United States Patent 11,484,585 (LIVE ATTENUATED CHOLERA VACCINE WITH PROBIOTIC PROPERTIES) - sequence listing, part 2

SEQ ID NO: 7 - DNA, 2988128 bp, Artificial Sequence (residues 1,494,065-2,988,128 of 2,988,128)
  Description of Artificial Sequence: Synthetic polynucleotide
  modified_base (53787)..(53835): a, c, t, g, unknown or other
  modified_base (54202)..(54585): a, c, t, g, unknown or other
  modified_base (402705)..(402796): a, c, t, g, unknown or other
  modified_base (403412)..(403518): a, c, t, g, unknown or other
  modified_base (403868)..(403908): a, c, t, g, unknown or other
  modified_base (404972)..(405005): a, c, t, g, unknown or other
  modified_base (1128757)..(1128757): a, c, t, g, unknown or other
  modified_base (1344014)..(1344127): a, c, t, g, unknown or other
  modified_base (1841570)..(1841570): a, c, t, g, unknown or other
  modified_base (2049369)..(2049369): a, c, t, g, unknown or other
  modified_base (2049380)..(2049380): a, c, t, g, unknown or other
  modified_base (2156929)..(2156929): a, c, t, g, unknown or other
  modified_base (2412676)..(2417775): a, c, t, g, unknown or other
  modified_base (2586765)..(2586850): a, c, t, g, unknown or other
  modified_base (2711933)..(2711951): a, c, t, g, unknown or other
  modified_base (2712050)..(2712057): a, c, t, g, unknown or other
  modified_base (2712156)..(2712240): a, c, t, g, unknown or other
  modified_base (2712527)..(2712530): a, c, t, g, unknown or other
  modified_base (2712713)..(2712774): a, c, t, g, unknown or other
  modified_base (2712849)..(2713015): a, c, t, g, unknown or other
  modified_base (2713069)..(2713160): a, c, t, g, unknown or other
  modified_base (2713236)..(2713287): a, c, t, g, unknown or other
  modified_base (2961163)..(2961292): a, c, t, g, unknown or other
  modified_base (2961614)..(2961742): a, c, t, g, unknown or other
  modified_base (2961874)..(2961946): a, c, t, g, unknown or other
  modified_base (2962138)..(2962217): a, c, t, g, unknown or other
  modified_base (2962333)..(2962592): a, c, t, g, unknown or other
atattgatcttcagtataacgagcaccggccgtcatcagagactggatggcagagcaggttaatgaaggcaaattgtactgttcacacaaccagcgtaagtagccgaggtagtcttcaatcgtttcttcttctatcttgagatctaattcaagctctgaaaacaaacataagccggaatgaatatcagcatctaaaaaatccagatcgccaagctgcgtgcgatcaccgacaacaataagtttaacgtcgtaacttgaacctaagcgattagggagcggagattttggatcgcaattgataggagagacagtttcacccaaaacggcggcttttactgttggccaatagcgtggattagccagcaataaattcgctgaaacaatcaaataaccgccattcgcttgttcgagatatcctgacgttttatgaactagaccaccatgctcaactttgacttggcctagaatctctgaaatatctaacgtctctgtactcacgacaggaacatcaagatcctgctcaagtaatgcgtctttaaagagagagcgataaatcgagttatcgggagcattaatcaagaggattcgactaaaccctttaaggtgaacaaactgttcaagcgcactggttaaacgaggctgaatctcgatcagtgaaatgggagctaggttagggtagttttcaaagactttgttaaactgctcaaattgaggcgttacactgcgccagatgctttgggtcattgagatatcgaactgattgaaaagagccaaattatatagaaaaagccgagcagcgaacagtgaaagtcgacgatgatctttctcgcttttttgatagggagaattgcaagtctgcagacagtgggttacgctgtcactgtataacaatggaaagtggccgaagatgaaatatcaacaacttgaaaatttagaatgtggttggaaatggcagtatctcatcaataaatggaaggatggagagcccgttactcgctatattgataaaagtgaaattgaagctgcggtacagaagctcagggcgatagaacatgaaccaacccatgtactgtcttggattgaagaacatatgtcctctgagctcgataacaaacttaaacaagcgatcagagccaagcgtaagcgccactttaatgcagaacaaatccatacacgcaagaaatctattgatttagattaccgagtttgggaaaaattatccctaaaagccaatgagttaggttgtacattatccgatgcgattgagtatctactcagcgaggcttcaagaagtgaaaaggcaagcaaaaccgtcaacagtttaaaagaagatctcagtcggttattagcagaataaggagatgtctcttatgaatatgctttatgtaatacttgtcgcggcgataattatcttctggctagtcgcgatcgatagacccatcttggtggtcagcttcaaagatggtcatcttgttcgtagcaagggacattttccgccaacattcaaacataaccttatcgatatcgctcaacatgaacctttttcaggggaaattaaggtgtatcaacaaaggactggagccaagctggcgttttcgaagcaagtcccgaaaaagatccagcaaagaatccgcaacgtattcccacaccaaggctttacacgccaaagctcgacattaaagaaaggtcgctaagcgtattaatcatccttgctcgacatcgtcattgcaagaaaaagcaggttaagctccaaacaacacaagttcaaactcgccaagaagatatttcggttacattttcctccttgcttaatcttggtgaggtgaatttgatgaagtttttgaggcgagtaatgttgagctcatcattattactcgagtgcggccgcattacgacgtttttgaccgaagccgttactggtattgaaaccatcaaaacgaccgcgacggagcatcgctttcttgagcagtggcaacgtattcttagccagcaactaaaccgtagctttgatgcacaaaaatcggggctcatcgctgggcaagctatcgctctggtgcagaagctgactgcggcactgctgctttggtggggcgtgagcgcggtactcaaaggtgaaatcactcccggtcagctagtggccttcaatatgctcgcaggccatgtgactcagcccgttctgcgactggcacaaatttggcaggattttcagcacactcttatcgcactgagaagggttggcgatattctcgatgaaccgagagaaaacagtaaacaaggcttagcgtccgtgcccgaactcgacggtggcattgagtttagtaacattcgctttcgttaccaccaagatgcccctgaggtactggccaatctatcactcaagatcaaaccggggcaatttatcggcgttactggaccatcaggttcaggcaaaagcacactcactcgcctgttgcaacgcttgtacgttccgcaacatggccaagtgctggtggatggaatggatcttgcgattgcggatcccgtgtctctgcgccgcaatatgagtgtggtactacaagagagcattcttttttccggaagtgtggcggacaatattcgtttatgtaaaccgcaggccagcgatgaagaaatccgtcatgccgctcaattagcaggtgcgttagcatttattgaaggacttccccacggctttaaccaaccggttggggaaaaaggtgcagcgctttcgggaggtcaaaggcaacgtatcgccttagcgagagccttgctggtcaatcctagaatcttactgctggatgaagcgacctctgctctcgactacaattctgaagcgtcaatcatgagcaatatggatgaaatatgtcgtggtcgcactgtgatcagtattgcccatcgcctcaataccatccgccatgctgacaacatctttgtcttggataaaggacaagtcgccgaaagcggtacacatgaagaactgcttgcccagcaagggctgtacgccaaactttggacgcaacaagtgggagaatagcaggttgagaattcggtagaagatccgcaggttaatgcaggctgagatctaccaatctagctatggattaaggaaacgtttcacaacctccatgatgtctttgctgcggatcggttttagtacaatgtcattcattcccgcatcaatacagttttgtttgtcactcccggcggtgtgagcagtgagtgcgataatggggatttcaatatgtttatctcggagtattttggttgcagcaataccatccataatcggcatggaaatatccattagcaccagatcaaatacatgatttttttctaaaagctccaccgcttgcagcccattttctgcaatcgtgacatcatagcccaacttattcagtagtaattgaatgaccatttgattggtctttgtgtcttccacaacaagaatgtgatgattttttacatttacgatttgttgggatgaggacgtactcggtttaatatttttcaagcgagattgaagtggaatatataaagtaaaggttgtgcctataccgaactcactttcaacttggattgtgccacccatcaattcaaccaaatgtttggtaatcgcaaggcctaaccctgtaccaccataatttcttgtaattgaattatccgcttgaataaagggggtaaataattgttctacccgattcttttcaatcccaattcctgtatctttgactcgaaatacgacgccatccttggtgtagtctaatactacatcaacttgaccttgtttagtgaacttgatggcgttaccaacaatattaaaaagtatctgtgtgagccttgccgaatcggtgtagtactctaatgttggattcttattcgattgaacataaaaatgcacacctttatcttgcgcaatctgtctgtgataaaccaaagattgatctagtttcttttctagatccaaccagtgacagtgtaatgaaaagtgcccagactcgattcggcttaaatctaaaatatcattgataataatgagaagaagttcggcagagttttccatctgctcaagcagctcaacttggtaactcgttgactctccacgtaaaatatcaatcaatccaagcaccgcattcaacggagttctgagctcatggctcatcatcgcgaggaagttggacttagattggttagcttgctctgccagtttttgcgccaaacgcagttcacgcgttcttatttctacgagtttttgtaactcttctttatgttcaatatctgagatagctctttctaacagcggcctaaaacgtgacaacgtctcttttgcttcaagagaaaactgacctttattctgccctaataagatgaggacagaatcgctgatttgagcttgaatcccagtaatcaaagcggaataaaccggcttatcaatcgaccccattaagcaggcaaactcatctaacttacaaggttcaaataacagaatgcactcaccattcagcacacgctgaaatttaactccgtttggccaaacaacatcattaaatgaggcatttgaggcaatcgccgtacgaaactggtgaccgtttttatctttggaaataacaataaaatcatcaaactgaatatatcgattcaataatgtttttaattcttcaaagatatgatttttgttggtggcaacactgaatgcagagatagcagcgagaattaccctattctcttctgcaagctgttttcctcgttcaatgcttctttgtaactcaagagtcaattcatttactttctctgtgtattcagaatccattttcatgcctcataaaatacaacagaagaaatcattaagttaccgtgcgcattttcaccattaataaaacggccttgctctccaaaagtgaagggacaaataaaagcgcaaccattgagctgctccattattttctgttgaaccttatgtatatcttgaccaagcctcaacatggaaccagcacagaatatagttaaagaaccaaataacgcccgatcttggtaacttttataactcgcttcctgaataacgcgcgtcacacgttcaataagctgattttgcgatcccgtcatcaagcttacttgctctccgacttccacattcgcaaacatttctagcccgccattttcagtccttctcacggggtgagtaagcttatattgcgttgaacagctctcctcctttcccaccactctccctaaaggaaaccgagtcacatgttcgaaaaggtactgttccgtgatttgaattcctgagtgatccccaatccactctttataaagtccactggccgattcgttatcaatttcctcaatcactcgacctttggctttcgtgatcacaccagaaaattcggttggagaatacccagcgctgaatccaccaaaaaccgactgcgatggaaacatcaattgcaatgcaatgcctttatcggtagcaccttcctgcgtgaagatagaccaattttgactgatgaaattatccgcagcactcccgccaataatggggacttgagagccaaacttgttatcgattccttcaatcaaaacttcttcaataccgggggtggcatgcaaaagcacaagactaggtaactctcccgttctatcggcactttctagtgcattatcaatcgcttgatcaattaactcagggatggggcgattatcgcaaagagagatcaatgccgtgccgtaagcagcctgaggactatcataaatccccatgattcccactgccggattggaaaaatacccatcttgcgtcatcacaccacgacaggaagaacatccgataattggaatgccgggaaatgccgcttttaacattgaggataaaagttgagcatcgtattcttcagtgaaatagcagattaaattcgataaaccattactatccatagactgttgtagttcatggatacaagaatagacatcaacttgagtagaaacggttgtttttagccgcattgaacgagttttgtatacgtgagatgacactatttatacctgatatatcggagtgtttaaatagcgccaatctatggtttaggcgttgagtgatgattctacggtaggtaacgcagttttagtgtgatgccatggttaattttaagctcgatattgtcttgcgttgttggggacactaatagcactccagactggaattccgtcgaaccattcacttcgattgaccattgctcatcccatggcgaaatggagtacttgggaacgtctcgtgacccgagttgagagacagtcacccgcttcccctctatatcaaattgacaaggcttttccattccacaggtgatgtgcgtaccactttcatgtgagaaggttcgccatagaaaagcactaatcaacaccagcaaggtgattaggatttgagcaagtcgggcttttgtgagtttttcggctgccatgaacgcgggttcctcgtgtaacaaacttcaaatttttgaaataaaaggccaaaacctgatggagtgtaaggttactacactgtcattgaattgttaattgaagtatagttagacgttgaaaatgccactttttcataaagtcagcaacaagaattaacagtttagatgtcattgtttttgttgtggatttgggtggtgttacgacgaaagtcgtgttggaagtaaaagtgtagttaattaaacattggaagcatgcaaatgagccaagaaaagcagcttgaacaaaactacaactataccgtggtccgccaatttaccctggtaacaattctctggggtatcgtcggtatggctgtaggggttttgattgccgctcaattagtttggccacagctaaactttgatacgccgtggttgacgtacagtcgcttacgtcctctgcatactaatgcggtaatttttgcgtttggtacaagtgccctgtttgcaacatcatattatgttgtgcagcgtacttgccaaactcgtctgttcggtggaccgttagttccctttaccttttggggatggcaagcgattatcgtttccgctgcaatcaccttacctttgggttacacctcaggtaaagagtacgcagaactggaatggccaatcgacatcgccatcgcagcggtttgggtcgcttatgcggttgtgttctttggaaccctagtaaaacgtaaaacatctcatatttacgtggctaactggttcttcggtgcctttattattaccgttgcggtattgcacattgtaaacagtatggcgctccccgtttcgatgggtaagtcttactctatctacgctggtgccgtcgatgccatggtgcaatggtggtatggtcacaacgctgtaggtttcctgctcacggccggcttcctaggcatgatgtactactttgttcctaaacaagctgaacgcccagtctactcttaccgtctgtctatcgttcacttttgggctctgatttctctctatatttgggcaggtccgcaccatttgcattacaccgcactacctgactggactcagtctttgggcatggtaatgtctctcgtgctgttcgcaccctcttggggtgggatgatcaacggtatcatgactctttctggtgcatggcataagctgcgctatgatccgattcttcgtttcttgatcgtttctctgtctttctacggcatgtctacgtttgaaggcccgatgatgtcaatcaagaccgtcaatgctttatcccactacaccgactggacgattggtcacgttcactctggtgcgcttggttgggtagcaatggtgtcgattggttctgtttaccatcttatcccacgtctttttggacaagagcgcatgtactctgtcagtctgatcaacgctcacttctggttagccacgattggtacagttctgtacatcgttgcaatgtggatctctggcgtaatgcaaggtttgatgtggcgtgcagtgaactctgacggcacactgacatacagctttgtcgagtcagtgcaagcgtcatatccgttctataccgtgcgtttcatcggtggtttcatcttcttgtctgggatgttcctgatggcttacaacgcctataagaccatttctgcacctaaaaatagcctaaaagctattgtgcaaccggcataaggagaattaagcaatgagttctaattctaataatcgccatgaactacttgagcgtaatgtcggcttactggctattttcattgtttttgccatcagttggggtgctctggttgagattactccattgattttccaaaaacagaccacggaagaagtacagaacctcaaaccttataccgcgttgcaactcgaaggtcgcgacatttacatccgtgaaggttgtaacgtttgtcacagccagatggtgcgcccattccgttctgaaaccgagcgttatggccattactctgtggcaggtgaaagtgtttgggaacacccatttttatggggctctaagcgtactggtcctgacttagcacgtgtgggtggtcgttattctgatgaatggcaccgtgttcacctattgaacccacgtgaactggttcctgagtcaaatatgcctgcattcccatggctggcaaaaaacactctggacggtaaatacacgcaacaaaagatgaccttgttccgtgacaagtttggtgttccatacacagatgaacaaatcgcaaatgcgacaaaagatgtagaaggtaaaacagagatggatgccatcattgcttatcttcaatctcttggtcatgcaatgaaatagcagaggtaattatggatatcggtactattcacagtatttggaccatagtgctgttcatatgctttataggcgtggtttggtgggcttatggcaaaaagcgtaaagcgcgttttgatgaagctgcaaacctcatcttcgccgatgaagagcaaaatacctcgaaaaacaaggagtgactaagtaatgactacattctggagtctttggatcatcgtgattactgtgggtactttgctcggttgcgctattctgctcgtttggtgtctgaaagacaaaatgggtgttgaagaaggcgttgacatgggccatgagtacgatggcattcgcgagttgaacaacccgttgccaaaatggtggacctatctatttattggtactttcatttttgcagccatttatttaaccctttacccaggtttaggcagctttaaaggcattctcggctggcaaagttcagaccagaccgtacgttctcttgaagaatcacgtgcttcgattgctgccgcacagcaaaacaaacaactggttcagtattcaaaagaactggacgacgctgaagcttactacggtgaagctttcaaacgtttggcttatcaagacggcaccactaacttacgcgaaatcccagatatcgctgccgatagtgatgctttaaaagtaggtcaacgcctgtttttacagaactgctctcaatgtcacggctcagatgctcgcggccaaaaaggctttcctaacttgactgatgatgcatggctgtatggtggtgaaccacaagcgattgtgaccaccattcgccatggccgtattggccaaatgccagcatggaaagacattttaggcgagcaaggtgtgaaggaagtcgttagttacaccttaagcctgtcgggtcgttctgtgaatgctaaagaagcagaagcaggtaaagctcgtttcgccgtttgttctgcatgtcatggtactgacggtaaaggtaacccagcctttggtgcaccaaacctaacggataatgactggttatttggcgattcacgcgcagaagtaaccgagacggttatgaacggtcgctcaggtgttatgcctgcgtggatcaatactttaggtgaagaaaagattcaattggttgccgcttatgtatggagcttaagcaactcagagaataagtaacattctaataacagccccttttcaaggggctgtctttcttatattttttagcctcttttcgttgtagagaactttcttatggtaaagccttggtataaacaattttggccttggttcctgatcatactacctctcactgtagtgatctggacggtcgtcaccgttattgtttttgcaaataactccgtttcattagtcactgaggattactataaaaaaggcaaaggcattaatattgatcttactaaaatcaatgtcgccaaagagttgggattgaacgctaccgttcactctgaaggtagcacggtcatcattgaattcgacaaaggtcaacttgctcacttccctgctattcaagccatgtttgctcatcgcacactgcctgatcgcgatttttctcagctgattacggctgatgcaaaaggaatttatcgtttaaatctggagaatgaactgcaaggcccttggtttatcgaactgactccgcatgatggccaatggcttgtccaaggtcgcgtcaccttcccctcttctccaacggcattaatgaattaagatcatggacaaaacgtgttatcactgcggtgaggatgtacctgccggcacaaatttccacgttgatattttgggtgaacaacgtgacatgtgctgccccggctgccaaacggttgctcaaaccattgtcgatagtggcctcgtttcttactaccaattccgcaccgcgccagcggaaaaagtggaattggttcccgagcaattgaaagctttgattcactacgacaatagtgatgtccaagccgagtttgtgcgtagcaaagatgaccactctgaggtgacattgtcactcgatggtgtttcatgtgccgcctgtgcgtggttaattgaaaaacagctacacaccgagccgggcgtagtctctattcgagtcaatacaacaaccaatcgagcgctcctcagctgggaccgaaccaaaacccagctaagccatgtattagctcaaattcataaactgggttataaagccgcgccttttgaagctgacaagcatgaagcgcaataccacgatgccatgaaaacatacttgtatcgtcttggtatcgcgggattggcgagcatgcaggtgatgatgctggctgtcgcactttatctcgaggcgtttggcgatctggatgctgagtttaaaaactatttccgctgggtgagcttaatttttgctactcctgtcttactctactcggcccttccattttacctaaatgcatggcgcagtattcgtggtcgcactttaggcatggatgtccccgtctctctcgcactcatctttgcttatatagcaagcttagtcgcaaccattaccgaacaaggtgaagtgttcttcgaatcgatctccatgtttaccttcttcttattggtaggccgctttttagagatgagagcgagacgtaaggcggctgccgcaagtggtaacctgttgaaactcatccccgcgattgcaacaacgttagacggtcaacaagtaccggtaaaaacgctcaagcccggcgactgtgtacgagttttgcctggtgaacacattccagcagatggtgaaatcattaataaccgagttcatattgatgaatctatgttaacgggtgagtctttacccgttgtcaaagcgacaggggatcacgtgtttgctggaacactgaatggtgatgaatcgtttgatctgcgtgtcaccgcttcaaaagccgattcagttatttccaatattgtgagactgcaagatgatgctcaatcctccaagccaaaaattgcggaaattgccgatattgtggcgcgttactttgttgccatcatattagttattgctgcaggcacatggtttttctggcatcaggtacgacctgaagatgcgttttggattatgctttcggtattagtcgccacctgcccttgcgcactttctctcgcaacaccgaccgccttgacctgcgcgacctccagtatgggtagcgttggagtaatgttacgcaaaaatcacgtgttcgaaacgctttgcaaagtgaatcatttagtcatcgacaaaacgggcaccctcacccatggcaatattgaaattagcactgtcgaaaccctggattcattaacgaaagaatcttgtctggcgatagcggctgaacttgagagccatgccaaccacccaatagctaaagcctttcgtccttataaggcagaaaatgtcacggtgagcgaagtaagaaatatcatcggaagcgggatggaaggtgtctttgcaggacaaaaagtcaaaattggcagcgcagaatttgtgttaggcaatccactagactccgcacacaattgtgttttcttatcgctggatggacgacatgttgccaccttccattaccgagatccaattcgtaaagaagctaaagcgtttatagagaaattccatgctgcaggaatcaaaatcactttattgacaggagactcacaaaccaatgcccaaagcgttgctaatgagatgcaaatcgataaggtagtcgcccaggcgaagcccgaagacaagcttacctatctacgagaattgaataaaaccgacgtgactatgatggttggtgatggtattaacgatgctccaacactagctggtgctcatatttctgttgcgatgggcggaggtacagatgtcgctaaagcctcagcagatatggtactcattggtgatcgcttagataaattgcttgaggcaagagagctcgcgctgaaaacgcgtaaaatcattcgcgaaaaccttgcttggtcgttgggttacaacttactgattttacctcttgccgtggcaggattagtcgcgccctatattgcagtggtagggatgtcgggaagttcgattattgtcgtgaccaactcacttcgtctgctgaaaaagcaagggagataaccggtggaaagcttatatttgctcatcccaattgcgattgtgttagtttgtgtcgcggtcggtatttttttgtgggcagtcaaaagtgagcaatttgaagatcttgagcgccaaggccacaacatcttatttgaagatgaagagagccaagataaggataaacggtgagtcctgattatttgggggcttgggtggtaggcctgctgggagcgggtcactgtttgggcatgtgcggcggcattagcgctttgcttacccttgatccgtctaaaagctcaccagcactgctactttattacaatctaggtcgcctgctgagctacgccttaattggcggcattgtcggtggcatcaccgcttcactgacagagctcattgatgttcaatccgccttagtgtggcttcgaattttcgcagctgtgttgatgattgtattaggcctttacatcggacgctggtggtttggactactgtggcttgaaaaagtcggccagaaaatctggcgatggatttcaccgctaggcaaaactcttttgccgctaaaaaaacagtggcatgcactacccttcggccttgtgtggggctggcttccttgtggtttagtctactctatgttgacttggtctgccgtggcaggcagtttctcacaaggggcacttattatgttgtcatttgggtttggcaccctacccgccatgctagccagtggctggggagccaataaattaatgcattggcaaaattcgcatttatttcgtcaatgcgcggcaatactggtgattgggtatgggctattcactgcctacgatgccgtaaagctgatgattaatctgggttaatggtttagaggtcgctgatgtattttaactaccctttagggttaagcgatgctaaaatattgacgtacatcaattagtgaaaggttgttatgatttctgaaaagcctgctgcgaagcgcattcaatcgggtggttgtgctattcactgtcaagattgcagtattagccaactctgtatcccttttaccttgaatgagtctgagcttgatcagcttgaccagatcattgagcgtaaaaaaccgatccagaaaggtcaggagctgtttaaagcgggtgacgaactgagatctttatacgcaattcgttctggtacgattaaaagctacaccatcactgagcaaggtgatgagcagatcacagcctttcatctggctggtgatttagttggttttgatgcaattactggagatcagcacccaagctttgctcaagcgcttgagacctccatggtttgtgaaatcccgtatgaaatcttggatgacctgtctggcaaaatgccgaaactgcgtcaacaaatcatgcgtttaatgagtaacgaaattaaaggcgatcaggagatgatcctgctgctttcaaagaagaacgctgaagaacgtttagcggccttcttgtacaacctttctactcgtttctctcaacgcggttttagcccaagagagtttcgtcttaccatgacacgtggtgatattggtaactaccttggtcttactgttgaaaccatcagccgcttgctcggtcgtttccaaaaatcagaaatcctaagtgttaaaggcaaatacatcactattctcaaccatgcagaattgatggaattggctggcgtatctaaagaatctaaataacttcaatgatgtagctcttaatgagctacatcatatttcttccaaatacctcttctttttactaaaactctgctcataactaagctaaagtgaagctaacaaacctcctcactgaacaaggagtttctcatgagcatttatagtaaaattcttgtcgtggctgatatcaaccatgatgaacaacctgctttggctcgggcaatgcaactggcacaaaaaagcacctccgtcagccatatcactttcttcctatcgatttacgatttttcttatgacatgacctccatgctttctctcgaagagcgtgatgccatgcgcaagggagtgatccatcaacgagaacagtggatgcgctctattgcagagccttatctagataaatccgttcagtttgacattaaggtggtgtggcacaaccgtccttacgaagcgattattggtgaaatttttgcgggtgaacacgatatcctgatcaaagcgactcgcaaacacgacatgctagagtccgttattttcactccaaccgattggcacttgatgcgtaagtgtccgacaccggtcttgttagtcaaaaatgctgactggccagaaaatgccaatatcattgcctctgtgcatgttggctctgagctagatacccatattgatttgaatgatcgtatggtcgaacagctccttaatttgagcaaacgcttaggagcgagtccttatcttgtcaacgcttatccagtcactccagccaacatcactattgagctgccggagtttgatccaaccacctataccgatgcggttcgaggacatcaccttacggcgatgaaggctcttcgccaaaaacatggtttaagtgaagagcaaacgcttgtccaacaaggattgcccgaagatgtgatcccagaagcggccaaacagcttaatgcagccatggtgattctgggcacaacaggtagaacgggactttcggcggtatttatcggcaacactgcagaacatgtcatcgataaaattaactgtgatgtgcttgccctcaaacccaatggctacgtaagccccctcgatccacagacagccatttagttctcctcagcagtccctgccgtatggcagggattttttatctcttcacactatagatctggcatctctgctatttatccgtatcatacgcacttcattttgttctgagatttaagatagcaagcaatgacagcgcaaactcaagagttgaccaaagctcaacaatacaatttcaataagttgcaaaaacgtattcgtcgtaatactggtcaagcaattgcagactttaatatgatcgaagatggcgaccggattatggtatgtctatctggcggtaaagacagctttaccatgctggatattttgatgagcctgcagaaaagtgcgcctatctcttttgaattggttgctgtcaatctcgatcaaaaacaaccgggatttcctgagcatgtcttgcctgaatacctagagagtttgggggttgagtacaagatcgtagaagaagacacctacgccatcgtgcaagataaagtgcctgaaggcaaaactacctgcgcactctgctctcgtctgcgtcgcggtatcttataccgtaccgccaaagagttaggagcaaccaaaattgctttgggtcaccatcgtgatgacatcttagaaactctgttcttgaatatgttctatggcggcaaaatgaaaggcatgccacctaagctagtatcagacaacggcgaacatgtggttattcgcccgttggcctactgccgcgagaaagacatcatcaaatattcagatatgcgcggctacccgatcattccatgtaacttgtgtgggtcacagcctaacttacagcgccaagcggtaaaacagatgcttaatgactgggataagcgcttccctggccgtattgaaaccatgtttagagccatgcaaaacgtggtgccaagccaccttgcagacttctctttgttcgattttaaatcgattgataaaaactctggcgtcattaatggtggtgatattggctttgataaagaagaaattgcaccgcaagtcgtggaagatgaagacttagtgatggagtttgacccatcactccagttaaatgtcaccaatatctaggtggcttcaaaagcataaaaacaaacaaaggctgtctactgacagcctttgttttatgtctttcaatcgctaaagcttacttttttgcagaaggtaagtaaggtaaaactcgcaaagctggagccggcagttgcatccacccttctttaccaatttgcgttagcgctacttgcgccttgtgattcgcaatcgcaatggattgaccattactgaacgtaatcattccctctgtctctggggcgaattctaaggtaacgccttcaaccgcgggcgtaaaccaactggcaaacatgccgccaagctgttcaagcattacctgcatctgcggcaacaagacctcgacttcctgataagtcaccttaccctcaaacgactttttcgccatcaccaccatagaataatcacagcgtttatcttgcggtgtattcacaaaaacgagtggattcgcctgtctcagattgttatcgagtgggatcaccagctcattactagggccaatgggtaactcttcgtagtgttcttccttttccatccacgctttttctatcacgcagttttgtttactctgtgcatcaacaaagaaaatccccatttttacatcaggatgatcttcttttgtgttgcttttcatttgagagaacaacttgctgtaggtaaacatatattgctgcgccaaagctggagcacttaggcttaaaaacaaaggggcaagtatgaggtaagattttgatttcattctaattatcgttccaatattcttgattcgctaacatcatggcttgtaaatcacgcacataggcttcaccacgctcggaatattttaaaaggccattactcatcgctttagcactttcatcgctgttggggttgattttctgctggcgaagctgaaagcgtatttcacgtaattctcgataagcaggattacgattgacattcataaaatagctttgaattgagtcttgaacgctgtcaaatttagccacttcatggaacgctccctccgctctcgctaacggtactaagccacatcccgcgctataacaccattgaccaaaatagttgttggcttctttggcaaatcttgaggttccccatgccgattcattcgcagcttgagttaagactaaggcttcaggtaccacatcgacgcgatgaaacatttcctgcaaccaagcgttatcaacgttgttttctgtcagtgccacagaatacgcagttgccaaatgttgtgcttgtgccagattgtgagatgagagctgaccgtcggcaaaatccttttttattcgcttcaatagtgttcgttcttgaagaatccgcgaattttcatacctcacaccgggttttaagtagttaaaaaaagcctctttccgctcagcaatgtcgtggattgcagagaaatcaggggctgcaccgaccacttctcctctgagcaaaggtaacttgaacttcttcggtttctcaaatcgatacacgccaaacatggcgatgaagacaatgattaaccaaaccagggtaatggttattcgcttatgcatcaaaaattccagaagagttgttgttatcaggttggtcaggctgagcttgatccgttgcgatgattttcaagcgaatgccaaacatgttgcgataaataatgcctttaacatgaaagaagaaaggcaagaacaacactaaaccaataccgtacagaagtacggccatcatgaacagcaccatcaagatcgaatagatagcgattaacgggaaaatctttttattcactgctcgcaatgacaataacaaagattgcataggtgggactttcttttcacaaatcaatagtaatgagttactgaaagccacagagagatacatagaaaggaatggcagaatcatccctgccacaccttgtaacaataaactgaacagagtggcgaggataacagggatcgtaaactgtaatcctttcgtgatatgccgagtttgggtttttagccctgccgcgtgactcatcgccattaaactgatgcctgcataaatcggcgcgctgatcacttcatagctaaagttagcaataaacatggcttggactaggccttcgggcagcgcaccgccctcctgaaacacagacagaatcacggagagatcgccgatctgcaatttgaacgcaaaataaaaaatcgccaactgcaccaaaatcagcgcaaaaatggcaggcgtaaaattaatgaagtgcttgactgtaataccccaagcttccttgagtacatcacccacttttaattcataacttcccgatagcgctttctctaccgagccgccaagattgaactctctttcgatatcgttattcataaaatgccctagttcggtcgaatgcgcggataacgtcacgcttcaacgtgaaaattgtgttcattatactgaaatgctgctcaggctaaaatctgattaccaatatcatcttgctttattgtcgatatgattgataattaaccgcttgatagcattaagagttaagcaaaatcagtatgctagacaaactctattcaaactggcaaaaatttttctgtttcaaggtgagaaaaagactttgaaatcgtgctcttggtgtttatgatgcgccccttatttttgtttaactacaggtccaacaagtaggattttctacaggccgaggtgggagaaatacagacgttgaacgaacaacattcagtaggaaagccagtcattcgtttatctggcattagcaaaagtttcgatggtaaggaaatcattggtaacctaaatcttgatgtgaatcatggcgagttcttaaccatcctaggtccatcgggctgtggtaaaacgacggtgttaagaatgattgctggttttgaaactgcagatcaaggtcagattctgctagatgatcaagacgttactcaagttcctgctgaacaacgacacgtcaatacggtcttccaaagctatgctctattcccccacatgacagtgttcgaaaacgtcgcttttggtttgcgcatgcaaaaagtccctcaaagcgaaatcgaacctcgtgttatggaagcactacgcatggtgcgccttgccgaaatggcacagcgtaaaccgcatcaactttctggtggccagcagcaacgtatcgctattgcgcgcgcagtggttaacaaacctaaagtactgctacttgacgaatcgctctccgctttggattacaaattgcgtaaacaaatgcagagcgagctcaaacaactacaacgtcaattaggcattacctttatcttcgttactcacgatcaagaagaagcgctgtctatgtcagatcgcatcatcgttatgcgttcaggcaaaattgaacaagacggctctcctcgtgaaatctacgaagatccaaaaaatctctttgttgctcgttttatcggcgaaatcaacgtcttccaagcaacgactatcgatcgtatcgacgaaaaacgcatccgcgttgacatcgaaggtatcgagtcgattgtttactatgaagatgaagtgaaggctggtgacaagctgcaagtgctcctccgtcctgaagacttacgtatcgaagaaatcaaagagtcagaagaaaaaggcattgtgggtcacgtgactgaccgtacctacaaaggcatgactctggaatcagtggtagaactggaatccggtatgtgtgtgatggttagcgaattctttaacgaagatgatccagatgttgatcactctatcggacagaaagttgccgtcacttgggttgaaagctgggaggtagtcctcaatgatgagcaaaaagcttaatctacaaaatgcgattgttaccttaatcgtaggttggttagtgctgtttgtactgatccccaacctgatgattattggtacgagttttctgactcgtgatgaagcgaacctgattaagtttgcattcacctttgaaaactacacgcgtctgcttgatccactatacggaaaagtgatgctgcactcgttctacatggcgattgttgcaacattaatctgtctagtgattggttatccttttgcgtacatagtggcgaaaatgcctgaaaaatggcgtccatttatgctgtttttgattattgttcctttctggaccaactcactcatccgcacctatggtttaaaaatcgtactcggcacgcaaggtattcttaatcaagcgctaatgtctctgggccttattgatgcaccactgcgcattatgtttaccgaaacagccgtcatgatcggtctggtttacattttgttgccatttatgatccttccgctctattcggctatcgaaaaattggatggcacttatattgaagcggcgcgcgatctcggtgccaacaagtttcaaactttggttcgcgtgattttaccgctgactatgcctggcattattggtggttgtttgctagttctgctccctgccctcggtatgttctacatcgctgacctactcggcggtgcgaaaaacctgctgatcggtaacgtgattaagagccaagtactcaacgcccgtgactggccatttggtgccgcaaccagtattgcactgactctggccatggcgatcatgctgtacgcctactatcgtgcaggtaaacttttgaataagaaggtggagctagactaatgggacgttcaattagatttagctttatgagtttggtgtacttatttttgtacttaccaatcatcgttctgattgcaaactcatttaacgaaaacaagtttggtatcaaatggggcggttttaccaccaagtggtaccacgctttgatgaataacgacagcttaatgcaagccgcttggcactccatcaacgtagcggtgttttctgctactgcagcaaccttgatcggtagtttgacggcggttgccctcttccgctaccaatttaaaggtaagaaagtggtgagtggcatgctgtttgtcgtgatgatgtcacccgatatcgtgatggctatttcgctgcttgctctattcttagtgatgggagcgaaactgggcttcttcactctgttgattgcgcacatcactttctgtctgcctttcgttgtggtgacggtttacactcgactcaacggctttgacgttaagatgcttgaagcagcaaaagacctcggcgctggcgaatgggtgattttaaagaaaattatcctgccactggcgaagcctgcggttgccgcaggttggttactgagctttaccctatctctggatgatgtgatcatcagttcatttgtgacagggccaacctacgaaattctgccattgaagatatactcaatggtaaaagtgggtatttcacctgaagtaaacgcactggcgaccgtcatgcttgtggtttctttggtacttgttgtcgcttcacagttgttagcaagagaaaaagtgaagtaaaatccacgtccgtttggaaacacgcgaaacagaatgacggaagtcattctgtttttctttgcaacgcccaaaagggcaacgtttagtttggagctaacgtcgatgaaaaaactggctactcttttagcaggtagcgcatgtgcgctttctctgttgtctggcacagcggcagcggaagataaggaactggtgtttatgaactggggaccgtatatcaatagcggtatcctagaacagttcaccaaggaaacgggaatcaaagtgatttactcaacttatgagtcaaatgaaactttgtatgcaaaactcaaaacgcacaatcaaggttatgatctggtagttccttctacctacttcgtggcaaaaatgcgtgatgaagggatgctgcaaaaaattgacaaatctaagctgagcaacttcaaaaacctagattccaactacctagataaaccttacgacccaaacaacgactactcaattccacacgttgtagcaattaccggtctcgcggttaataccgacatgtatgatcctaatgacttccaaagttggggcgatctatggaagcctgagctaaaaggtcaactgatgttgatggatgatacgcgtgaagtattccatatcgctctgcgtaaactgggttactcaggtaactcaacggacgacaagcagattgatgaagcgtatgccgagctacaaaagctgatgccaaacgtactggttttcaactctgataaccctgcagctccttacctttcaggtgaagtaggtcttggtatgctgtggaacggctcagcagcggcggcacagaaagaaggtttaccaatcaagctagtcttcccgaaagaaggcggtatcggttgggttgataacttcgccatctcttctggtgccaaaaacgtcgatgcagcacacaagatgatcgatttcttgttacgtcctgaaattgcagagcaaatttcacgcgacacaggttatctgactggcgttaaagcctcaaacgacaaattccaagatgtcgcgccactgttcccatctcaagaagatctggaccgtgttgagtggcaatctgccgttggcgataagacagtgaagtatgaagagtacttcatgaagttgaaagctggccaataaggtctaagaaaagcatcaaataggcagccattgctgcctatttttttttatcttgttatactcccctctccaacgcctagttaggttctttctatacactatgggaacgtaatgaaaaataaactgtttgcgagtgctctgtgcgcagcagcattgttcaccaccaatgcaatggctaaagaccaagaactttatttctacaactggtctgaatatatcccgagcgaagtcctagaagactttaccaaagaaaccggaatcaaggttatctactctacctacgaatccaatgaaagcatgtatgccaagctcaaaacgcaaggcgctggttatgatcttgtggttccttccacttattttgtctctaagatgcgcaaagaaggcatgctgcaagagattgaccattcaaaactctcacatttcaaagacttggatccaaactatctcaacaagccttttgatccaggcaataaattctctatcccttatatctggggagcgacgggtatcggcattaacaccgatatgctggataaaaaatcactcaaaaactggggcgatctgtgggatgccaaatgggcaggtcaattaatgctgatggatgacgctcgtgaagtcttccatatcgccctgagtaagctgggatactcgcctaacacgaccaatcccaaagagattaaagccgcttaccgtgagttgaaaaagctgatgccaaatgtcttagtgtttaactctgacttcccggccaatccttacctcgctggtgaagtgtcactaggtatgttatggaatggctcagcgtatatggcccgccaagaaggcgcaccaatccagattatctggcctgaaaaaggcaccattttttggatggacagcatctcgattcctgccggagccaaaaatatcgaggccgcccacaagatgattgacttcttactgcgcccagaaaatgctgcaaaaatcgccttagaaatcggctatccaacaccagttaaaaccgcgcatgacctactgcccaaagagtttgcgaatgacccaagtatctacccaccacaatcagtgatagacaatggcgagtggcaagatgaagttggagaagctagcgtgctttacgatgagtatttccaaaagctaaaagtgaacgattaagccttttatctcccattaaaaagccaccgacgacggtggcttttttgtatcttcagaatgcgattcactctagagagtgaaaaagcgaacgctcaagtcatgtaacgaaaataatcgatttaattcagcctgatagattaaatcacttataaacctatctcttctgagagcgccttaatctcttccagatccatttgatgcacacggatcatctgatcaatttggcttacccgtgaattcgcttcatcttgtttatcacaggcatccgacttcgcatcccatgatttcccttcaaggtaaatgtcacactcttttttcagtactttgagcttgggaaccagagaatcgcgctctttttgtaatccctcgagttcttgtttgatttttagttctcgttggaacaactctcgagaacgctcaagcatggtcacttgcatatcggcttgacgattaagctgattgttttgtgtattggccagttccaatgccattttctgctcgttcagttgctgttctaaattaagattttgcttttcgagttcagcaacgtatttatcacgctgtacagcctctgcctgccactcttctctttgcttctctaaagcctgatccattttatgttgccacgcttcctcttgattttgctcagaaagctcagccgctttagaaacttctgctttcgcattattgagttgttcaagctggttttgtagtgcttggtaagacgtctcccaacgactggtggtgacagtggaaccaatcagaccacccaaggcaatacctaataccgcagcaatcgcgatatagagatagctctgtttatctcttcgttcgataacaacaacttcttcgttgtcgtcaaactcattatgtttattcacgctcgctcctcttgcgtcagcgaatcagttcagaaatcatcaagaaggccgtataggtgacaaaggtcgccaaaatgacgataacgacccccttctgcaatttttcattggtacggtagcgaatcaacacaaacgctaatgctatcagtaaggctattgcaattaatctcaccatctcccgcctccaagcgtgattatcttataacacttatacgtagtttaacgtcagagaaaagtggattagcaaaagacttgcgcaacatttcatcagttaatttcttttgtaggtgacatcacattttcttttcgctagtatccgccttgcaaatcgttttattcaagacgattgttccgttgaagactgcaggagagtggttgttaaccagattttaacatctgagccaaataacccgccgaagaagtaaatctttcaggtgcattattcttagccatatattggcaacgaataagcgaggactgtagttggaggaacctctggagagaaccgtttaatcggtcgccgaaggagcaagctctgcgcatatgcagagtgaaactctcaggcaaaaggacagaggagtgaaaggccaatcttttagtgagctcgctagagctctgctgtgcatttttcgcaccctttctctcttctccttatgtttattttttaaggggaaatcatgaataacctgcaatcttttctgcaaactgttgatagtttagtgtggggtccaccactgttaattcttctggtcggcactggtgtctatttcaccttccgcttgggcttactgcaatttcgacgcctgccgacggctttagctatggtatttggccgcgaaaaatcttcagacaaacaaggtgatgtatcaagcttcgccgcattgtgtactgctctttctgccaccattggtactggaaacatcgtaggcgttgcgaccgcaatcaagctcggcggcccaggtgccctgttctggatgtggctcgccgccctgtttggcatggcaaccaaatacgcagaatgcttactcgcggtgaaatatcgccaaatcgatgacaaaggacaaatggtcggcgggccaatgtactacctgcgtgatggtgtgagttcaaaaacactggcagtattatttgctgtgtttgccgtaggggttgcctgcttcgggattggcactttcccacaagtgaacgcgatcttagatgccactcaaatctcttttggtgtccctcgtgaagcctctgcggtggtactgaccgtactggttgccattgtcactatcggtggtattcaatccatcgctaaagtggcaggaaaagtggttcctgcgatggcgctgttttatatcatcgcctgcttaagtgtgattgttaccaatgcagacaaactcgcagacgccgtggaattggtgctggtatccgcgttcacctcaactgctgcaactggtggcttcttaggtgcgagcattatgctcgcgattcaatcgggtattgctcgcggcgtattctccaatgaatctggcttaggcagtgcgcctatggcggcggcggcggcgaaaactgactcctgcgttgaacagggtcttatctctatgacggggaccttcttcgataccatcatcatctgtacgatgactggcttggctctcattctaacgggcgcttggcaaagcgatctttccggtgcagcgatgaccacctacgcctttgccacaggcttaaatgcacaaactatcggtccgatgctggtttccattggtttgatgttctttgcctttacgaccattctgggttggaactactacggcgaacgctgcatggtgttcttattcggaaccaaagcggtattgccttataaaatcgtctttattggcttgattgcctcaggcgcattcctgcacctcgatttgatttggattatcgccgacattgtaaatggtttaatggccattccgaaccttattggccttgttgccttacgccatgtggtcgtggaagaaacgaagcaatattttgccgcgcgttatcaatactccgaagccgaagcccaagttcaataacacctagtcgctctaagcacaaagaaaaagcgcccaacggcgctttttctacttttaaacctttattacaagctaggcttgaggtttctctaagagcagtttgatacctaatgcgaccaaaacaactcccgttgtaccttccatccaacgcataaaagaagcgtttttcagaaggtttttagcgctactcaaagcaccggctaaaccacattgccataccatcgcaatcgcaaaatgaatcaacgccatcagcaaagattgcgctaacggtgaatagtcaggattaataaattgaggcagaaaagctaagtaaaagacggcagttttcgggttcagcacattcgagaggaaaccttcacgcagcgatcgggttaagcgaaattgtgcatgagctaggctagcaacctcaatgccctgccctgttttcattaatgatcgtaggctcgaaatacccaaccaaatcagataagccgctcccaccattttaacgatttgaaatagctcagccgattgagcaagaatcgcagagataccaatagcagaaaaagtggcgtgaacgaataagccaaaacagatacccaagctggtcgtgcatccatcggcaaacccagcccgcgaagtgttacggatcaccaaagcagtatctagccccggtgttaaagtcaaaatagtaatagcgataaaaaaagcttcgaaattctggataaccatatcaatccttgaaggaaaatcagcaagcctttcttataccgcaaagcctctcatgtgtcttatgaagatttttcaactcacgctaagttactcgccaagcgttttaatctcattgatggaatagactttattcactttatcccaagggataggctctagctcaacacctgcatccttagcgcgttgctgaacatcaacaaaagaggaagacttccgataagaatcaaatttaacgccattactgtcgcggtcaagtatttggtcaggtgctagctcggtcaaataaatagtctcaccacagccactcaaccacaccttagcttgcccattaggcagaagaccaaaaataaactctgtgcgataacatggatcaacaataaatccattccatttagtataagtttttttcgtagctactaactgttttacgttgtcaggaatctcatacttagtgacataaaatttggtatcaaacaatgaaacccagtacatatagagtgtatcaggcagctgggtggtacctacaccaatttggcttctgcttgtaatacctaaggcatgtggcagcccaaaaccatcatagtcaggaaatatctgatggatataactgatatcactatcactcacaaaagtcataaagttatgaattaagacggtccaatcctctttattattcacgccatagactcgagtaacgttgactggataaaaagagggcattgttacaccaactcgccaagtccatggttgctctgtttcatatacgggattggtggaacaagagttgagtagaagtgccgacaacaagaaaatcaattttttcattttacttccttgattgtattatcagctaactacgattcaccaaatagaagtgttttatctcgtaacaggattttaaaacaatgacaattatgagcttaattgaaattattaaactcataattaaaaattacagaaccaccggcattaattatcatcagataccactgctgtcttttgagctgaggacaaaggctctgaccgatagttttcaccggctaaaatatcgtaatgaatcacggtgtcattattgaatttcgaaaaatcgtagtagatggtgtaagcgttgaattcttcatctttagtctttttctttccatcgacataaaaatgacaaccaatggctcctgcccactcttttcttatacttttaaatatatcactattgcaattatctgctgtaatcaatgagtttagatcaacctctcgattgtaatattctctgcctgctggagaaaatcgcaactgagcaaaacctacggtatcaaaatcattatgagcttgtatggaaaagtctcttaattccactatacaattttgtgagttcttatacgtttggtaaggaattctaaattcaaaatttgaaccatctttagcaaaatcatgcgtaatcttctggcttatttttcctccttgatgggctttttgaccaaataaatcgtaggaataagcttcacactcatctcctgtcacccaaaaatgagtccacacttctaaataagcatctataggctttttgcctgatatagtaatataggactcatcaggttcatcaccccaaatattaggttgagaagtctggtaatagtcatacccaagaaaaaataatgcaatgaatagtacaacaactgagattagcttttttattgcaagattattcaataacttcatcttatttgcaccttgatttcatctggtaaggtttgctgtgaaattaaaaatttagttgcaggcatacgctgaggatcagagactatctgccttagctcacctctaattttattacggttctctattaatttatttatagaatgcatttcactcatcaaacgtccgatattcatagtcggcgtgccatttcctatagattcaatccaagcttgtttaactgtaagataactttgttgcaacgtagcaatttcctgctctaaggctgaaatcgctcgttgataatgcaccattaaactttcatcacttagtgctgttaactgctcaaataaattgggtatatactgctccattccatgctctactattgaggcatctgataaaccatctaccatagcaacagaatcattagtggctaaatttgctaggtctagcatagtgacttgagtttgtttgggtgtcagtaagacttggttatttgaattataagttagtaactgagacaaatgaccatggtgttgataattgtcatcatcatcatcagtgagcatttttctcatcagatcaacacggcttttaaatacatcaagtacatggaatccttcagatacatctgtgttcatccatactgttggtatctgtggcaccaaatcgtgattattaacatgacggtaatgcaaaatattttgatagcgctctacaaaactgcgagttcccactcgtggcattccatatgtatataaacgcaatactggaggatgatagctatctttaatcaatgcacttataagtaatgcaccagcgccccctaagctatggccacaacaatagaatttttttattttatgtagccctagatctttctccatcaaagataacaaagccatcgtatattggtaaaacccccgatgaacatatgttccaccaaactcttcgggggcgatttgcgcagcatcaaggtctgttataataaggtctttcattcctggtgaatcggtagcactttctatcttatccgcaatcacagccgccatacctgaagccgcttttataattttaaatttagtgttatcaacaggtggtttcttactctgaaaataaggctctgtacctctcacacctataatcgccaattcatcgttaaagatgatgtaaccttcactaccgacatcatcctcagcataatattgggcacttaacgctttgctatatggaatttcctctaataaccactttgcttgtaaatctccagaataagtcggtctttctttacgcttcaattgagaaataaccgtgctaattgctccctgattatctattgtcttaccatcatccctattaaaatcgttagtcgcataagctaatttcgacaacaacgcaaaggtataactattcaccaagttaaattcatcggtatcaataatcactggcatatagctacgtagtgctttgatttcaaaaacataggtctggttatgactgagtctaaaccctgctttctcagcagaagcattgacatctatccctttatgctgcttttgtaaaaactcatcttttggtgcttcatcccagaaatcaccaatagtggtaaagcggtactgcttcgtatctttatctgcggcgtcaagttctgccgcagctcgttttttcactggcgactcttgtccctctttacggctggcatatttttcgacttcagttaacagagaagcttggcttacagaagcacgccattccccagccgcaatcttgccaaacaacaccttacccgaacttgtggtttgcgtgtatgtgttagagggggcactttggttcgtaatcgtaactagcaaaccatctatcggttcatcattttcactccgaaactctagctctaaccagttttcctcagggttacactgcacgcaataattaaatgaatccatggttatccccttagttcaaattgacgagttaaagcatgcagagcgagctgagcttcttcgttgttatagtctcgtagaaattcaatcatgctaggctgagtcaattgttcggcaccgacaacagcaacgatagcggcacttaacacacgatatgttaaggtttgttcaggaacagagagagatggagcgagcatggaagcgatatcacgcccttgaattaagtactcgttcatcacttttggaaaatgccgccatagccaagattcgaggttagcttgaacaagaggcaaattctcatgagcctccaaatggtgtcgtttgatcacccaccacgttgtctttttggccgtaaactgagcgtctgatgtattggtaaatgagactaaccgatttttctcatggctatcgaacacgactaactgatttatcttacctaagaactgatttttttctatttcatccattcgttcaagcataggcacaatgacctgcctatcataaaaacgaaacagtacttcttcgccttccagtgctgcaatcaaaaggctttggagatggcttaataactctgtggagggacaggagcaacttaggaatataccttgttgtaagcactcgtagtcgatatccgataccatatcagagacagggactaaccagggcgataacgccatcacaggggcaaaggtctctccgtggaaaacaacttgtgtaccatcaaatacaattccactgttattcgccaccgcctgtttaaacgttaaatgatcagcaagccaatagacgtttgatgtctgttcactcaaccattgtaaaagcatcttttccattccattttccactaagcaataatgcgttgccattcttgaggattatgctctttaacccattgtgctttttgattcgcggaagcaattttcttcgcatttttaacgggaggttgattcatggagtctcggtagctttggtaccatttatcaaatgcatcgccactattttgcacaagcgattctacttgttgaattactgttttacgcttcataggatcaaactgatcgagtaacttcacttctgacttagttgtcgattctgttttaggcaaataactttgcagttcattcggaacagttctgaactcaaacaaaatcgccaattccggactatgtttatcaccgaccgtcgcattattaataccgtgtccggctacttcaccaccatcttggaaatattgaaatacatttttcgacaaactctcagaatagcgagactgcaattgaggcttgatatgtttcataaccgctttggcatcactcttactgagtatttctactattttgcttggttttgtacgtggcaatatttcccatgcattttttacttttggatccgttaatccattcgcatttggagtaatttgctccgacatggggtcccattcattgatgtaaataccaaacttcttcgctagctctgctgtttttaaataaatagacgtcagataagcaaatacgtttgcagctaactctttatcatccaagttttctgcgctcgttagagatgcaaattggctcttgagtgatttctgataccaaggtgccgattcaagtaaccttaattctggcgttgcactcgtcccgaaacctttagcagcaacacccactgtggcttgttgtccacttggtgtcatcgtgattgtttgaccttgagattctgcagaaatcccattgcccgcagcaatcacatgcttcgcattagtgatttcgataacaaagcgtccgtcttcactttgaataggagctaatggttgatgattggactggtcgatatgcgtagtaaagtgggttgctaaccacaacatggcttgtttgcgtgtttcaacggcagctttatcgtccatttcacaagggtagctcaccaactctactgtatgcgtctgccaattctgataattttttccatcttgtaatgaaggtggccgctgatacgaaccttggttcatgtctttcgttaacataaacagcgcatcaccttgtgcacttttcacgtagccaaatttctgtgccgagttggctggcatagccaccactagaccagctaactcattctcaatgccaatggatgacttcgggaaatgtgttggaaaatccggcgttgccttagtggatcttccaagattaggctgcgcgttagcggttggctgtggattcattattggttgtggtggggccattggcggagcaatcggtggtggtggaggcggcgtgatactattcaccgcaggcgttgcttcttgagcggctaaaggacacaccttcaccgcaggaacattcgcttgctcggcctgtagcaacgcttggtaagagatggtttgcggtggagccagtgccacggcgggttctaagccgcccggtaaggcgggcattgcaccgccaaagccgctaccactaccagcgctgccgccagagttgagattgaccaaagcaccggacagatgcaccccagccggatcgactttcacaaagctgccgcccgctttaacggtaatctcggagcccgcttcaatcaccactttctgtcccgcttttacatggatctctgtacccgcttcattgacccaaactttgcctgttttcacatgcagcgagccttcaatactcagcacttgctcgcccgttaccgcttctcgactttcccactccaccgtcaggtgttggttgtgcttaatctgggtaaattggtcgttttcaacggtcaggtgatggtcgtgacgaatgaccgtggtgtggtcgttttcaatcaaaccatcaaaatctttctgcgcatgcaggtagatttgctctttgcccgcttggtcttcaaaactgagctcgttaaagccctccccttggtgcgtctcggtgcgcagcacggttttggttttgtgctcaggcaaggtgtatggcggcgtgttggtcgcatgataagtgcggccagtgataatcggttggtctgggtcaccgtttaaaaactctacaatcacttcatggccgatgcgcggaatagcgataaagccatactgactgcccgcccaaccttgcgacacccgtacccaacaggagctttgctcgttaccgttcgagtaacggtcccacgggaaatggattttcacccgcccatgttcatcacagaagatttcttcgccttcaggaccgacgaccgtggcaatcattggaccatcgacttgcggtttgggttgtggctcggcgcgccagtgaagatgccccggaattaagctgaactgattgctgtaagtagtagcgccgctgccaccgtcttcttgtagcgcttgcggctgctcaccttggtggttaatcgacactaccacccaatcgcggttcatcgcggggtcaaggtgctcttgcaggtcaaacttatagccggcacgcagcagcggctcgttgctctgccctgttgcggtatgggcatggcggcgcaggtagtctaaacggatttggctaaaggcggcgccgttcacatcgtctttgtagcgccccggcgcatcaaaatgttggtagcgcgtttgctgataatccagctcagtaccctgcacggtttgcaaaaaggagtaggctggctttttgaagctgtagtctttgagctgaacttcgctcacttctgcttgggtgcgataggttaagccgtggatatacggggtatctatcgcgccaccgactaaagcgttgtatgggataggctccggcagtttgcttaggctatcactggcatcactgaaatagagggtatgtttgcccgcttcatggacaaagctgtacaccaaaccttcttcagcggcgaggcggtgcagaaagtcgatatcgctttcgcggtactgcacacaaaactcacgctgcacgccatcacgtttgagcgcaaaagcgtaatcgttgatgcccatctcttgcagcaagatagagagaatctcagggacagtctgcttttggaaaatgcggctgttatgacgcagggataagcgctctaaggcagggactaaagtgagttggtagaaggtgtggtgatggccgatatcgccttggctgaaagcacgcacaatgccgtgcacgcgctgcaccaactgtgagttgcggtaaagcttgagctcggcacgcttatccaccatctgctcggcggtgaggtttgatacccgactcgccagttgcacttcgtagcgaaacccgtaacaggcttgccctaaaaaaacactattagagagtgactcctgcccgtggaagcctctgaccaccagagtctcatcttccagcccttccacctcaatgctgtacgctaatgtcgccatcctgcctttccttcccctacattaaaaatggcaaaaccttaaacccacaataccgcgccaaacgatactctgggtttaaggttcacagccgcccaccctaaggtgagcgacattctcgcagcgtaaattacgcttcgattggcttacgccagtcatcagagcctgaggtgcccgcgttaacgtggtcccaagtgattttgcggtaagacagagacacagtcacattctgagtaaagtcagattttgctgggtcttggcagtgtggcatttcacagtggatgtcgacgatagacgcgttttccagcttagtggtgaagaagttctcttgtttaccttcgatagaggtacggtaccacttcagctcaacggttttcagcttctcaccagaagagagcgcgttgtacagcagaggaaccgctttgttcagcgccacagtgaatttgaatggcttgtgcacacgttggcctgaaggctgaccagattgtgggtcagtcggtacagtcacaacgtggtcaaactgctgaaccagcatctcatcttcgtggccttcaacgaatgaatcgccgatagagtcagcagtacatgcacctgcagtgataagaccctgagtttggccttcgatagagatataacatggagttggcatggctatttcctttcaataaatcatttttaagtcaatgaatgagttaacgcgctctgcgcaccgtcgcgatacaaagagcaagtgggatgccaactttcacaccattcaaaatcaataagttatagaaatagtcccatcaacaaagcaaaaaactgcccaacgctgagcaagatcttgcttggcgggcaaaaatcctcttgatgaaaaaacgcgcttctcatcacttggttatctgcaccttgattgatacacttcgctttcgtttatcgtcacggaaggctatttccatgaatgcgttcaataaattagtaaaacattctaaaaaaatttctaactttaatcatttgtcgtccatcgttggttgggaccaagccgccgtcatgcccagtggcggcgctgaagcgcgctcgcaagccatggcagagctttctgtgcatatccatggcctgatgacccagccacaattggctgattggtttgccgaggcagaaagtgaaacgctcaatatcgagcagcaagccaccctgcgcgaaatgaaacgccaatggcaacaagcgacggttctgcctgaagccttagtcgaagcgcaatccctagctggctccaaatgtgaacacgcttggcgtagccaacgcaaaaataacgattggacaggttttgagaaaaactgggcggaagtggtcaagctttctcaagaagaagcgcaaattcgtgccgaagcaactgggaaaaccccttacgatgcgatgcttgagctttatgagccgggcacgacaaccgaacagctcaatcgtgtatttagtgatgtgaaaacttggctaccaagcttaattgatgtggtgattgaaaagcagagtagcgaaagctttatcgcacctaaaggccattatcctgctgaaagccaaaaagcgctggggctggatgtgatgaagctacttcagtttgattttaaccacggccgacttgatgaaagtgtgcaccccttctgtggcggcgtaccgagtgatgtgcgcattactacacgctacaacgaaagcgagtttgtacaatcgctgatgggcattgtgcatgaaactggccatgcgcgttatgagcaaggtttacctaagcatttggccggcactccggctggcgaagcgcgttcgatgggcattcatgaatcacaatctctgttctttgagatgcaagtgggtcgtagccctgcgtttattgcccatctcgctgaactggcaggcaaacatttttcggcgatgaatgatccggtcttccgagtggaaaacattcaaaaactttacacgcgcgtgcagaaagattttatccgcgtcgatgcggatgaactcacctacccagcccatgtgatcctgcgttttgaaatcgaacgagatttgatgaacggcaagatcaaacacactgatgtgccagaactttgggatcaaaagatgcaggcttatttaggcctaagcaccaaaggcaacgatcaaaatgggtgtatgcaggatattcactggaccgatggcagctttggttacttcccaagctacaccttaggtgccatgtatgcggcgcaatttatggcggccatgaagaaaaccgtggatgtggatggcgcgattcgccgcggcgatctctcaccgatttttacttggttgtctgagaatatttggagtaagggcagcttattcagtaccgatgaattggttaaacaagcgacgggggaaaccctcaatccagagcattttaaagctcatttgagtcagcgctatctgaagtaatctttcacgaaccccacgaaatgtggggttctttatttcctcaaaatctcacgtcttcactgtcatttttcagcgcaaactagataatttttgtaaatgaatgcaacgtaattgcaacaatgacacagctcacttaatatgtgacccgaacttttgtatgagtttatcaacggcgcaggaaatgccgttcaaatcgatcacttttaaggatgtaaagtgctatggcccaactctcgtttaaaaacaagataattgcgctgatcatcgcgattatctcgctgaccatcatcacctcgtattttagtgttaactattttatcagcgattacatcaaacaggcggatagccaaaacatcacgcataacattgatttgatgcaacgtaagcttgaaaacgaactgaacagcaaattagctctcgcacaaagcctgaacttcagcatgatggatattggtgaaactaaagcgagctctggattcaataaaatcataaagatcgtcaacggatatgcctttgatgatacgggcaatatgagcgaagaagatgcgcagcagtatgtgagtctcgctgaaaatcatggtgatgcagtggtagttagccctgtgacattcaatgagggacagccgacgattaccttttcagtcaagcgtttcgatgagtcagtagatttcttcgtgttcaacctttccgcctttagtcaaatgatgaccgattacgcaaccgagggcagctttgcggaattgatggctaatggaaatgtgattttctcggataagcatggggtaaacctcacgcccattactcgtccaatcaattttgctggacaagattggcagttgattggctacatcgatttaaccgcgattcaagccaataccgatcagctcaactggaaaattaccctcgcgcttttagtctgtgcctccgtcattattgttgccagcgtgactatgctgcacgtttcatttaagccattgagccgccttaacactttggttgccaacctatcacaaggtaatggtgatctaacccaacgtctcgccgttgaatcaaaagatgaaattggtcaaatctgcaactccatcaaccttttcattgaaaaactgcagcagatgtttatcgacgtagctgactcatcgaaagagattgatcgtgccgttgtacatttaagcaaccaagctcgttccaatctcaatacgcttaatcaacatacgcaagaaactgaacaagcgattaccgccattgaagagatgagtgctagcgcaggctctattgcgcaaagtgcggatgatgccgcactacttaccgaacgaacaaatcgttatgctgatgaatcaaaacaaaccgttaccgaagctgtcaacagtgtcaatggactggtgaaccaagtctcctcgatggcagaaactatcacgcgtatgagcgaggacacgaagcaaatcaattccgtattacaagtcatcggcgcgattgcagaacaaactaatctactggcgctcaatgcggcgatcgaagctgctcgtgctggtgaacaaggcagaggttttgcagtagtcgctgatgaagttcgtgcattagcctctcggacacaacagagcacttcgcaaattaatgacatgctcgcgaccttaaaaaccacgacagaaaacgtagtaaaagagatggactcaacccgtattcattgtgaagaaaccgctgaacgcaccaatcatgtgatggattcgctcaatgtggtgactgattcagtcgctgaaatgaataatctgaatactcttatcgccacatcagcgatggagcagcggcaagttacacacgaagtgagtaaaaacatggcggcaattcaagagatggtgcgtaagctcaacatgaatgccgcgcaagtcacctcggtcagcaatgagttgcaaaatacctcacatgcattgagtgatgtggtaggacggtttagagttcaataacgctttagtcttcaccacattcataagctcgagagaataaaggcgtaatgccatgtgtattacgcctttgacgtttaatgaacagcagaggtatccaccgcttgcttgggttttggcgcaaaccaaatcatgcaggctgcaaatacaaagatcagtgcaatcacgataaacaactggttggttgccaccatcacactctgattttgcaatatccagtccatcgcagagcgcgtctgctcggcactcattcctgaattttgcatcgcttgtgtcgcaacacccgctttatcagttaagcctgccaactcagcatgcacataacgtgtttcatgctcccatgaagtgttgatcattgaggtggcaaacgcaccggacaaggttcggataaagttcatcaagcctgcagctgattccatttcgtgcggtttgacactaccaagggctatcgcagtcaatggcacaaagaacaacggcatgccgatgccttggaaaaataaaggccaactgatttgcgaaaacgtcatatctactgtgttaaagccacgcatgaaagtccacagtccaagccacatcacgccagcaaaaacaaagggccgagggtcaaatttcgaggacagattggccactatcggtgccaaaaataccgctagaatccccatactggcagtagcgtggcctgagatggtggcggtataacccatgtaaatttgcaaccataaaggtgttaccacagaaatactaaaaaaagcgccgaacgcgagtgacaacgtcaccatgctaatactgtaacctcgatgtcggaatacctttaaatccacgacagggtttcgctccgttagctcccaaatcaagaatgcaatgaaaccaatcacagcaatcaccgccaaaaacacaatgcgcgatgactcaaaccagtcatgatccttaccttcatccaacattaattgcaatgcggcgacccacacgaccaataacgccagccccactttatcaatttttgaatgcgtcgttttggtttcaaattttttcagcaatttccaacacagtaacgccgcggcaatagcgaaaggcattttgatgaaaaagatgtatggccaactgagttggtcacacaacacaccgccaagaataggtcccatgataggtgccacgagcgtggtcatcgaccagataccaatcgcagcatggcttttgtttttggggaatattcgtatcatcaaggtttgtgaaagtggcattaaaggccctcccacgaaaccaagcagcactcgaaacatcaccagcgtgctcatgctattggctaaaccacagagtaatgaaaaaacaccgaataacagaaaacaggtgacaaagactcgaatagagccaaatcgcgaagccaaccaacccgtaagaggtaccgaaatcgcctctgcgaccgcataagaggtaatcacataagtcccttggctagttgaagttcctaggctaccagcgatattggagacagagacgttagcaatagtggtatccaaaatagcgagaaagttggccattgccagacacagggcaccgaaaaacagtgcccatcctgacagaggttgcatctcattgtcagcgttatgactcatggattcaccttagccttgctctgaaactttggcggcgcggtactgcactaaggtttgtggatcggtagttcctgcagtatctatcgtggcaaccatagataatcccacctgcagtggataagcttgcaaatctttggggtccaactcgatacggatcggcaaacgctgcaccactttaatccagttgcctgtggcgttttgtgcagggatcatcgaaaatgcggagcccgtaccgccggaaaaaccagcgaccacaccatggtaggtcacatcatcaccatacagatctgccgttaaggtaacgggttgtccaactttcacatcgcgcaattccacttctttaaaattggcatcgacataaatatgatcagtaggcaccacggtcattaaaggcatccccacctgtacacgacgcccaacttgtacttggcgtttagcgacgattccactgatcggcgcacgaatcaccgtacgctcgagatcgattttcgcttgttcataacgcgcttttgccagtaagacttcagggttgctatcgacggtcgtgttatcggtcaacgctgcattagctttttgtgagccaatagtcgagagcttagttgcctgtgcttgcgccatagccgcttttgccgcattaaggtttgcttgtgcctgcgcaaaaccggttttggcattcgtcagctcttcaccagaaacggagccggaacgcactaagtcttcccgacgagataaatcgatttttgctcgttcaaagtccgcttgcgccgcttttaactgcgctttcacacgctgctcattggcttcttgtgcttccaccatagcacttaaaccttcgtcattagcgagatagctacgtacacggcgttttgcgagtgccaaatccgcctcagcttgaagcaaagctaatctcgcatcggtatcatccagctgtacaagtacgtcgccttgtttgacgtactcggtatccactacattcacttgcgcgataatcccgcccacggccggcgtgacttcggcgatttccgccgcagcataagcgttgtcggtggaaatgtagcgtgaaccgataaagtgccaatagagtgcataactccccccggcaaccacaattgcggccgctaatccgagaaacccttttttacgcgattgagctgcgcgtacaccatcaaattcggtgttgctattatttgaattcattgaagataacctattaagattctgttgtttcaaaaccgccgcctagcgcatggatcagcgcaagatctaaactaaaagcgcgtgactgcaaattgaccaatgctctttggttattgagtaaagactcttcagccaccaaaacatcgagataggtggctaaaccaccttgataacggttcgtcgcgatatgcagtgcttgttcagcttgctgtacggcttgttcggttttattaattcgcgcttgcagagcttggctactggtcaccacatcggcgacttcatacaaggcttgcactaacgtgccattgtattgagcgaccgcttcttggtagcgagcttctgccgaagtcaactgcccctctaaacgtccacccgtaaatagtggtaagtagatcgcaggcccaattgcacctgcgtcattaccactatcaaacaaatgatccagaccaaatgcctgataaccaataaacgctgacaaagtgacatctggatagaattgagcttgcgcaataccgacttgctgtgctgcggcttctgcccgccaacgcgcagcggtgatatcagcacgatgccccaataatccaacgccagcctccgacggcaagccataacgagaggtcaaggtgatatggggttcttcaatcgatgcagcgcgatcaggcccttgccccaccaaagcggccaaagcatttttctgtaattggatcgattcttgaataccaagcaactccgcttccacactcgcagcaaccgctttcgcttggctgacagaacctagcgtttctaagccattggcataacgtttttctaaaagctcaacggttttgttgcgcacttgtagcgcggcatgcacggtctcttgattggcataaagacgagctaattcggcataagcattagcaatcgatgtgctgatcatcaaacgcgcagccacactctctgcctcagcggcagcaagctcggaagtcgccgcaacaaccgctgcgcgattttttccccaaaagtcaaagtcatactgaaaattcaaggttagagtgccatagtcattccaaccatcgggaggcgtagcagattgataacgttcactgactttactttccgtggcggatgccgctaacccgagatcaaatgatcgaattgcgcctgcttgacgagcaaaaccttgtgcccctttaagccgagccattgccatctctaacgatggtgagtgctgcaacgcttcctcaatcagatggtttaattgtgcatcttgatagcgttgccaccaattcgctgatggccagtccatttcagcttggtgagaaaatgtgtttgtcgagctaagctcattcgcttcccacatcgtcgcaagatcagggtaatgatcgggtactgagcaacccgttaaaacgaaagcactcaatagagaagccgtaaaataaggcgctgctttatgcaacaaacctaccgtttgaacgctatttttcacatttgaaaaccttataactaaaccgtaccgtacagttatactcttgacagaaggaaaccgtcaagggaaacttatccacaatttctaactggaaatagatgaactcatgcgggtaaaaagtgaagaaaaaaggcaagcaattctagagattgctaaagattcctttacaaaacaaggttttgaacagacttccatgtcgcatattgcgaagatgctagggggctcgaaggccacgttatacaactatttcagctcgaaagaagagattttcacggcggttatggagtcatcagcgacagagcaaatcgccctctctttcctctcacttgaccataatcgagagttaaaacccgccttattagaatttggttacaattttttgaactcggttttaacgcaagatgcgatgtccatctatcgaatggcgattcatgaagccgaccgatctgcaatcggcagacatttttatgaaaatggcccgaaacgaggttgggcacgtttaagtcgctacattacgtgccaaattgaatgtggttcattgaaagagtgtgatccttggatcgccgccatgcatttcaaagcgttgctatctgcacaatattttgagcccttttcattaggtgcgattgaaaaaccgacctcaagtgaacttaaagctacgacccaacgcgcggtagaggcctttttatgcctgtacgcagctgattgaactgaaaaatagaatagaaaaagccgggaaattcccggctttttctgaagtgttcgtattaatcttgcaccgcacgcttatgtttgggcacatagttcaaaatcgaaatcggtacgggctttttcggctcaaagccttctaccacgcgacgctcaatcaaatggcctaagcggctttcaatcatgcacagatttttgaagttgtcttttgagacaaacgaaatggcttcgccgacagcctctgcgcgccctgttcgaccgattcggtggacatattcatcggctgggaagggcaaatcgtagttcactacacgcgatagctggtcaatatcaatgccgcgtgctgcgacacctgttgcgaccaagtatttgatttttcctgacttaaaatcttcaagcagttgggcgcgaatggcttggctacggccactatgaaacgcttccgcatggatgccccgcttttcaagttgagaaacgagcttggctgcaccatgtttggtttcaataaaaatcaatgcctgatcccactgctgctcattgattaaatggctcaacaatgcggatttggtgtctttatcgacggtgatcagccattggctaatattgctttttgaggcttggttggcggcgatactgatttcatgcggatcgcgtactgcggttttcgctaactcacgcactttacgtgacagtgtcgcggaaaaaagcagaaactgtacttcactcggcaggcagtcaatgattttgttgatcgactcaataaaacccatatccagcatgcggtcggcttcgtcgagtaccaccatttctatctcttcgaaatagacggcgcgttgcccatagagatccatcaaacgccccggtgtggccaccagcacatccacgccatcaatcaagcgctgcttctgtgcttgttcatcgacgccaccaaacacagcaaggctctttaagcccgtgtctttaccgtattgctctactttttccgccacttgcatcgcaagctcgcgggttggcactaaaatcaaggcgcggacacgttttttacgttgcgtttgcccttggcgcagtttttccaaaataggcaggacgaaactggcggttttacccgtgcccgtttgcgcagcggcaatcagatcacgtccctgcaaaatcactggaatcgcttgggtttgaatatgggtcggtttttggtaaccaagttgcgctacggtttgtaccagaacgtcacttaatccaagttgagaaaaagacatgaatttactcgagcttactgccagacctaacagaggtctagcctaaatatagaagggtcagattctaacactaacctaagcaaccgctgtgttttttcttcttacaacgctattgtttcaacatgagatgatgaatgaagccatggtttaggcttactactggatggctttccggctcatcttattcatccacaatattactcaccgttttttgtacattttccgctgcatgctgaatttgctcaatcaaagactgggtttgttgcagcatatgattgaattcagtgactttggcttggatctgctccatggtttgccctgactgttcggtgagttggctgttgcgtttaacaatgttgtcaatttcgctagttgcttgactggtattcgacgctaaactgcgcacctcatcagccactacagcaaagccacgtccatattcacctgctcgagcggcctcaatggcggcatttaaagctaacaaattggtctgctcagcaattttgttgatggttgtgactatttgcgtgattctctgagattgagatgagaggtccgtcatcaatgcatttgcacccgcaattgactctgtaataccactcgctatcgttgccgcagcatcaatcatctcgcgccccgactctgccacacgaaccgtttctgcagacgtttgctgagccatttgcgacgcttctttggttgcatgagcttttaacacttgatctgtaacatctgaagcaaatttaacaacttgagtcacgacacctgcatcattaaaaatcgggttatacgtcgcctctaaccaaagatcttgaccgtgacgagtgcgccgatggaataaaccggatttaaactcccctcttgcgagctcacgccaaaagtttggattttctttatagaaacggtcatcacaaaacatacggtgatgtttgccaacaatctcttccagtcgataacccgtggctttgagaaagttctcattcgcctctttgatggttccatccggattaaactgaatcatggctgatgaacgatccagagaatgaaataccgcagcctgcttgtccgccgtaattttggctttcgtcacatcatgggcaactttgatcaccttatatacatcgcccgcacgattacgtactggcatatacgttgcctctatccagatactcgaaccatctttcttgagtcggtgaaacatttttcgttgcgcttgtccttgggctaggcttttccaaaattgtgcatattccaaggagttaacagtctcgggatcacaaaaaattttgtgatgttgaccaatcacttcttctttggtgtaccccattgcgctcaaaaaaagtgcgtttgcatctaaaattttgccttgcggatcaaactcgatatacgcaaggttccttttaagtgcagagacaatgtcgctgtcatgattgtgttgttccacctctgattgggcggcagcttttttccaaaatggcataaatggcttccaaatcaatgactctcaaactcattatagtagagagccttatcttttatgtttgtaatactctactcgtttagtgacaacacactgttacgaaataacaaagcgtcccatcaataattttaatccttgggcttgttgtgccaactcttcactcgcttgagccgtttcttgtgcactgagcatgatggtttccccagcatcgcgaatatccgtcatgttgtggctaatctcatctgcggcaaccgattgttcctcactggctgccgctacttgggtattggcggacgtgagttctagaagagcaagattaatcgaatcgagctgtttttttgcggcggtaatcgatgaaaagctttcttctatctgacgatcgcttgagtcaatcatcttagtagccgattgcgcacgttccactaaggtctggatcaagcccttaatttcatgtgttgcctgttggctgcgagatgccagagctcgcacctcatccgcaaccacagcaaatccacggccttgttcaccggcacgcgccgcttcgatcgctgcatttaaagccagtaggttagtttgttccgaaattccttctacgactaacacaaaactttcgatctgccgagtactggcctctaactcaacaatcatttgctgtgattgctgggcattagcaaccaattgactagaaaccgtctcagttttacccaagacatcgcagctgtagcgtgcattttcctgtgcccttgctgtcgcagcggaggactcttccgcactgctcgccacttccgtaatcgtgattgccatttgcgccattgcgctggtgacttgttctgtattggcttgctgctgttgtactgacttcttattgctttctgccgaagaagcaagttgtgtcacggttgaggcaatcgtatttgctctgtctattacctcaccgacgatgtggctcagagattgagccatggtattcatactggtaatgagctggccaatttcgtcacctgtagtgactttagctcgcttgctaaaatttccttcagccatttcattggccaacttacgggctctagcaatcgccataacgatttgtttactaaacgcaaacccgagaattaacccgaataaaatcgcaaaggcgcttaaataaatcattccccatagcgcctcacgttcttcttgctctgtcactaagacagattgctcagttgcttgctcgattttacgcagaatatcgattaaacgctgatctaggctgatttgtaattgttcaatctgctcggcatctgctactaataatttaacctctctgccagaacgaagttcattcagcaactcattgagctttctttcaaattcttcatgttcacgacctaatgagtcaaggtcttgctctagattagccagatagctacgtattgagggggaaatcgtatgttctatagaagattcaagtagttgtcgagattggttaaattcttgcttgaatttattcactaactccatgagctgtgcttgatactgattttgctgctgcttgccttgactactttcgatgcctgctgcgcggaagactcgttcaagagtaatcgccccttcgagttgatgaacggtcatgtcggtcatcaatttggctaaaggtaagttatcgtgagctatcgcctctatctcaaccgctactcgtttcatcttagtaatagaataagtggaaaccattaacgttagagcaagtaaacacccaaccagagcaatcattttttgggtaatcgataaattattaaaccatttcatcacagtgcgcctcacgttccatgtcacatgccataaaatatggctccaaaagtgtctcaacctactcggtatcaaagcctttaagtaaatagacaaaaccgctagccgacgcgaggtactaacctctagtacaaatttttctttttgtttgttttaaatttaagcctttgcttaagtattttagattatgaaactaagaatgcttaaacccgttcaccgcaattcatttaatttattgtttaataagaatataaataagttaccactttagtttaatgaacatgtaaagctttgcatctagtgcaaatcatcgatagatgacatatgcaacatagttggaaaatcttgaaattcaagagcaaacaattataaaaatatcaactaaaaatatcgatgcagatttggctcaaatcctcttccctatcctcaataaaaacaaagtaaatccttgtttttaattagtttaaatttaattagtttgaaactggaaaatttaaatcattgtctatactgatctaacatcttggatgaatatctcattttggagatggattacatctgttacatcaatggcaaacaacgaggttttccatggcgctcaagaaacatatcactaccagtgctagctcatcatttagtccgagcaaccatagcacttcggctaatgcccccaaaaaagaagctgatgatttgcgtcgccaagcaagaacattagccagaaaacaacaagctgccgaacgagtggcttctgctacagcagaattattggctggattagaagaaagttcttctgccatgactcaactacgtagctctatggaacagattgcggtgggtgcggaagaatcttcatcggctacaaaacaaagtgaaacggcggtatcacagatgaataacttcatcaatgaacaagccacctatgccactcaatctaagcaaattttgactaaactcgaacaagatattgttgatgtggctaataaaatcaatgagatggtatcgaacgtccaaacctcttcagaacgacaaaacgattcggtcaaacgaatgatcgaactttccgaacaagcagccaaaattaatgatgcagtgaaacaagtcatacatatcgcggatcaaactaacttattggcgttgaatgcggcgattgaagcgggtcgtgcaggtaaacatgggaaagggtttgcggtggtggccgatacagttagaaccttagcggagaaggccgaaaaaaatgcggctaacattgaaagtctcatcaaggacatttctaacggtgcggaaatggtttcaaacggagtgaaatcaagctctcaaaaagcagaaagtgaagttcagaaaggccatgtcgtcaataaacaacttacgctcattcgcaatgaaatggttgatttagtgaaagattcagaagtgttattgaaagctgcggatgagatgtcttctgcagcagttattgccttaaaaggttccgaatctgtctcacaagccgctcaagaacagtcggccgcctgtgaagagagcttaaaaagtctagatcaacaacaaatcgcgcttgatggtgctgtcacagcagctcagtcacttgatgaattaaccgatgagctacgcacatccaccgatatcgttaaatcatctgaagaagtcgctgccgctgccgaagagctctctgctggcattgaagagatcaaccgctcatcgaatgaaattatgggtgcactcaaccagatcagctctggtgcacaacatatggccaagtcggttgaaaccgggatcactagcttaacgcagatagaacaaggagctcgccttggtaaagaacgagcagaaagcagcctgaaagcttgcgagaaaatgttgacaggtatagaagaaaataaaactactgttgacgagatgatcttagccattacggaatctaccaaagctgcaacggaaaacctgaatgaaatggcgaatattgaacgtatttcgcgacagatcgataaaatcgtcgatggtatttccaatgtctccattcaaaccgccatgttggctgtgaatggtgctgtcgaggcagcacgcgcaggtgaatatggaaaaggttttgctgttgtttctaccgatattcaaaacctcgccaacgatgctgctgaaaacgctgaacaaatcaaagatcaagttaagaatatccaagagcaaatcaacattgttcgtaaagatttagctgacatcctttcgacagtgatggaagaggctcaaaaagcagctctgaccatcaaacaactggataatgttcgctctaggatgagtgatgtggtgttaggaagtaaacgtatttctgaaagtgccgggggcatcgagcgttcgattgctgatgcacgcgcgggaatgcaacaaattgccactgcagctgaagaatcctctcatgcaacgggtgaagccgctactgcggctcgtcagcaaagctcaagtacttcggagctggcatccgcaattgaaaatattgccgccgttgccgatgaacttcaatcaatctgattgaggtgaactatgaccagtgaagcccttgtagacaacgaacttgagcatgaagagaacctcacacagtatgtcaatttcatgctgggtgatgagctttttgctttacacatgcaagaagtggaagaaattatccgtctcccaactacgttttcagtaccactcactcccagttatttgattggattatccaacttaagaggacaaattcttcccgttctgtgtctacggactttactgtgcatggacagaacctctgcgacggaagccacccgagtgattgtcattacaattggcaaaaccaagattggattcaccgtcgatcgtgttgtgaatgtggcaacccctgaccctgagatgataaagccgaccaataccgcgggaggcaaaattgacccaaccttaattaccaacaccattcactcggataaccagattatccaagtactgaattgtcatcgtttgttagacaactctgtcgaagaagaattggaattaagcacgcagcgttttaaccacctctcttctcagtctcattttggggatgtgatcgatgaagaacgagatgatgatgaagacatgcgacagctcgtgtgctgcatggtagatgggcaagaatacgcctttccactagaggacactcaagaaattgtgcgtatacccgagattatcaccaaggtccctcttactgaatccgccattcttggagtgatcaatttacgtggcaaaacgctcccattggtcagtctgagaacgctgtttggattacctagcattagctttagtgatagtcaccgtgtcttggtggtgaatatatccctctcagagaaagagcggcttcccgtgggggttgttgtggatgccgtacgcgaagtcatacgtctgcatgtagacgtgatggatagcgttccagaaatcatgagtaaaatgggacaagccaatgacatttcggccatttgtaatcttgatgatggccgacgcacactcagcgttatttctgtagagcaactttttgacgctcaaatcgtagatcaattctccgaagcttacccacaggaaggaactgatatgtcgacgatcgacgatgtaagtatcctagaagatgacaataccgacatgcagttggtgatttttaagttggataaagaagaatttggcatctccattcataccgtacaagaaattatccgtattccggaaaacatcagccgtgttcctaaaaccgatgattttatcgaaggagtaattaatttacgcggtaacgttttacctatcgtcgatatgcgtaagcgctttcatctacccgagatggcacgccatgaacgtcaacgtatcttagttgtgaattttgagaagatttcaacaggttttatcgtcgattccgtcagtgaagtattaagaataccggaatcccagctggaagatgcgcccgtgttgagcgaagagcaagcacaactaatgcgccaaatggtcaatctcagccctcgaatgataggagtactgtccgccgatcaattgatcagtaataccgagatgtacaagttacacatggctgcaaacgatatggatagctaagttttaaggctggagggaacatgaagattttagttgtcgatgattctgcgttaatgcgcaccaccattagcgacatattgcaaaacattccgaatgccgagattaaaacagcacgtgatggtatggatgccatcgacaaagtgatgaaatggcaaccggatgtgatgacgttagacatcaatatgcccaacatggatggtctaacttgccttacgcaaatcatggttgaacgtcccttgccgattgtcatgctctcatccctcacccatgaaggtgccattacaacgctcgaagcgctttatcttggtgcggtagactttgtcgccaaacccggaggcactatctgcggtcgattacaagaagtcgcaccactgatccgtgaaaaagttcgcgcggcagcgaaaatgagagtcaaagttcacacgcagctttcggtatcaccagcagaagtagagcacaaacataagtcacctgtggtggaaaataatgaagaccaccagcttgcgatcatgggggtttcgacaggagggcccggcactgttgaaacgatactgcgccatctgcccgccgatttctcattacctattattgttaaccaacacatgccagagagcttcactgccgcctttgcacaaaggcttaatcgccatctgcaacaacccgtgaaagagattaaccgtgctttagtgcttgaggctggtaccgtttatgtttgcaagggtgaccgagactgcattgtcacgctacgtgatggtaaattggctgccatgcccacgccaaatgatagccatttttcatggcatcccagcgtctccaaactggttgccagcgccatacgcacttgtggagaagataacttattgtgcgtcatgctaacgggaatgggcgacgacggtgccactgaaatggctcaggttgctcaaggaaacggtattgtttttgcccaagaacccacaacctgcgtagtccccagtatgccggaagcattacttaaacgtgtaccccatattccaacaggaactccagagcacttagcttatctgatgaccgaagtggtgagacagtccagtagggagcttcactatggcaatcattaaacgcagcgctgctacagacaacccaaatattgagatactttctactcccgagcagatcgatgtgctgagcgcagaagcgctgatggaagctctacaaggtgatgacctcgagcaaattttacgtgcgattcatcagttggaagctgcggactcagttgagtttcaacaacatcaagcggctttatttactttgctcgatcgcgatacagaacaaaacccttgcagtgatgctgttttctcactgttagccatccgaaacaatgatgaaatcacgactcgtttgatccccctgctcgattcagaagcaccctatttacgtaatcaagcgattgagattttacaacatagcccgcaacagctggaaaggcacattcaggatttactgaaccatcaagatcctgatgttcggatctttgctatcgatattatcgggcttttacctcatcaatcggtgccagaatggttaatgcaagtcctccagcacgaagaacacattaatgtgattggtacagcgatcgacagagtcgctcagctctccgaccctaacttctcgacgatattgggggaggtcaagcaacgattttctcatgtaccctatctcgtttttgcctgtgatgtggctatcaaacggttaaatacctaaggtcagcattatgaatgagattgtcattaccgatactgacttctgccgattccgtgattatttttatcaaaaaacaggcattttttttgagaacagcaaacgttattttgttgataaacgcttattacagcgcattgaattaaccgaacaccaaagttttcgtggttattttacttatctacgctttcaagccagcggagaagagctgcaagccgttatcaacgcactcaccgtcaatgaaacctattttttccgcgagatcagtcagttggagtccttggttgaagaggttttggatgacatcgtacgccataggccaggtgagctaatacgcatatggtctatgccctgttctagtggcgaagagccctattcaattgtgctgtttttactggaacattggccaaagctagaacaggtcgatattgaaattatcgcctcagatattgataccggcattttacaaaaagcagcacaaggtattttcagtgctcgttctgttaaaaatttacccaatagttctctcaacaaatatttcagcttacgggctgatggcagttaccaattaattgacgatattcgtcaatcggtacgttttactcaaaccaacctcaacaaccgagcagaagttcaaaaattaggcgctatggacgttattttttgccgaaatctgttgatttattttgatgatatttcgcgccgtaacgcagtggaatctttttacgagcaactcaatcccggtggtgttctcttcctcggccactcagagtcgatgagccgtatatcctcaatttttcatgtaaaacgctttcgtaaatcaacgggatactacaaaccgcacaaggggaaaaagtgatgaaaaaagtaatggtcgttgatgacgcttctacggtgcgtatgtatcacaaagctttactcgaagagatcggaatattcattttagaagccagtaatggtgttgaagccttagaacgagcgctagaaatgcccgttgacctatttctggtggatatcaatatgcccaagatggatggctttactctcgttcgggaaatacgctgtcgccctgagctggcgggcattccgactgtcatgatctcaaccgaatcccaagaaagcgatagacaacaaggtattcatatgggagcgaacttgtatatggtgaaacctgtgaatcctgaagaattacaacaaactgttaccttgatgcttggggggttgaaatgaacccaataatgcaaaacttcatcatcgagagccgagatttaattgaatccgcggcacgaggtctacttgcgttagaagcgaatcccgatgacaaagccatcattaacgagttattccgagaaatacataccgtaaagggagcctcaggtattctcgataatattgcgcctttcacccaattagcgcatcgaatggaagatttgatgcaaaaagtgcgtgatggacatgtggctttaaacggcacaatgcttgacctgatgttgggctgctgcgaccaatttctcttatggattgaagagttagaacaacaccaagagctctcagcagaggcggtatcgatcagtaaacagatgattgctcagttagcacctttaactcaagccgcgccaacacacacgcctacccctgccgtagcggcgcaagaagagacggccaccctatccatcagtgaattaacggagctattaggacgagattgcttcaacgatgtagaagcgcttttggaacatcccgatgctttactcttgatttatacccccgataaacagtgctttttctctggggacgacccattggcttggatgcgtagtgttgaaaaggtctcttggcgtaaagtagtgctcatcccagattctgagcctttcgatacctatcaggctcaaatgcagtttctgctgctgactcaatcagcgaaaaaagacctagagcagcaacttgctccgatagaaggccaataccgcctttaccgcattcaatcggacaacctacccacagcaccgattgatcagcgcacacaatatgtcgagcgaattgttaaacaacaaatcgcgttgcttagagaagaacaagtttcggaatccgtacgtgctggtaccttcttatcgattaaaaatctctactgtgccctgagccaacaaatcagtgatcgccctgctcccttgccagaatctgtctcggccgatgaacttatcaccttgtttgataacattttactctcttttgctcatcgaaccgccatcatcgataaatgcgaaaatgaacctgctcaaccctccgctatcacggttaacgagcagttagacaaggtgaagaaaaaacagataaaaacactgaaggtggatcaggaaaaagtcgatttattgatggatttggtcggtgagctgattgttgcgaaaaactcgatgcaatatctcgcctatcgtgcagaaaatgagtttggtgttcgtaaacttgcacaagatattaaagcagaacagagtgtgatatcgcgtcttgctgaagacctacagtctgttgtgatgcaggtccgcatggtaccacttgcgaccgtttttcaacgctacccacgcttgatccgcgatatctcacgcaaactgggtaaacaagtcgatctgatcatcgaaggtgaagacactgaggcagataaaagtattgttgaagatctctccgaacctttagtgcatctgatccgtaatgccctcgatcacggaatagaatcacccgacatacgtcgcgaacaagggaagaatccaacaggaaaaattactctaagcgcttttactcttgatgattctgtcatcatcaagatgagtgatgatggtaaaggcgttgatgtcgaacgcgtcaaaaccaaagctttggaacgcgggttagtggaagcgagcaaacttgagcggatgagccaacaagagattattcacttgatctttgaacccggcttttcaacggttgaacaagtcagtgatctctcaggacgcggtgtgggtatggatgcagttcgtacggctattgaacgcaacggcggcactctcacactctcctcagagccggggaaaggcagtgaaattaccatgatcctgccactttctatgaccatttcacgcgtcatgatgtttgaacttgagcagcagtcctttgctattcccattgaatcggttatccaaacgttaaaaatttcccgacacaaagacattcgccgtgtaaaaaatctcgatacgttcattttacgcggtgaaactgtgcctattttgtatctcaagcgtgcgtttgagatgaactctgcccaaatttatcccgacatccaacctattcttgttgtccgtgtgggtgatgatgtattgggacttgccgtagatcgattacaagagggacaagatgtcatcatcaaacctcttgagggtgctttggccacattctccatctaccgtggtgccgccattatgggagatgggcgtgtccttttagtgctcgatactgaggaggtagtaaaacatgcccgttgaatataaaaaccgagtggcctatttagtcgatcacgtcggagttgaagaggcagaaacattattaacatggatggaatcgacaccagggtctagtgttaatttaaagcactgcaaacatgtgcactcagcggtattacaagcactaatgtttgagaagcctcgcgtgactgtgttgcccaatgatcccgaacttaaagtttggttatcggcggccaacatcatcggaaaaggagaaaataataatgtctaaaagcattctgattgttgatgactctagtactgttcttatgagtgtcgatgccatgctctctaaactgggtttccaagtcgagaaagcaaaagatggcgttgaagcagaaactcgactcaaaggtggtctaaaagtcaacctcatcattaccgacatcaatatgcctcgtatggatggtattgagttgattagcaaaattcgtgcgattgcttcatatcgctttaccccaattttagtgctcactacagaacaagaacaagccaaacgcaatgaggctcgcgccaaaggtgcaacaggttatttagttaagcccgtaacgggagatcaattgaaagccgtgattcaacaagttctcccaggtagtatttcgtgaggtcgttatgattcgttacctatttgaacggctagagaataataaaaaacgctatcttttcttcactatcactctaagctgcacagtgcttctgttgggcttagaactggttcgatactggactccgcaatggttttatctaccgtttgcgataaccgcacttatcttaacgatgaccgctttggttttctctcagggcaatctttttgtgcgtttcctacaacaaatccatgaacaagaaaccatgaaacaaaaagaaaccgtttctgccatttgcgattggatcgatgaatatcgcgatctcaatggcttagtcgcggatcatattgagaacgtaaattctgatgcacaaaaagccactgaggatattctcaatcacatttgctcattggatcacgcagccgctaattttactcactacctcaaagacatggagttcgattcacaaaatatggtatcgagcttagatgaacacaccttagttatctcaaatctagccgatagtactcgcagcctgatgagcaatatccaaaccgagcgcaaacaggttaatgatgtattaaaccgagtcatgggacttaacgagatcaccgaagtcatttcaaaaattgctaatgagaccaatctactcgccttgaatgccgctatcgaagcagctcgcagtggtgaaatgggacgtggctttgctgttgtcgcagatgaagtgcgacatcttgctcagagagctggtgaggcagcctcacaaattagcgaagaaatagaaagccttcgtgcagaagtgactcaacgttttgaagtcgccaataaagagagcagcgagcaaaacatcaaagctgatatgatgattgagtccgtacaaagcttaagacaaagtttctcttctgttcgtgaattaagcgaacgacaaatcacccaaatcatgttgtacaacaatgatcttgagaaaaatatcagcggtagtatggcctgtactcagttccaagacatcgtccgtcaaaagctcgatagcatcgaagctttaatgcgtgaaaaacacttattggtgggtgatgtctttaacggtatgcgcctcaatgatctgcgccatcgggaactagaatacacagaaaccctgcgccgcctgtcattggagtataggcacgactttgaaagacactgtaactatcgcgattcagatatgaacagcacaaagcaatcgacgttatccacttcaaatccattaccgaaaattgagctgttctagcctaactagccagagccgaaactcacggctctggctttatactaacttctgccgttaagcactcattttgagtccagcaatacccgcgatgatcagaaataaactgaacagcttaatcaaggttaaggtttcgccaaacaaaaatgcggcagccagtgccgttcctactgcgccaattcccacccaaatgccgtaagccacgccaagaggcagagtgcgcaacgcgatcccgagtaacacaaaactaatgaccagcgccgataaggtagcgacagaagccagcggtttgctaaaaccttcactgtatttgaggccaatagcccaagcgatttcacaaataccggcgagaaagaggattaaccacgccatatatacacctcatatatggggtcgtccccgaagaaaagatggagcggtgaggtcgtcctcacttcctgatgtgccgctaagactagcaaagcttacgggtcttggctagcttggcttggcgcgatgcaaaactcgcaaagccgtgttaatccatctccggttgacgcttgttgggttggcgcggcgaagttctcggtttagcttgccgcacatggcgcgcgaggatacgcatcgcttcggcttgtaccgcaggcagtttctgccactgccataagcgatcccgtgcttgcttggcactggcttccaaatccatcaccggcttgaggtaagggctctcaagcggtacttgatacatctgcgcttcaagcggtgtcatcagccagggttcaaagagcagcggtacaggcacttgcgccaactctggcacccatttgtgaataaactgcccttcgctgtcatgctcttgtgcttgcttggtcgggttataaatgcggatagtattggtacccgtgacccctgcttgcatttgaaactgcggataatgaatgcccggttcaaaatcgaggaacagttgcgccaaataagtcacgcccgctcgccaatccacattcatatgatgagttaacacgctcaccaacatcgcgcgcatgcgaaaattgaggtatccggtttgaattaagcaacgcatacaggcatcgaccagtggaatgccggtgtgcccagtttgccaagccgctaactgcgcggcgggggcatcgcttgattgctgtaagagtgaatcataagcgcggttgacgcagcgaaactccatctcacattctgattcaaatttttggataaagtgacagtgccaatgcagacgtgatgaaagcgcaatcaggctgcggcgaaatcccgctaccgaccagtgtttgagcaaagtttgatacatctcccgcagtgagatattcccccacgcaagataaggcgacatccgcgagcacgcgtggcgcgctaagctcggacttgaaatggagcggtaatactctcgccctcgacgcgcgaaaaaatcctccagcgtcgcccacgccatatcactgccgccagtttgcatgcccgcttgtttactctgccatgtggcagggatatcgctgcgcaaaccaagtgttgcggcatccagcttcagccaattggcgcgtgttaaatcaggatcgcagcaaggggagcgcatcacttgctgccaatgctcatcccaatttttacgggtttgcgcgccgcggatcacggcggcataaggaaactcatgccagacgatgtcgtgttgctggcaccactgcgccagcgcaagatcgcgctgaaaagtgcaggctaaaccgacttcttgatgagaataaatcgcctcaatggcgtagcgctcagcaatacgtgcaaagcaggtttgccaatcggatgtgacgatcaacacctcccctttactctgcgccaaatcacgattgatggcttgcaatgattgccacacaaagcgccagtgtcgttcgctgtaatgcgcatcgccaagcagcattggctcaaacagatagagtagtaacgtcggtcgccccgaagttaacgccgcttgtaatggcgcgtgatcggtcagccttaggtcgcgtttgagccataccagattgatcttttccatactctttccttgttttctctgccgtttgtacgcgacagaagaggaaaagatcgctcccgtgttctatctatcgcttctctttctattacctcactttctgcctattaccgagttttctatttatcaccttattttctattgaacacagagagaggctagtgccctttcagcgcatctttacgtaaacgccaagcggtcagtatcatcgccacaaccgccaacgcactcatgccgatgtacaccaaactaaaaccttgggcgagcacatcaggcgttactgatgaggcttggctgccatgctcacttaccgtgacactttgcggcacacgcagataaaacagcgcagaacagaacgccaccccgagtgcgccgccaagctcacgaccaaagttaaacagtgacatgccaatacccctatcacgggcaggcaacacactctgtaccaccacattaagagaaggcagagtgaaaccaagcccaaggccgccaatacctagcgagagatgaacccacaaatcgtagtgaatctgccagatggcgacggcagcaagcagaaaaccgctcaccaccagcgctttatatcgccctgagcgagccacccatttgccaccaagataagctccggtggtgatactgaacatgaaaatcaccatcacggtgccactttgcgacggtgaaaagcctttctgccactgcaattgcagcggcatataaaccaaaagcgcgaacatcaacatttgtgaggccatgattagaccaatcgcggtcaggtaactgggtaagcgtgccaaacgcgcaggcaaaatcgggtcactcacctgtctttccacaaggattaacagcaccaagcagagtaacagagcaaaagctccccaccccgcaggcaaaaaggagtgtgaggaaagctgaagcagcagcaaagttgtggtgagcattaaaagcccagcgcccagccagtcaaatcgactgtgacgtttttggttaaggtgtctgagatggcggttgaccatatacagagccaccattcccagcggtaaattaatgccaaacacccagcgccaactgaggtgatcggcaaaatagccgccaagcaaggggccagcgacactggaaaccgcatacaccgccgaaatatagccttggtatttgccgacttcacgcgccggaatggaatcagcaatcacggtgaacgccaaagcaatcaaaccaccgccgccaattccctgcaccactcgcgccccaatcagggttggtaagtcaacggcaaaggtacacatcgctgagccaacaataaaaataccgatgctgatattgagcatgcgtacacgcccaaacagatcgctcaatttgccatacacaggcaatacggctgtggcggcgagtaagtaggcggtgatcacccaagttaaggcggttcccgccgagagatcttgcccaatcaaggccagcggtgtggtcactatgcttttttctagtgaaccaagggcaatcactagcgcaacgctagcaaaaataattcgcggatgaggggcatcggcagcgggaataggatcaaaatgcatgagctctctttcaagataaagtcaaagggaatggatttgctgtggcacaagataaccaaatcacagccatccgaaaataggatagaatgggacgcgaaattgcaaaaatgggattaccgatgaaacttgatgatttggcgctgtttttaaccgtggtgcgttgtggcagttttgccttagcagcgaaacagaaatcgatgtctaccagcacgctgagccgccgtattcagcaacttgaacaagatacgggcagcattttgctgatccgcaacagtaaagagttggtactgaccaaagaaggtgaacagctatttcacagctacgccgagctgtttgcccaaattgagcgcaaacaagaagaggtcgagcaagcgaaacgagattaccgcggcgaaatcgcgataagtgcacccgtgttacctctgcgccaccaattaacccctttggcgctggagtttgccgagctgcatccgaatgtcacactgcgcatgcaagttggctcagggctcgactatttcagccagcgggatctggatatcgcgctgcgttttggcccacagccggagtccgactgggtagcgcgtaaactggcgcgtaacccttccgtactctgtgccagtgctgagcttgctgccaaactcagcacagtaacgcttaccttagcgcatcccgagcagttaaaagagcatcccctactcagtctcaaccacaagctgccgtggatttttcatcaccacagcgtcgcgcaaaaagtgcaatttattccgacggcgcgtttgtgctccgacgagctggacacgatagtgcaagccaccttacaaggcatgggcatcgcccgcttaccaagaggattaatggagccactcctgcgtagcggtcagctcatcgagctgctccccgagtgggaaattgaaggcgcagatgtgtatctgctccatccgcagcgccgttttttacctgagcgcactcaagccctgattgattacatcatgacgcactggtcacgtgtcgcattcagttattggcatcagccttaacagcaccaagcgactgtgatgaacgatgacgccggcagcgctccgaacaatatttgacttcatcccaacactgctgccattttttacgccaagcaaaaggccgctgacagacaggacaaattttctgcgccaaataggcttttttatgcgaagtcaccctacaccgagtatcacgtcagttattcaatttgaagatatacgaacgttgcgtctgattggctcaccgcttgttatgatttgggaatcgtaagagagagcaaaagagaacaagaaagaaatcagggcaacatactttgtgaatacgcttggtgagcccctcctctgagtgaggagggaatcgagaataggaaatgataagcaggagcgcggttacaaaaacgtacaggtgaggctcaatcaatctggtcgatgaaccagcgctgaaactcttctagaggcaattggtattgtggcaattcctgcatcaattgggcaaggcacggttcaagcgccgttttgttgtaggtgagcccgcttaaacgcagcgccaattgctccatcggataagggtccagcatgtcgctgaaaatcgtggcttgcacaatcgtgccgcgctcaacttcaagatacacctcgacgccaccccagctaaatcgttcatccatgtggtgagtaaaaggtggcgtttgtccgaagttccaatcccaactgctttgctgagcgaatttttgctcaaatcccggcaaatcaaaaaacgactgcggcgagatcaactcaggctcaacctgctgttggtaatgttcgcaataggcttgcatgatcgcttcacacacttgttggtgctcaatatccgctttaaccgtgttgaggttgatgactcgcgatttcaccgaggttatgcctttcgcttgcagctttttaagatcgggattgaggtaatcggctaaacggttgagatcggcactcagcagcagcgtgccgtggtgaaatccgcgatccagcgtttcgcgataagcagaaccggaaaacttacgaataccctgttcatcttccagtaccagatcattgcgcccgttggcgaccccatgaatccccaacttttgcagccccgccaacacaatcttggttgagacctctttatcgtactccggtttacccgccataaaggtgaagttggtattgcccaaatcatggaaaactgccccgcccccagtctgacgacgtgcgagtttcactttgtcctgctccatacgatccgttttgcattcgcgccacgggttttgcgcacgaccaatcacgacggtatcggcgttacgccacaaaaacagcacacgctgatcggcgggcatagaacgaaaaatcgtgtcttcgacggcgaggttaaaccaagggtccgtagaatcagagagcagaatgcgagtcttagtcatggttgttgcgtaccaagcaatagaaaagatgcgccatgttacgcaattctgcgcagatagccaaaccccttgctttcaataaattcgccacacaaaaaagccttccgaagaaggcttaagatgatcagcgaaaacagacctgtgcccagcgcgccagacccgccgtaaccgaaccaaagtagttaccactgacgataggcacgttaggcagagcttgctcaacaccagcccgtaaaatcggtgaacgcgcgctaccgccggtcataaagatcacatccggcgtcacgccgccgagcgtcaccgcttctgtcaccaactcaatcattttggtcttgggcacgtcaatcgcttcgatcatcgcttcgcgttgaatttcaacttctagcagttcggatagcactttgatttgcgcaatcgctcgcgccgtgtcagagagcgcaatcttcgcctcttcggcttttttgacaaggctgtaacccaaagtatcgtgatagaccgccagaagtcgcgccagtttttccggctcacgcgcctctttgtgcaggcgttttaaatcggccaaattttcacgggaaaagaatttggcttgcgcactcacatcgttaatcgcaatcggattccaaaattgggtgatcggcatgtctagcccgctttgcgtttgagtgccaaaaccaaagggcgtcatcagggctttgaaagcgagatgaatatcgagatcgttaccgcctacgcgctgacctgtatgcgcaatcagactttgcgtgcgatccgctttgccgcgccatgatggccccatttgaataagtgagcagtcggtggtaccgccgccaatgtccactactaacacggttttgtcttcggtcagtgtggcttcgtattctagcccagcagcgacaggctcaaactgaaactcaagatgacgaaaaccagcgcgagtggccgcacggcgcaaaatattttccgcttgctggttagagtcctccccgccccgaccatgaaaattgaccggacgaccaatcaccgcatcctgaatcactgcatcggagtgagcttctgcttgtgctttgatgttggccatcatggcgcacaccagatcttcaaaaaagctcagttgaatgtcgtgtaaccccatcgcccccaaaaaggatttgggcgatttcacgtaatacacttcatggggatcggagagatagagatcaagcgccgcctgaccaaacaccacatcagcaaactgtaaatcaatgccttcttcacgattagacgccaccgaacgacgcagaagttgctcaccgagtgcatccgctggggcaatgtgacgatggcgaaatagatgttcagacaccgactcacgcgtgggcgcggcgagtgtcgaaggaatatagaggctgtcaccttcaagtgggatcagcacaggcctgccatcctgcatgctcgctaccgagcagttggccgtaccatagtcaaatccaataaacatctacccactcctactcttaagcgaaaaaaggccggcgatcctatcgcaagccttctcttatctctagaagaaattgttgtttttgatactcactcacggcgcgccctctcctaaagccccttcccagattcaggtcatcgctatgccattacttggaacagcagacatgaaaaagccagcatgacgctggctttagcattgcgattaaagcaaatcttacaagaagtggaacgtcgcattgaatgagagcgtgccaacgtctgtgctatccatggtgtagttcatgtagcttgcgcctactgagaatggccctatgatgaagtattcggcaccgatgccgtacatcacgtcgataccatcatcgattttgccaccgttgatgtctttatcccatgagtgcaggccgcctttagcgtaaacgtgcagagggccgaaatccatgcttggtttcactgcaaagtaaagagaagaggctgacagctcttgagttgcattgatttcaaagtcaccgtggttcacgtaacccgcttctaaaccaatgaatggcagaatacctgtgccagcatgcacagagtaagccgtaccatgtttgccttcataatccgattgacctactgacgcaccgccatagatccatgaatccgccatcgcggttgaagaggcacccagtaatgccagagcaagtaatgtctttttcataattaaccttctttaaatagtggggcaacgttgacggcggccagtcgttgccacattgagtgcaaattccgtcatctcagcttgttaagcaaatttcgtacctatttattatcgagtgccacgaaatttgccttcatgactaacaagcctcaatcgcgttgatgatccgcttatccgaaaccggatacggcgtacccaattgctgagcaaaataactcacgcgtaactcttcgagcatccagcggatttctcgcacgttatcgggaatcgccatccctttcgggatcttgttcagcagctctttatacttgttggctaccgattcaattttcagcatatgcagacgatctttgttgggatcgaccggcagtttttccatccggcgttcaatcgcgcgcatgtaacgcagaatgtccggcagacgtttccaaccgcactcagtcgcaaagccgctgaaaatcagcccttcgatttgtgctttcacatcagaaagcgcaaacgccatcgtgaaatccaccttacctttcaaacgcttattgatgttgtaagccgtggtcaaaatggtttctacctgcttggcaatctcaactactgtatcgccaagctcggcacgcacatgctctttgagcgcttcaaatgcttgtggctcccacaccatgccgccgcgctcttcaatcagcttatcaacgccgcaggcaatgcagtcatcaatcaaatcgagcactttgccatacgggttaaagtacaaaccgagtttagatttgttcggcagattggcgtgcagatatttgatcggtgatggcacgttaagcaaaatcaaacggcgctgaccggcacgcatcgcgctaagctgctcttgctcggtttcaaacagtttgatttcgacgctgtctttcttatcgactaacgccggataagctctaacttcaaagccaccacgcttttgctggtacactttcggtagctcaccaaacgaccacgtatgcagatcgcgctgctcgatatcgtcatcggccacttgtgaaagtgtctcttgcactttctctttcaagctctctttcagctcatgcagatcgcagctttcattgagcttgcgattgcgatgatccaccgcgcgataagtaatttttaaatgcgcaggcagttgatcgagtttccaatcttcacgcagcaccgtcacacccgtcatgcggcgcagctctttttccattgcatcgagcagcggcatttcaaacggtgttacacgcgccaaaaaagcgtcagcgtaattgggggctggcacaaagtttttacgcagcgttttcggtagcgatttaattaagctcaccaccaactcatggcgcaaaccgggaatctgccagtcaaagccatgtggctcaacttgatttaagattggcagcggaatgtgtaccgtcacaccgtcactgttctcgcccggctcaaactggtaactgagtttgagtttcagattgccttgatgccagaaattcgggtaatccagatcggtaatgtggctggcatcgcctttgaacagcatctctttttcaaagctgagcagatccggcgttttacgactagcggttttccaccacgcatcaaaatggcgaccagacaccacttcggtaccgacacgctggtcgtagaattggaacaactcttcatcatcaaccagaatatcgcggcgacgcgatttgtgttctaactcttccacttcggcgagtagcgcgcggttttgtttgaagaaggcgtgtttggtttcccaatccccttctaccagtgcgctgcgaatgaaaatttcgcgactgagcacaggatcaatcgtgccatagttgaccaagcgcttgggaacaatcgggatgccgtacagcatcactttttcatacgccatcaccgccgcatttttcttcgaccaatgtggctcactgtaactgcgcttgctcaggtgtttcgctagtggctcaatccaatccggttcgattttcgcaaccacgcgcgcccacagtttggaggtttccaccagctctgccgacatgacccatttcggctgctttttaaataagccagaggcaggaaaaatgttgaaacgtgcgttacgtgcgccgtggtactcgttcttctcctgatctttcataccgatgtgcgacaacaaaccgaccaagatcgcactgtgcaccgcatggtaactgcccggctcatcattgagcttaaaacccatttcccgagtcgattgatgcagttgggtgtacacatcctgccattcgcgcacacgcaaatagttgaggtaatcaagcttgcactgacggcggaactggttactggtcaacgctttttgctgctgtccgatgtagtgccataagttcactaacgtcaggaaatctgaatcttcatgattaaagcggcgatgtttgtcatcggccgattgctgcttgtcgctcggtctttcacgcggatcttgaatcgacaacgcggaagcaataatcatcacttctttcaaacagcctaatttagacgcttcgagcaccatgcgtgccaaacgtggatcaatgggcaaacgcgctagctgcttaccactttcagtgaggcgttttttcgggtctttgatttgatcgttgatagcccctagctcttcgagcagacgcacaccatcttgaatgttgcgcttatctggcgcttccacaaaggggaaggcttcaatatcgcctagccccaatgccgtcatctgcaagataaccgaggctaagttggtgcgcagaatctcagggtcagtaaactcagggcgtgacaagaaatcctcttccgaatagagacggatacagatcccctcttcggtacgtccacagcggcctttacgctggttagcgctggcttgggaaatcggctcaatcggcaaacgctgcactttggtgcgatagctgtaacgactgatccgcgcggtacctgggtcgataacgtatttgatgcccggaaccgttagcgaggtttccgccacgttggtggccagcacaatgcgacgacccgcatgaggttggaaaatcttgttctgctcaccggctgacaaacgtgcatacagtggcacaatttccgtatcacgcaggttgcgctttgaaagcgcatccgcggtatcacgaatttcgcgctcaccgttcatgaagatcagaatgtcgcccagcccttcatcgcacagctcatccacggcttggaaaatgccttccagttggtcgcgatcgctttcgctgtcatcatcccccgccagagggcgatagcgcacttccacaggataagtacggcctgagacttcgatgatcggcgcattgctaaaatgcttcgagaagcgctcagggtcgatggtcgccgaggtgatgatgactttgagatcgggacgacgcggcaaaagctgcttgagatagcctaagataaagtcgatgttgaggctacgctcgtgcgcttcatcgataatgatggtgtcgtactggttgaggaaacgatcgttttggatctccgccagcaagataccgtcagtcatcaatttgatttgagtctgatccgagatttgatcggtaaagcgaactttatagcccacaaagccaccgagttcggtttccatctcttcggcaatgcggtttgccactgatcgcgcagcaagacggcgcggctgagtgtggccaatcaaaccgtatttaccacggcctaattctgcacaaattttcggtagctgagtggttttgcctgaaccggtttcaccggccacgatcaccacttgatgatgagcaatcgcctgcgcaatatcatcgcgtttttggctaactggcagcagcgcaggatactcgattttgggcatctgctgtttacgctgctcaaccaccatcatggattgcgcaatatcgagcgcgatttcgtcaaataccgcgttgcgtgccgattcatttttaattttactggcaccatcaatgcgtttactgaaacgaaaacggtctttgatcaagcactctccgagcgccttttttaaactggcagcgctattggcttttggctgagctgccgaatcgggtgtgggctgtgacgaagtcaaagcatttcctattgttatctttccaaaaaactgcgcggattgtaccacagagttttagcaacacgcccatgatcccacgctttagccacctttacctgcctacagaaacagcaaatgcaagcctaatactcaaaagaagcttcgttttcggcgcgattggccgctaaaatgaagatagaaccttaaggaaacgaagcgattgtgaaagcctctgaactgaaaacgattttaaaccagctccccgatgaccttgatcccgacgtggtgatgggggaagtgtggcttccagaacgcttaattgaagcgcagcttgatgacgacatgctgtttctcacctttgataacgcgccggaagaaggggaaggcgaagaggaaggtcgcggctttgtggaacatgagatggaattgatccgctcacagctcatgacgattttggctgaggacagcggccccaaaaccaaagccgaagcactactggcgttgattactcttgcccacgaacgcactagctcagaatttatcgaaattttaggtactatgcttgaagagtgacgctcaaggccacattgtttaacctacgactcccaatctccaaggcttgcctatgtttaatacactcacctccctgtttaagcagcttcttgaaggccaagacttagctcaacactctgccacaccggagctggctatcgcctgtctgctcagcgaagtggctggcgcagatcaacaaatttcagcgccagagcaacaagctaagctggcactgttgcagcatttgctccaatgtacggctgagcaagccagcgacttactcatgcgcgcagagcaagaagtcaaacaatctgcgtcactgtacgattttacttcccagctacgtagcctctctcaaacacaacggtttgagctgatcaaagcgatgtgggaagtggccaacgcggatggcacgattgatccgcttgaagatgcggtaattcgtaaggccgctgagctgctgtatgtcgaccacagccagtttattcgcgccaaactgatggccgcagacaaacatcaatcaccagaataacgccgcgcgttatcggctccgacactttctccctttgtctgaaagacaaaaagcgcgaaattcgcgcttttgaacttgggctttgatctaggacttcttgtctaaaaagtcactagagtggtggtgtcattcgccaatagagcatcacagcgatacaacttagagcattcaccagccaacagacgtagagtgtattttccattcttgtactcggctttgtggacaaccatacaaaagcctagaacaagatctgatgcgttgcataacaatttgctgaatatcacattacagcatggttaacgctaactttgccaagttgtaggcatcaacatagcctgagtgctgacgcccttcccattcaataccttgcgattcctgagccgcgcgatgaccgatacgtttgtctttcaaacgatgttgaatacgatacaaggtggcaaggttcagaaactcttggaacgggacagaaaggcccttttctcgacactcgttaagcaaaatgaggtcatcgcgcccccatgaggcgtaaattttattcgaaccaccgaagtttttgaccatagactggatcacctcagctaaaggccgaccctgcttttcgattttgcgcggtgtgatcccagtaagttcggcgcaaaacagcgagatttcatctttttccggtttgacaaagtactgcgcgcgcttgacgatttctcccgccgcgagatcgatttctgctagaccaatttcaatgatttcacccgtggttcccactccgttttcgttccaacaacacatttctaaatcgaagcacacaacacggttgtaattcattcttggctctttctctgttacataaagtcgaacatcctacctgaattgaaggcataattcgattctaccttgctgcattgctgcgcaatcgatacacgatttcgacctttcgatttactgagatagagctgatcatcaacactctgtaaaatttccggctcactgtactcacagttaatgctcgccccaatactgatggttaaggttaatggtgtctcggcattgagcatcacaggttctgcttcgaccactttacggatccgctctagataagtataaagcgccgtttcatcagtaacggatgacaagatggcaaactcatcaccgccgaaacgggcaaaaatatccgattcaaccaactcttttttgaccacatcaaccacatgcgttaaagcgtaatcccccgctaaatgcccatagctgtcgttgatttgcttaaagcggtcgatatcaaatgaaatcaaggtaaaggattgtttttcatctaacattttgcacaaatgctgactaaagaagcggcggttatagatgttggtcaaactgtcatgctccaccagataacgcagctctgcggtacgctcctcaatcatatctgtcagccgttgtttctcttccagttgcattcgcatgatgtagctaagcagcagagaaataataacgccacccaaccctaagcccagtagcacccactcttcactatggttaatcggctgatgcagttcaaactccagcacccaatcacggtttggcaacaccaatttgcgctctattttgggttcatcatccgctcgccacatcgggctttgataaagaaccggactgtcttccgaatcaaatccggtgtcaatcacgcgcatatcgagatcttgttccatgacgctgatttggaccagtttctcgaaataggtggataggcgcaccaccccgaccatcacaccaagtaagctgcgatcatcttctgaagaaaaaacagggtgatagaccaacatgccatctttgacgatcgacttatcaatcccatcttgtagcaggcgcactttatccgaaacattcggccgacgattaacgacaatatccgccagtattcgtttgaaacgttcacgctccgagtaaaagcctaacagtttacgattgtcataattgagtggataaatatccgataaaacgtatttcgcttggtcatccgtaccgaaaccgtatttgatctctcccgtttttggcaccgtgtacaaagtgaactcaggaaaacgttgctgcattcgcgcggtaaaagtttcagcctgaggcggctcaactttcactaaccattgtaaagcaatcaggctttgtgaacctttaagagtctcttctgcgaaagtgtgaaaacgcacccagtcatcgcttgtgcttgagcggaaaaagttggcggcagagccgataaaatggatatcaccatcgacaaactgttgcagtgccatagtttgcctatccgcaaggttttccagcagagtacgattatggcgcagctgtaatgagtatgcggtgtaaaccacaaacacagtcagaagcagagaaaacaacagtaccagcaagggcacaatcacgcgcacatgtttgagcatccacatcttccttattatgttatctatcatgaaaaatcatgatgaagatgtgtgatatatcaatatccttacttcagttgggacgctagattcaagtcattttcagagcattcagtgataaaccgagcgcttactcacgaaatgcaggggtagatggtgcaaaatcgaccacactcactgctcacaaagccaccaatcaaaccttatcccagcctgtaaatcgggattcatcgctgcctttcgccttgaatatggtactatccgcccctattttgagcttagtctataacgcagcttagcgaaaaaagcctgagttaacactggcacaatgaaacaaagtgcacctgatacttattattttcgctaggcgtataccaaacgactcgacgcttcaggtcagtggtaagtctgtcaatctccgtaaacacatagacaaactgtgtgatgaaagagagcaaacagcccgcccgtagcttcaagtccgggtatagaaacttgttgtgccttgagcacagagtctgcaaaagagaattcacgatgaatatcgacctaaacctgatcccaaccacttttgatatgctccatgctgggctagcagcttcgtcagtactgctattgattgttgccattgctcgtaaaggcaaagtgacagaaaagatcgtagaaaaacccgtcgaaaagattgtgacggttgaaaagccggtagaaaaaatcatcgaagttgaaaagatcgtcgaagttgaaaaagtcgtggaacgagtcgttgaagtggaatccaaactcgcaaccgcctcaaccgattcagcactgcaacttctctcgctgctgcaaaaagaagctcgcctaattgacttcttacaagaagaagtgagccagttttcggatgaagaagtgggcgcagccgctcgcgtgattcatagtggcggccaaaaagtgctgcgcgaatacctcacgctatcgcctattcgtagcgaacaagaagagagccgcatcagcgtcgaagcgggcttcaatacgcaagaaattcgcctaaccggtcaagtgactggccaagcgccattcgttggcactctgattcacaaaggttggcgtgcagattccataaccctgccgaaactggcggacaattacgacacttctatcctcgcgcctgcggaggtagaactgtaatggagatgccaattcattccgccaaatacagtgtaggtatcgaccttggtacaacccactgcgtactcgcttatcaagatgtacagagtgaagagagccgtgttgaagtgatgtcgattgcgcaaatgacagcgccgggcactgtggaaaacctcaaccagctcggttctttcgtttatcaaccccatgaacatgaaatggctgccgcttcacgccgtttgccttggagcagtgaaccaactgcactggtcggtgcaattgcgcgtaatttgggctcaaaaaccccgattcgcctagtcgcaagcgccaaatcttggttatgccatgcgggcgttaatcgtcgcgaagcctttttgccatcgggcagccctgaagatgtcagcaaaatttcccctctgcgtgccactgaactttatttagagcacttacaagccgcgtgggatcatgcgcatcctgatgccccattagctgaacaagatgtcaccattaccgttcctgcttcgtttgatcctgccgcccgtgatttaaccgcggaagcggcacgtaatattggcctgcagcactttactctgctcgaagaaccacaagcggcgctgtacagctggattgataaccgccatgagcaatggcgcagtgaagtgagcgttggcgatgtggtgttagtgatcgatatcggcggcggtaccactgacctctcactggtcgaagtgaccgaagaagaaggcaaccttgccctcaagcgtattgccgttggcgaacatattctgctcggtggcgataacatggatctcgccctcgcctatcgtctgaaaatgaagttggcgcaggaaggcaaagagctgcaaatgtggcaagtacaagccatgacacacgcatgccgtgatgcaaaagaagtactcctcagccaaccggatttggccgcagtgccgatcgtggtaccaagccgcggttctaaactgctcggcgcaacactgaaaaccgaactgactcgtgaagaagttcagcaaacgctagtcgatggtttcttcccagcagtttctatcaacgaacatccacaacacaaaatgcgcggcgcactgactcagatgagtttgccttacgcgcaagatgccggcatcactcgccacatcgccgcatttttaagtaaacaagccaacgcgcaaggtcaaaccgaaagcctgcctttcgcgatggccggcattccgggcatggccgctccacaagccgatttcattaagccaagtgccattttacttaacggcggtgtgcttaaatcgactctgcttgccgatcgtttgctagaaaccatcaatgcttggttaactcaggccaatgcggctcctgccaaactccttgccggagtggatttggatctggcagtggcacgtggcgcggcttactacggcgttgtgcgtcaaggtcaagggatacgcatccgtggtggtattgcttcggcttactatgtcgggattgaaagtgcgatgccagccattccgggcatgttaccgccgatggaagcactctgcgttgctccatttggtatggaagaaggctcgagcgcgcaagtcgcggatcgccagtttggcctagtgattggtgagccagtgcacttccaattctatggctccaccgttcgccgtgatgatgttgcggggactcaccttgtcgattgggccaatgatgaactagacgatctgccaaccattcagatcaccttacctgtttctgaaggtcgccgagcaggagaagtggttccggttacgctggcatcacgagtgactgagctcggtacgctctatcttgaagcgattgcggctgataatggccaaaaatggcatgtggaatttgatgttcgggataacccacagaacgaacctacaccacagcaacattaacaagacagtagcggcatccttcggggtgccgctcaacctttatgaacacgaggtatcgcatgtcatcaccacgttttctggtcggcattgatttaggcaccaccaatactgtggtcgccttttgtgaattgagcgatgctcttgaacaagcgcctatagagatttttcctgtcgatcaattgattggcccaggcgaggtggttcgccgtccacttcttccgtctttccgctaccacccttcacacggacaattcaccgattctgatttgaccctgccatggtcatccgaattggtcgagggcgatctgccccaagtgattattggcgagtgggcacgcgatttaggcgcgaaagtcgaaggccggcaagtctccagtgccaaaagctggctgtcacaccctaatgtcgatcgtactcagccgattttgccttgggcaggtgccagcgatgttgaaaaagtatcaccgattgtcgccagcgccagctacctcaaccatattcgccaagcgtggaatcatcgccatccgttgaacccgcttgagcagcaagaagtggtgatcaccgtcccagcctcgtttgacgaaacggcgcgaaaattaacgctcgaagccgcacgactggctgggttatccaacatcatgctgctcgaagagccacaagcggtgtgttatgactggcatcatcgccatcaaacccaagccaacgagatcttgcatgcgtccccgctgattctggtgtgtgatgtcggtgggggtaccacggatttaagcctgattgccgcgcaatttgatgcgcaggccgccttacaactcaatcgaattggcgtcggcgatcatttgatgcttggcggtgacaacattgatctggctttagcgcatgtggcggaacgtcgctttaaccaaaacaaaaaactcagcgcggcaggtttatccaagcttatccagcaaacccgccaagcgaaagagagcctgctctctgcagatgcaccagagcagatgaaaattaccctgctcggcagcggctcaaaattacttggcggcactcaaagtgtcgccctacaccgtgacgaagtacaccagattgcgcttgatggattttttccactgacccagcgtgacgtactaccagagaaacgccgcagtgcagtcgtggagtttggcttgccttatgcgtctgaccctgcggtcagtaaacatatcgctgagtttttgagccaccatcaaggcgtggtgccttccgatcctaatacagagcccaatacagtatccaccgacctgttgccgacagcgttattactcaacggtggcgtctttaatagttcgctcatcacgcaaagactcatcgcgttactgagtgactggttaggccggccaatcaccctacttgataacccacacccagactggtctgtcgcattaggcgctgtggcttatgccaaagcaagacgcggtgcacagctcaaaatcggtggtggcgcagcgcgctcttatttccttcatctacaagaaaaaaataaactcggcaaagccttatgtttgctcgccaaaggcagtgaagaaggacaagaaattcgtttaaccagccgccgctttgccctcacggtcggtgaaccggtgcgctttaatttgttaacttcgacgcacgatcacgtcacacaagagcaacgggtacaaaatggcgctctgtttaccattgataccgataagtttcagcccttgccgccttatattgttacgttacccgcactcgatcccaccgagcttgccgccaaccaaaagcagcgcgtagaagtgcaattggcctgccaattaaccgaggtgggcacgctgcaaatcgtgtgtgtcaatcccaatgatgaaaagcagcgctggcaggtcgaatttgatattcgtcacagcttaacccaagccggagagctggaggacagcgtcgctacttctcctaagttacaacaggcgaaagatctcatcagcaaaatctacagcgccaataaaaccagtgctgaccaacaagcgatcaaaacgctgaccaaagagctagaaaaacgcttaggtaaacgggaaacgtgggatttttccaccttacgcagcctgtttgacacgcttgcccttggccgtaagcgccgtcgccgttcagagccccatgaaaaaaactggctacgtctggccggcctctgcttacgtcccggttttggtgatgccactgatggttggcggattgaacaaatttgggcgctgtaccaacaaggtattcagtttaccaatacgcaaggttggacagattggtgggtattctggcgtcgtgttgcgggtggtttgaatcaagaacagcaagaaaccttgctggcagatatcgccaagtatctccatcccggagcaatgcgaacgcctgcttcaactaaagaagcccaagagaaaggctatgaagccatggtgcgtctcgccgcctctttagagcatttacaggtggaagacaaaactctactcgccacttggtttttaaataaggcactcaaccatactcaatatcaacaagcacattggtgggcattaggacgattggccgctcgcacacctttttacggcagcctgcatacctgtctgcccaaagagcagatccagcagtggctccctaagctcttagagcaagactggcaacaagagccaatgtgcgcttttgccactgtgatgatgtgtcgcaaaacgggggatcgcactcgcgatatatcggaagaatggcgcacacaagtgttggataagctcaagcagagtcgcgtggccgattcatggattaatctggttagtgacgtagtcgaactggatgaagcggaaactcaacgcgcctttggagaaagcttacccaacgggttgattttgctggctcactgagcgagagcgacaagcccaaacaacttgaagtcgcagatataccaaaactactgggagttgcaggtattgaaattaggagccgttaggctcccatcctataaacaatctgagttaactcgcgctcacgtcttgcagcatgattcggtttcgtccttgttgcttcgcttggtataacgccttatccgcttggcgtaatacttcgccatattcatgtgaactttcgaaaatcaccgcgccgatactgaccgatactttgagtggttgctgttcaacatgaaaacctaccgaaatcgcatcacgtaccgaatcaagagcttgcgatactcgctcaaaatcattttcacgggcaaagatcgcgaactcttcaccgccatatcgagcgaccaagcattccgttaatgccagtgactctaaatggcgaaccacataagtgatcactgaatcaccaatatcatgtccataggaatcattgatctgcttgaaatggtcaatatcgactaaagccaccatagatttctgcttagactgcttcaatttttgctgtacttgctctttaaaatgacgacggttaaacgcgcctgtcagttcatcttgaatagagcgtaagcgatgccattctatttcctcgaacaaaaacagcattagcatggtgccaagaatgataaaaaagaacaggttctgcaccactatggtcgaggcgcgaaataccgccaacaaaggtaaagtttgataagcgacgaaaggaacgtagagcatgaccatcatcattgccaatacaacagcgaaaagagtttgctctggccgcccacgctgaccattttttgccgcaacgattgcagaaatcagatacaccgaagacaagcttaacgaagcaatcaagatgcgcagtcctatgtcttcaggattcaaacggaacaagagatataacaacaaagcaaacaacaaggagtgcgccatcatcagtaggtataagccacttttgatcggcttttgataccagcgcaatacggcaaatagcatgcaataaccgccaagttgatagagcaagttattgacaaagatggcaaatcccatcggtaaaataaaacgcagcgaagaggtggtataagccaagccgtaagccaaaaacagcagcacaaaccaagtggccgtatccaatttatgttcaatcagcttgcttcttaacatataaagaaagagcgcggctattgcactgcatgcgatgttatttatcactgtggcaatttctaaaaaagaaagatccatcatgcttggtcgtcctgaatgcacaaaaataaaatcaacttaaacaacattttggcgctcttctccccaaataactactaaaatataaattatctaacaacttaagctcgcattaacgacctgaacgggtgtagaattcgcctcccaaacaaaactatagtcttattaaagacaagtagactcgcgtcgttggttagtaactgctgtgacagtttgctcttttgcttaatttcgattttcgtgaatagcctcccctatgcaggaaatcgaggtatcaataaaacatagattctatgcccagataccctaacgttgcggaaaagcggatatccttcaatcttccactctttcgcaatcatataggctgggtatacaagctcaggttgcaaataagccaatggaacaagataaatttacacatgtttttcgtttgccagggtcaatccaagtgcgcattgccaaatggcagcaaacttttcgaggtaagtctgatttagtgctccatcaagcactggtcgcacgcaatcatcaatatcaacaagacgaatttctgcctaagggttggtgcgtcaatctgtttgatccggacgacatttcgattactcatcacggtgattatattcaaaccgcaatgcgcactatgatcgatagaaaagtgtcttataagcgcatttatctgtctcgtttacccttagagcaggcagaagcagaattacgtcaatttaaaatagtgtggatcaaaaaacataacacggttgcgcagcgctttaatcaaactcaaaaagccgcattcttgaattatgctcaagaagaaattgagacactctaccctgccattcctgaacaaggttttgaccgtggattgtggaatcgcttggtcaaacaagaatttggaccagccgaacactacgaagacccctattttgtcgtcgaaaatgtggcggcaaagaaagccgccgagcagagacaatcacagcataaacccgcaaaatttgccgctcgacgtaaaccgaatcccacaaagccttttcacgcgagacccgcagcgcccaaaaacgcgcgctactcatcgtcatgacagaaaccgcagcaaccaaattctgatcccgttgctgcggcctttgtgcatcagctcactaaactggtgtgatcgtgcttatcttggtgggcgcaatacaccgtattgccggattgatgttttgcggtgtacatcgcctcatcagcaatacgcaataattcaggtacttgggtcgcttgctctggatataaggcgacaccaatactcaccccaatctctaagctctcttggttaagttgaagcggcttttgtagtttttctagcatctgataagccttattgataacgccactgtgatcctgcagcagatctaggcataccacaaattcatccccccctaagcgcccacaaaaatccgattctcgtatcgaccctttgagccgttgagcgatttcttgcaagacaagatcacctacttcgtgccctttggtgtcattgatttctttaaatttatctaagtcaaaaaacagcaaagccagcttcatgtttgagcgcttcgctttaattaacgcgtgactaagctgctgtttaaaggcacggcggttcaaaatacctgtcaatgaatctctttctgacaagaaacgtaattccgctttttgacgctctaatttggcggtttttcttgccacttccgcttgtaactcatctttggtaacggttgtgctttgcagcgaagccttcatttgattgaaaaactgagttaattgaacaaactcttgttcattattttgagtggaaattcggctggcgagatcccctttcgccatttgttcaatcccttcttggagagttttacatccatgtcggaagcggcgtaacaccaccagcgcgataccacagacaaccgatgagaagagcagtaagtgcgccatggtggttaacaataaatagcgttgattattaatgctctcttccatgacttgacgctgaaaataggccaactcctcattcatgttttgcaccaaaatattgtatcgagagtgaagtagctcataagttccgatgccatcgaccaacttagtaatgcccgattcttcggccatgtagcgctcttgttctaatagcccggctaaactgttattcattctttggatgccggctaagtgttgcccaaagaccgtttccatctcgagctgcccagccaaaacctgctgcgcacgataaacctgctctaagctatgagcatcgttgtattgcagaaagacccagagctggctacgcaacatggcaatgctgttttggatttccaaaatcgtatccagctcagcattggtttgctgctgccgctgatctaagttcagtaatgagaaagcaataaaaccaactaacagcagtgatgcaataaacagtaacgtcattttgcggtttaatgagttgatcaaggctggcctccatcgtttttcaccgcttcgctcaacaggtcgtcagccattaattgccgataatcgggcaattgaccatgcactaacttgttttctaatgcccagcgtccctgaagttgtaagttcgttaataacgtattaccgagcgagagacgaaatgaataatcttgccatgaccatctcagctgtttttcatcaatattcagcacacctgccactcggtatcgagtgcgttctgggttttgatgaatccaatcaatcgcttgcttcagggcttttaaaatcgcaagactgcgctgcttttcttcttccgtcgtcggtttcatggttaataaattaaacgataaggtgtaaatgcccggtaaactcaggttggtcactttcgattccgcagcaaccccaattttgtatccccaaggctcccaaatcgaaatggcatccagctgtttatcaaataactgctgataaagctgatccgcagtgccatacactttatcgattggaatacctttcaagttattggccaaaagtaatgaatcaaaatagaactcactggcgctcgctctgatcataccgacacgtttgttgtgtaaatccgcaaccgagcgaatcgtctcactttctaatgcaaggagcttcaaatcgttatctgattgcacaaagctagcaagaataagaaaatcctgacgctcgaagctgctaaacattgccacagattctgacgccgtcgcataactcaccgccccttgaaacaaggcttggctgcattgcactccaccactgcatgccacgagctcaacatcaatcccctgctgcttaaaaaagcccagctgatcagcaagataaaaaggggaagaaagaggtgtttgtgataccgctattttgattggagcagcattggcgttaacgctaatcgcggttgccaaaggagtcagccatcgccacgctacgaaagcgatggcgaggatcgataggtaaactatccatcttcgggattgccgagccaaaaacatgccaacctctgaatctgtatgaatattgttctatggtttagtgtagttgctaatcggtgattcgcgagtgttgcccttatggacaacactcagcgtttgaattgagaaaggattgtgtgtctaccgagatgatttgtcggttatttacaggtttaactaatgagtgacatcatcagtacgttcaccaaaatcggcttgatcatagatatcggccaaggttttttggcgtttttggttacttttgcgatatttcttcggttcaaagtattgttcaacgtgctgcaaagtttcctcatgctgtttggcagattgaagaaattcagggttattcatcgcttgctgacgcagacgattaacacgttcgagtgtgtcccaaaacatattatgccctccttcactgtacataattacagcatagtcaactttatactcttgtcaaccggaatactgttttttaatacagttcgatagggcgtcaaatgataaacaagccaatgatgtacgtttcaatcgcacgtttaatacattagcctgctgcgactatcacaaaatgagatagcaatcagaataactcattgtttatcaagttaatgaggaatatattttccgaactaacatcacatattcagaacatgaaactctattttaaacgctcgttgcttgtctttagcctaatgtcctcattctgcgtcgcctctgaacgatctgcatgggaagaggtttacgccaaatctcaacacaaacaaacagagacggccctaaaactattacaggatcgctaccattcccttcctgaaggggcagaaaaactctatttaacctctaaattacacggctatttcgtgctcaaagggcagccctattatggtgaattggtcaattcccatgatacttacgcgctgacagaacaacgcttcctagacgcgttgaatcatgaagaaagtctcgattaccactctgcagaagaaacctacttaaccttctacgccgagatgaaacaaaaaaacgaccaagatggcatggtgctatttgaataccatctttgtcgtcttttccagcggcatggccgcccgtaccaagctcgtttctattgctcacagatggatcagcgccttcttaatgctgaagatcccctatttcctcgctatcgcggcctacacctcgtcgccaataatttggagttcttaggggaatatgaagaggcgctgcaaacttacgatctgctactcagtctgctgcctgattatgtcgacccatccggtatttataacgatgtcgggcttctgatggggacattaggccagtatgaatcggccttggactacctcaataaagcattggagtatcgactcgaacaaggcaacccactacttatcgcgcaagtagaacacagtttgggtgatacttacttcaagcaaggtcgatatgaagaaagcatcctctattttgaacaagcgaaagcccatcttactcccgctaattatctgtttgggttggcttacgtgcacctaggtttaggcaaagcgtacattgaactcaataatttcgttgaaggcgaccaacatctctttcaggctctcgagtatgtcaatcaacataaagaccaacatttgcagggactgatttacttatcacttgcgcaagcccatttcaaagagcagaaatacgcgcaagcgattgactatgctaatcaagctgtcgcgattagcgagagcgcttctctgccacgcattaaagcgcaagcttatttacagttagccaaaattgcggaggctgagcagcaataccaagaggcattaagctggtatcgccaatatgctgagagtgagctgttgctgcgcaacacagagcagcgtaaagcttttgaagcgctcgatctggcgaaagcggaattagaacaaaaacgcggcgtcaatttttggcgagaaaactaccaagcgttggccgaaaaatatgaaatgttgaagtggcaacgtgtttcactttcactattagtgattgtgtttgcactgattctgcccattgcccattatcgtcgcagaaaagagtgcgatcagaatcaacaagatagcttgcatggagtattaagccgcaccagtggattagagcgattaactcatattgaagcctgccagcaaactgagcatgtccatttgcttgctctattggatattgaccaactgaggcagttcaatgaacgtcacggctatgaacggggcgatattgcgttacaaaatacaatcaataccttgctgcaccagttgcgtgccaaggagtttgtgtgtcgcttaggggatgatgaattcttggtggttatgccaaactgcagacgtactctttcggaaacacggctgtttgtgcttcatcatgcgttaaatggcaaaacaccaaccgatgctaaatcaacagttggcttgagcgttaccctcagctatttagcggtagagagtggtttggcgagttttacgcacttttatcctaagctggatagcgctctaagcatcgccaaacagagcggcaatggcggcttaatcgatgccgccgatcccactaatgcgctgctgactgcttgctcttaagcgcactcattatcagatcgcgattatcgagatacgctttaagcccagcctgacgtaaaccacaggctgggcattcaccacagccatcacctatcaacccgttataacaagtgagcgtttggtgacgaaccagatccaatgctcccagttgatcggccaatgcccacgtctcagctttattcagccacatcaatggagtgcgaatcattaaaggcagatccatgcctttcgcgagtgcttggttcatcgcttgtacgaattcatcacggcaatcgggataaccggaaaaatccgtctcacaaaccccagtaatgaccgtggtcgcgccgatttggtaagcatagatacccgccaaagttaaaaacagaatattgcgtcccggaacaaaagaattcggcagtccattggcttgtagctcatgagaaaccggaatgtcatcacgcgtcagcgagctgatggccagctcattgagtaaactcacgtccatgactttatgcgcagtcacgccaagctgcttcgccaattgctgggccacttctatctctaatttatggcgctggccataatcaaaggtgatcgcatgcacttcatcaaactcttttaacgcctgaactaaacaggtggttgaatcttgcccaccactgaacacgacgacggcttttttcatgatgcgctccctttaagcaatgttgagatatttatgggtttggatagataaacgccaattgcgagcaatacaggtgcgaatgcacaactctgtcgcacgcggcttttggctaatcggctgcaaagcgattgcggtttgagcactgacctgagctcgtgcaagcaactcatcaagattgtcgatatctttctcggtcgccacgggatgtttaatttcgttggcacgttgcaaggctgaatccagaatcggtaacttccctttcatcgcgaccttgggtgacactgtcacccaagtgttctcggtcgcacagacttcgtaagtaccactggtttcaatttggcatcggcaacccattgcttcaaacgcttgagttaactcggtcaaatcgtaaatgcagggctcaccgcccgtaatgacgatatgttttgcctgataaccttgcgcttggtagcgttgaaccacctcttgcgcagtggcctgacaccaagttggcgcatcattggttttcagcaaaatttgtgagaatgaggtttggtctgagtctaatgtttcccaagtctgcttagtatcacaccaagcacaaccgactgggcagccttgcaagcgcacaaagaccgcgggaacaccagtaaacacgccttcgccttggataatctcaaacatttcatttattcggtacaagatgaacgacctaacatggataaacagttgcaggtggcagaccataatggagatagcgatcgaggtcaaattaaatgcgtctatccccttcttagttcaagcttcagcgatattggcgaccgttgttcaccctaattacatagagcatctaggttcgtcatataccgcctgcctacaactccaagtaattgggggataaccagatgacttagagcaacaaattgctacgaatggaaagcgcaaaattgctctaattttcattttttatcactgtggctcacagtttaagcacgatgtgtatataatcgagctcgttctctttttccactttatgtaggtacccgatgtacaaactgattgcgctcgatatggatggcacactgctcaatagccaaaaacagatctctcctcgcaccaagcaggctattgctcaagctcgtcagcaaggcattcaagtggttttggcttctggccgccctcttgatggcatgcgcagtaaattggaagagttacatctgaccacggaaaatgactatgtactctattacaacggctctatggtcgcgaatgtcggtactggggagattattcatcaacaaatcattgatggcaaagcggctaagcgtgtggcaacactcgcgcaagagtttgggctcaatacccatgcctttagccaaattcacggtttgatcacccctaaaaccagccaatataccgaagtggaagccagcataaatggcctcaatattaccgaaatggattttgcacaattggcagatgaccacccgatcattaaggcgatgatcgtcggagagccagaaaaactcactcaagccatcgctcaattaccagcgcaatggcgtgaagaatttactgtggtacaaagtgcgcccttctttttagaatttcttaacacgggcagtaataaaggcatcggcgtacaagcgattgcagcgcatttaggcattcaagccagtgaagtgatttgtatgggagatgcggaaaacgatcaccacatgctgcaatacgcaggcctcggtatcgcaatggcgaatgctatggaagagaccaaacacattgcggatcacattacgctaagcaacgatcacgatggcgtggccgtggcgatagaacgctttgcgctaggctgtttcagcgaagcttaagttttgatggggaagctttgggtaaggcgtgttatgccttacctgctctcttttatcctcgtcttttaaccttgctgagccattttgagtactgtggctttgccttgtagcaaggcgtattcactacttccggaagggatcaacacacacacgttttgtgtttcttgttgagcttgtaagagtaaagtgctcaattcaaccgatgagttgaagctctgtcgctgtgcatctcgacgacacaaatccacaaacacaaatggacaatcttgggtatgcagcaccaactcagcttgttgcatatagcgcagcgctttcagtgacaatagctcaacatccgctccaaactcgatccacgtcgttgcagaaaccttgtccgtagattgagtaagcagatgaatatatatgcgttctaatgactctctatcttgcgcatttttgacttccggatgggcaaaaaatcgctcccaaaattgacgacgtagatcaacactcggtaagaaatctttgatcgaattacgctttgaagcaccgaaatccgccaaaagtgcgagattttgcgctaaaacggcttccaaggtttcacgaatattgcgaatcaacactggagatgcgccgccgctggaaatggcgagctgaatgcggcctctttcaatcattgagggggtaatgaagtcgcagtatggctgatcatccaccacattgactaatatgccctgctctttcgcatccttgtagacttgatgattcaattctggattatctgtggttgcccatacttgaacataacgtttatctaaccagtgtgatgaataaaaatgctgaatccagtgacatttcccctgttcaatccaagcctgtaaagcgggagccacttgcggcgaaatcacggtgactttagcatccgctctcaatagcgcatcaatctttcggcaggccacttcgccgcccccgacgaccaaaacgggtttattggtcaaatccaaaaacagaggaaaatagcgcatagtacatcttatggttgtccatccttaactggcactcatgctaccaaaaatggggcaagaaaagcatctaataaccagaatgaaataaaatctgtgcaaatttcacccataaatcagtggatccgactgatccttaacaaattaatagaactattaattagaacttcgttcactcaccgccacgccatcctgttgcaccactctgtcactcagttgcactatttacatttatttaacacttcgccattctggcgcagttaaggaatggggaaattaagcaactcttttcactcgttgtttgagaaatctgacatccttacctacgcttacaactggttgatttgtcaatgtgcaaccacataggcatcaacctataactgaagaaacacaacatagctgaactcttgtatcaggtgtcacctggtcaaaaacggatcaaacaggaaggatacaaatggcgaataaactcactgttcttgcttctgtcgtcgcagcctcgtctgccatgctgagcctctcggcatcagccgcagaaagcactctagacaaagtgttatctcaaggttttattacttgtggcgtcagtacaggcttaccgggtttttctaacccaaatgcaaaaggggaatgggaagggatcgacgttgaatattgccaagcaatggcagcagcggttctaggcgataaaaccaaagttaaatttgtaccactcaccgcaaaagagcgtttcactgcgctgcaatccggtgaaattgatgttctgtctcgtaacacaacatggactctgcaacgtgatagcgccctgggtcttaactttgtcggggtgaactactacgacggccaaggtttcatggtgaaaaaagatttgggtgtgaaaagcgccaaagaactgaatggcgcgtcagtctgtgttcaatcgggcaccacaacagaactcaacttggcagactacttccgcaatagcggtatgacttacaaacctgtggtatttgatactgcagctcaaacttcaaaaggctttgatgctggtcgttgtgatgttctgacgactgaccaatcaggtctgtatgcactgcgcctcaatttagaaaaaccagactctgcggtcgttctacctgaaatcatctctaaagagcctctaggtcctgtggttcgtcaggatgatgataagtggttcaacgtcgctaaatgggtactgtacgccatggtcaatgctgaagagtacggtatcacatcgaaaaacgtcgatgagatgatgaagtcagacaacccagaagtaaaacgtatccttggtcttgatggtccgaaaggaacgggtcttggcattcgtgatgactggagctaccaaattgttaagcaagtgggtaactacggcgaaagcttcgatcgcacggtcggctctggctcaccactaaaaattgaccgcggtgtgaatgcactctggaatgcgggcggctttatgtacgcaccacctatccgttaattgataactataatcccgaccaccttaaagctgcagtacgagacgtgcgtactgcggctttaagtaaaaggaatctgcgcttggtttagctccgagcacaaaaatggataagaggttattgttgtatgaaacccacaaataaagcgacgccagagacttctgacgcgcattccaagcataccaatttgctttataacccaaccttccgttcggttgtgttccaacttctcgccgtttgtgtactcgcattttttctctacaccatagtgaacaatgcgttaactaaccttgaatctcgagggatcgcaacggggttcgcctttctagagcaaaccgctggttttggtatcagccaaagcttaattccctacgatgaaacttacagctatggccgaacgtttctggtgggcttgctcaataccgctctggtttcagtactcggcatcttattagcgaccatactgggatttttgattggcattgctcgcctctccagtaactggctaatcagccgcttagcagcggtctacatcgaaacatttcgtaatttgccactgctactgcaaatattcttttggtatttcgttgtgcttcaagccttgccatcggcaagggaaagcatgcatcttggcgagtggttttacctcaacataaaaggtctgtatctcgcgaagccaatctttgaatccggtagcatctgggttctggttgccttaatcgctggtatcattgcctgttgggtattgagtatctgggcaacaaatcgccaacgtttaacgggacaacaaaccccgatgggacgatacatactcttactgtgtgtcacttttccagtgttggtttattttctacttggccaacctatcacagcagaatatcccgtactacgcggattcaacttccaaggcgggatctcggtactgcctgaactggcggcattactggtcgccttgaccatctataccgcatccttcatcgcagagattgtgcgttctgggatcaatgcggtcagccacgggcaaacggaagcagcaatgtctctcggtttaactcgtacgaaaaccttaaaactggtcattattcctcaagcactcaggatcatcattccaccgctgactagccaatatctgaatctaaccaaaaactcctcactggccatggctattggctacccagacttggtttctgtatttgcgggcaccaccctcaaccaaacaggacaagcgattgagatcatttcgatgaccatgttggtctatctcacgctgagtttattaacttcagccttaatgaacctgtataaccgtaaagtggcactggtggagagataattatggcaacacatcaatttcaacctagcctaccgccgccatccaacacaacaggggtcgtcggttggttacggaaaaatttatttaatggcgtgtttaactcaatcgcaaccttggtgttaggctacttagctattcaaggtctcctaaatatcctcgattgggcaatttttaacgccaactggagcggaaccacgcgtaacgactgcacccttgagggcgcttgctgggtattcatcagtgttcgctgggagcagttcatgtacggcttctaccccgcggcagaactgtggagaccaaggctattcttcttcactctggctctttttgtcgcactgctggcttatgaaaaaacaccaaagcgaggttggatttggctggttttcgttaacatctatcccttcttcgctgccctacttctttatggtggtgtcttcgggctggaagtggtcgaaacccataaatggggtggattgttagtcactttgatcatcgctttagtcggcatcatcgcttcactaccaattggcgttgcactggctttaggacgtcgctccgacatgcccattattcgcagcttatgtaccgtctacattgaggtatggcgtggggtgcctttaattaccgtacttttcatggcttcggtaatgctgccactctttttatctcaaggcagtgagatagataagctactgcgtgccttgattggcgtggtgatgttcagtgccgcgtacatggcggaagtaatccgtggtggtttgcaagcgattcccaaaggccagtatgaggcagccgatgcgctcggtttaagttactggaaaaaaatggggctgattattctgccgcaagcgctgaaaatcaccattccatcgattgtaaatacctttattggtctgtttaaagacaccagtctggtgttgattatcggcatgtttgatgtgctcggcatcggacaatccgccaataccgacccgaattggctcggttttgctacagaaagttatgtttttgtcgcgttagtgttctggatcttctgctttggcatgtcgagatactcgatttggctcgaaggcaaactccataccggtcacaaacgataagtcactttgcaaggaacgtattatgacgcaacaactcaatcaagattttatgattcagattaaagacatgaataaatggtatggtgaatttcacgtcctgaagaacatcaacctgaatgtcaaaaaaggcgaacgtatcgtcatttgtggaccatccggctcaggaaaatcaaccatgatccgctgcattaaccgccttgaagagcatcaaaaagggcaaatcatcgtagcggggaatgagctcactgaagatttgaaaaacatcgagctagtacgccgtgaagttggcatgtgttttcaacacttcaacctcttccctcatctgacggtattggaaaattgcacgctcgcaccgatttgggttaagaaaatgcctaaagataaggcggaagaaattgccatgaaatatctcactcgggtgcgcattccagagcaagcggataaatatcccggtcaactctccggtggtcaacagcaacgcgtagccattgctcgctcactctgtatgaatccacaaattatgttatttgatgagccaacctctgccttagaccccgaaatggtgcgtgaagtgctggatgttatggttgaacttgccgaggaaggcatgaccatgttgtgtgtgacccacgaaatgggctttgcgaaagaagtcgcagaccgcgttattttcatggatgccggagaaatcattgaggaaaacaatccaaaagaattctttgaaaacccgcaatcggatcgtacacagaacttccttgctcagatcctgcatcactaatcgacggtactcacttcatcgtcattgattcagaagcgttaatcgcttctgaattcttttaaaatcatgcaaataaaaagacatcattcggtgaatgagatgaaatatcgtgttacaactgcacataaccttaaccaccgattttgattattattgagttagacagcacaaggggcttgaaatttatggcattgagcctcataactgtccctgtagcaatcagtacttttaatagaggaaaagtatgaatacgccaatgtttaccagaacttccagcttggaacgtactcttgaaaccaacaaggttttgaagaatacctacttcctgctttctatgacccttgtcaccagtgcgattgcagcaatggcgactatggctatcggcatttctcctatcgttgctttggtgatgcagttggctgccattggcattttgtttttcgtgatgccaaaagcgattaactcatcatcaggcctagtatggacgttcgtctttactggactgatgggaggagctcttggccctatgctgaatttctatgcggcgatgccaaatggcccaatcgttattgcgcaagcactcggcctgactggcatggtgtttttaggcctgtcggcttacaccattaccagcaagaaagatttctctttcatgcgtaatttcctgtttgctggcttgatcattgtgattgttgcggcattgattaacatctttgttggctcaacggtagctcatctggctatcagtagcgtttctgcactggtattttcgggtttcattctgtttgataccagccgtattgtgcgtggtgaagaaaccaactatatctcagcaacgatttctatgtacttgaatatcctgaacctgttcactagcttgttgagcattctgggtatcatgaacaataacgattaatcgcttagattgttttacggtaagcccgatgaattcatcgggcttttttatgcttgagccacaccttgagcttcgctaccctatgcgcaaattgacaaccacagacactcaccatgctggaataccaaggcaaaactatcgacactgacgcccaaggctatcttcttgactttacgcaatgggaagaagggatgatcgctcttttagcagagcaagaagggattgaactgacagatgcccacttagaagtggttcattttgtccgtcgtttctatgaggagtttaaaacctcccctgctattcgtatgttggtcaaagcgatggaaaaagagcacggcccagaaaaaggcaacagtaaatatctgtttaaactctttccgaaaggccccgccaaacaagcaacaaaactggctggcttaccaaaaccggcgaagtgcttataagatttaaaaactccatagcgaagtcatcgtattaggcttcgctttgacactcttccgacttaacactacagaatttcaaacccttgatagtcatgttctaactcactgcttaagcggcgcacttgccgaacgctggcggttttaggaccttcttgcaaccatagatacaactcttctaatctttcaggtgtgccacaagccacgacctctacatctccgttattgagattttttgcgtagcccgttaaacccaacttcagaccttgatgagacgtgtgatagcgaaaacccacgccttgcacatgacctgaaacgataaacttactgcactgtttttccatttttttcatcctgatttatgccattgttcagaccacagaatgctctcttccctgtggcataagaaagccagattcatcgatacgactttaatgaaactggttcaagcatagccgaaatccacgttatcccaaaaagagttgataaccccttaccttcgaatcataaggaaggggcttttcttttgcttttcttcatcagttccacgacaatagccgcccatttctatttccatctgagtagcgtaatgactcctgcaatttatttggtcaaaggtcgagacaaatctttgcgtcgtaaacatccgtgggttttttctcgtgggatcagcaaagtcgaagggactcctaaactgggagaaactgtcgatgtttactcctttgaaggcaaatggttagccaaagcggcctactcaccgcattcacaaattactgcgcgtgtctggagctttgaacaagagccgattgatcgcgatttcttcattaaacgcatcgaacaagcacaattattgcgcaacgatattatcgaacgtgatggcttaaccggttaccgtttaattgccgcagaatcagacggcttacctggcattactatcgacaaatatcaagattatttggtctgccaactactgagtgccggtgccgagtatcaaaaacagactctggtcgaggcattattacattgcttccctgagtgccatatttatgagcgttccgatgttgcggtgcgtaaaaaagaagggctggacgagcgcgttggggtactgcacggtgaattaccacctaaatcggtcgtgattgaagaaaatggcgttaagatcagcgtcgatattgtgggtggacacaaaacgggtttctatctagatcaacgcgacagccgcttccaatccatgaaatacgttaaagagaaagaagtgctgaactgcttctcttacacgggtggttttggtttatacgcactcaaaggcggagctaagcgtgtgatcaacgcagatgtctctcaaccagccttggatacggctaagttcaatgctgaattgaacggtttcgatatcagtaaaaagcgtgcggtgttcttgaatgccgatgtatttaaactgctgcgcgaataccgcgaccaaggcacacgttttgatgtggtggtgatggatccccccaagtttgccgaatctaaagcccagctggatggtgcatgccgcggctataaagacatcaacatgctggccatgcagatcttaaacccaggtggcaccctgctcacctactcgtgttcagggttaatggatcaagtgctatttcagaaaattattgccgatgcggctctcgatgctggacgtgatgtaaagtttgttgagcgttttgaacaagcggccgatcacccaaccgataccgcttatcctgaaggtttttatctcaaaggctttgcttgtaaggttttataagcgatggcgtgagcgaacgttagcaagcatagaaagcggtctcaatggaggccgctttttacttgccactcttcacttttcaccacgcggttacgcccgagtttcttcgccgtcaataatgcatgatccgccagcttcaaaacggtttcataactctccgcctgctgcgcatcggcaaagccaatactcactgtcacgtttaatcccggtgctactgcagacaaatcaacctgttcaatcttacaacgcagcttttcaaaataaccccaagcttgcttaggatctcctacatataagatggtgaactcttcaccgccccatctcgccactcgggttttgtcgccaacatacccaagtaactcttgtgataccgctacaatggcttggtcgccgataatgtgcgaataacgatcattaatctgcttgaagtgatcaatatccagcagcgcaatactgacttgctgatctggattttgcagacgagaaaaggcttgtttgaggtacatatcaaatgcgcggcgattggcaagcccagttaaatcatcttctttcgagagtctctcaaacttttccgcttgtaggcgcaatttttgggtttgcagcgcaacctgctcaacgagatacaactcacgccgtttcaaaatacgaattcgccacatcaccagtgacaccgccagcgccaaaaacagcatgccagccatgacaatcacctctttacgctgccaccaatgaggttcaatgataaatacgtaactaaacgtggcatcattccactcaccatacggataacgggcgctgacaaagaatcgatatttacccggcgctaaattggtgtattccgcttgggtattatgaccccgatatgaccaatctcgatcgaacccttcaagtttcgtgcgatattgcaaacgctctgacatcacaaaacctagccccacgtatccgaagctcacccgattggttccagccgcagcaatgtactgctgatcaggattgataatctcgctgtcaaaactgaccgattctagaacgaccggtaaacgcagttcactcagttgctggagacgctgtaccttgatgctcgccacccctttcgcagtggcaaaaagcagctcaccatttggcaaacttgcagacgcagggttggtccctccattcgcctgactggttgccatgccatcaccttcatcaaaatgttcgaattcaagctgtgtgctcatgccatcagcgaccgctaacatctgatcatagttgagcttccataccccacggttgctggatagccacacatgcccttcactatcacgtagcatttggaagaatttatcgattggtaagcctgcggcacgacccacaagggaaacgcttgcatcactcaagcgataacgcacgatgcctctgtctgtggccatccagacataatcggattccatgtagaagccaaacacatactgtgcttgctcttgcttagtaagatcaaccggacgaatcttgccttgagcatcaaaataagccacaccaacggcactaccaacccacagcttcccttccgaatccacagcgagtgccatgatgtaatcatcaggcaggggggagttgtctttgttgtatgtcgtcagcacaccttgcggcgttcttttgacaataccatttgaagtaccaatccaaagattatcttgtggatcggtgacgatggctctgacttcgctgcttggcaaaccgttattttcatctagcacaggacgcaactggccgttttgccaaaggagcaatcctttttgtaccgtcccaacccagactttttcaccttgctggtctgctttggccagactgagtatcgaaggacgagcaccgacttgaggcattaacgcgctatgtgccaagccctcttcaataatgcttaatccacgactggtaccgaccataactcgtcggtcatctagcggcaacaaggttcggacataatcgcccactaatcctttatcactgttgatattaatgaaaggcgcatcacgcagtcgcataatgccagcattggtccccacccatacactgccttcgatatcctgataccaagaaagcactcggctataaggcaaacctcgactaggctccaaaaattgcagttgctgatttttcaaacgtgcaatgccgcgattaaccgtgccaatccaccagttcccggcacgatcttgctccgccagcgtcaccacctctttctcaagcggtacaaacaacgattggaagccttcttcagtattgatccaaacaccttgatctgttgccacgacaagttcttgattcaaactgatggaaatatagttaattcgctcatagcgcccaatcggcagttccatggctgacgcttgccaatcattaaagcgatacaaccctttatcggtggccgcaaaaatcactccatgctgattttttactaaacgatacacactggcatcagtcagtaaccatcgatcaggcccatagaggttattacccaaataaggtcggactacgacgccgagaccttcaatcgcgagccacaagttttgtgcatcatcaatcaatgcaccattgactaaactgggcgcagaacgaaaagattgccagccataactctgtctgtgcgtgatactccctcgagcaccagccaccaacaacccattgttatccatgggtaataaggtgcgagttccggagtcaaccattccagtttgtggattgcgatcaaacacttgaaaattgatgccgttatatcgcaccacgccttcccaagtggcaaaccacaaataaccatcgcgtgtctgggcaatactattaatactgttgtgcggtaaaccatcagtggaagtccacgtctccacgaaatagtccgaaatatgttcgactacggcataagcagatgaactgatgatcagcaaaaacactgaacagatctgcactccgcagcaagctaaaagcctaattcctgtcattattctaatggtcctttatactggaagaccgcccctttagggtcttatacaccttgaacttgaagcggcagcggtattgacggcaaccccaagttgtttaggtataatgacttccagcattaagctggataatcttattattcgctgatcatctgggcgtgagccaagtgcaccatcaccaatgatgaaaagcggttttttattttgaagcctagctttcctttactcacttatcataaaaagtgattcaggttttagtgacattgcatgacgacaacgatatccattcaggtacttggctgtacccatcctttttattatccgccaaggtttcgttacttattctttcgtcgtcaatcgaagtggtggattatctaatttctgatcacactattcaccgtgtttttctcatttttgtcgcacacaattcattataaaaaataaactttattgtcgaactttgccaagatttcaaccgaaagagtgaacatgcgcatcctatactgaaacagtatgtcgatcctctaaaatatatccccaataacactctgtatttgtttgctcgataaggggctacactacggctagactcattccgagctagggttcgaaatcgtgtagagatataccaccttcataaggaaaacataatgattcaaatcggacaaaccttaccagatgttcaactgagccaaagaaccagtgagggtacactgactcactctgtaaccactttgtttgctaacaaaaaagtcgtactgtttgccgttccgggtgccttcaccccgacttgctcagaagcacatctacctggctatgtcgtcttagcagacaaattcaaagagaaaggcgtcgatatgatcgcttgcgtttcagttaacgatgcttttgtaatgaaagcgtggggcgaagcgcaaaatgcgagcgaaattgccatgctggctgatggcgatgcgagctttactaaagccttaggtctcgaaatggatacaggtaactttggtggcgtgcgctcgcaacgctacgccatggtgattgaaaataacgtagtcactctgctcaatgttgagccaccaaaaacctttgaactgagcaaagcagaaactgtgctagccagtttgtaattctagtcctcaaaaacccgacactgggtcttttgaccgcgtgtcgggttgatcgcctttcttaaacaactctcgttgcaaaccttgaacactattactttaaagctactggtttaaacgctcaccgcttaactgcggataactggctaatagcgcctttgcctgctcaaaatcaaaatcttcaattgcagaaattaaggcggcttgctgcgccgaatcccactgggaaacttggcgaatggacttactcaggcttaatgcggtgacatcataatcattgatcgcctgttgcaactgctgataccacaaaccccaatctaggttctccgccaatagcggctctttatgctgatgttcccacgcagagagttcatcatcgacttgggttagcaagctttgagcttgttgaagcagctcaaacgaaggtaggacttgctgctctagactctgctccatctctgccgccaactgagctaaagcttctaatcctaaattcgcggcagaacctttcagagtatgagccactcgggtcgcagagctccagtcttgcgcttcgattagccctgttacactgttcagctcatcaacttggctatcgataaagtgacgcagaatttcaaaatagcgttgttgattgcccccaatccggaagatagcttgttccaaatcaacgcccgtcagctgaggcagatccaacaaagcgttcatcgcaggttttgatgcgctgggtttatttggggaatgcgatgaaaagctctgctcatcactcacctgaagaaaatgcctgagtacctgataaaacttatccacttcaatcggtttggaaagatgatcattcatgcctgcttgcaagcagcgttcaatatctatcgccatcgcattagcggtcatagcaacgatgggtaagctatgccaccgcggattggctcgaatatgctcagtcgcggtgatcccatccatgaccggcatctgcatatccattagcaccagatcaaaatcggcatgctctaacctctctagcgcttcttgaccatgattggcgaccacgacattaaggccagtgtcttggagtaggccaagcgcaacttcttggttcacctcattatcttcgacgagcaacagactctggccggcaaaattcggcctgctgttgtgatgcgcttcgttcgttttatggcgtacatgctcaattccataactggtcacaatcgcatccagcagattcgagggattaaccggtttgacaattaaagcgtcaaccaacttgctgttttcgccatcaaggttaatctcacgtccataagccgtcactaaaaagctcttcatgtgcccacgaaggccgagggttttcactcgcgtcagtagctcaatgccattcataccaggcatgttccagtcaacaaacaacatatcaaagggtttctgttgaatttccgatagcgcctcaaacccattactcaccgtcacgacgttaaaacgcatagcggtcagtaaagagtcgagaatgtggcgagcagaatcattatcatccaccactaacactcgcttatccgctagaccatgcacaggttgggaaatatcacgcattttggcatcttgcagaccacacaccacagaaaactcaaaggtggaacctttaccttcttcactatgaacggtaatttgccctcccataagctcgaccaattgcttactgatgctcaatccaagcccagtgcccccatattgacgcgtaatgctgttatctgcctgcgagaaagcatcgaacaaatcgtccagcttgtcttgggcaatgccaatccctgtatctttgacggcaaaccgcagcgtgacttgctgttcattcaattggctcactcgtgcagacagtacaatttcgccttgtgaggtaaacttcaccgcattaccacacagattgaccatcacttgaccaagcctaagcggatcgccaatcaaccctagtgggatgtgcgggtcgatatccatcaaaaactcaatgcctttctcttgggctttcaatgagacgactgccgtcacattatccagcacatcatcaagattgaaatcgatccgttctacattgagtttacccgcctccattttggaaaagtcgagaatgtcattgataatgcccagtaagtttttggcggattcattaatacgagtcacgtatttgcgttgtgtcgtatcgagtggggtattcaatgccagatgtgccatacccaaaattgcattcattggggttcggatttcatggctcatattcgctaagaagtcacctttggcctgactcatcgcgtccgccgcctctttggctttgcggagttcatcttccatctctttgcgttcggtcatatccaacaaaataccgacgataccattgaccttgtccgcacgatcgctaaaagacgcctcgtaaaccagcatttcacgctgaacacccgtgtaatcgaccaaagaaacttcgtaattttggctactttgttgctgagtcaacacttggtgcgccgcagcaaagcgctctgcaacttcagcggggaaaatctcttgcggctctttatcaatcacttcgttattgtataaacccatgagatccaagaacttggcattgacagtgaggaatttaccatctgcactcaagcagtacatcgggttgggtgtagcatcgaggatctcttgattgagctgtgattgttcaagcacttttctttctgccaaacgttgctgctccgcattttggctaagttgaatcgcgacagagagatcgtcaagcatctgcgataaccaatggtattgctgcattgtcagcatgcctacagttcctaactccagtaacgctatcggctgattattgacctgtagaggtaggtaatacacctcattgagtgcaatcactcctgaggtagaaaccacttggaagttgccattgagtgacttcattgcataaggcttgcccgaacgaagcacactacaatgcgttgtcgttggatcactgtagtcacgttgtgcagactccgactgaccaacaccggcaatgcgtgtcagtacaccattttgatagagataaagacctatcagttcaacggggaaatggtgcagtaaaaactgtgtcacctgattgcacaaggcttccgtggtcggatggttgcgaatgatgatgttgaagtctttcaccaaggtattaaaactgagctgttcggaaatatggtgaaacaccacattcaaactatcgataaagcgttgcaattcgccatacgctttttgagtcagggtaaatttataatcttcactgcgaacttgtctcaccaccgttttcagtaaaatactcaatggcgcaatataaataacccaaagtagtatgaaagaagcgatgatgaccaacagtgataaactgactaaaactaaattaactcgttcataaaattgcgctttttcatcagccgctcgcacttcagattcaatacgatctacgatattggagtgcgccgatccaattgcagccatgattttggctttctcgagaaaatacttttcgctataaagcaaagaacgagcaaagttaagatctggctccccggtatagcggtattcccccgcaaactctctcttccaccccttcactgccatgaaggcttcacgctccaatgcgactagctgatccgataacgctaacgcattttgtaattcaaggaactcgaccgacccaataccagattgacgaatgcgttcaatcaatgtgggatagcgctgattagcgtttggtgtaagttcactcgaatcgttaagtacaactacatcccaaaactcgtaatcattattgcttggtgctggcagtttgccattacggacattcaaaacttggttaaacatacgcaaccatcgctcattgccagtgctagcatacgctcgggcaaacttagtcaagtggtctgagctttgttttaactcttgagatagacgataaaagtgaaaaagctgctcgctgtattgatggctctctagcctaagatctgcgacttgccgagtcactttaaacatggcaaccgccaatatcgccatcaagcaaaacagtagtacgaacatcgcttttatcgagcgcatgccatctccttctctacacaggattttgtataacctattttcaaagtttagctatagtttaagcaactcatgtcactttaatcttaaatgcctaaactttgtgatgaataggatgtttcacatgtcaatggaagaccttagccaatgcacgatactgatcgtcgatgactcgccagacaatatcgcctttatgtcgcaagggctggcacagtactatcgaatcaaggctgctcgctcaggaaaagtggcactcgagattttggcgcaataccctatcgatctggttttactcgatattgtcatgccagaaatgtcgggctatgaggtcattaatcaaatcaaacataacccgcataccgagcatattccggtgatttttcttacaggtaaaagtaatcccgaagatgagcaattaggctttgagcttggtgccgttgattatgtttttaaaccggtcagcattccgctgctgaaatcgcgcgttcacactcacttacaaaataagcgctctaaagacattttattgaatcaaaacgattatctggaaaccgaagtgctgcgacggtcaggagaattggatcgcatgcaagatgctgtggtgtttgcgctggccagtcttgcagaaacacgcgatccggagacaggtaatcacctactgcgtacccaacattacgtgaaagtattagcccagcgtctcgccaccacggacaaataccgagatgtactgagcccgaccgtgattgatacttattttaaagcggcaccgttgcacgacataggtaaagtcggcattcccgacaatattctgctcaaaccgggcaaattgaccccagatgagtttaccactatgcgcaatcacgccttgctgggtaagcttgctctcgaaaaagcggagaaactttccggagcctgtaccgcgctcatcaatgtcgcaaaagaaattgccatgggtcatcatgaaaagtgggacggttcaggttatccactaggactcaaaggcgacgatattcctctgagtgcccgcttgatggctctcgccgatgtgtatgacgctttgatttgccgccgcgtttataaagaaccgatgagtcatgaagaggccaaagcgatcattttacaaggccgaggttcacattttgaccctatggtgattgatgcctttttaatagaagagcagaacttcatcgacattgcacaaaagtttgccgatgaagaatctgcaatggtaccgattcaactgggtcaacaagcgtcaggctgattttctggagcagcctgcgcaaacgcaggcaaagcacgtaaccttgctgcgatctgctgtaaggtgggataacgactcatatcgagatcaaatcgctcagcgttataaacttgaggcactaaacagacatcgaccagagacaagcgattacccacacaatattcccctgccgtatggcgcaatttctcttccaaaccttgaaaacctttatcaatccagtggcgataccaccgatttttttcttcatcggccacaccaagctttgcggtaagatactgcaaaatccgcaagttattgatcggatggatatccgctgcgatgtctaacgctaacgctttcacctgataacgctcggcacctcgctctgggatcaaacggggggcgggataggtttcatccaaatactcaataatcgccagcgattgattcaagcagagctcaccatcgataagcacaggaatcaactcgctaggattgaggcgatgaaactcggcatgatgctgctcccctccctcacggctaagatgcacggcgcgtgactcgtaaaccaactgtttaatattgagggcaatacgcactcgataggcggctgacgaacgccaataaccatagagaattaaactcatcacacttccttgttgtactgcatcacctgttgctcaatcgcaccaaaaatactctgttgctgtggattgagcatctcaattcgcaccgtatcaccaaagcgcatgaaggctgttttaggctcaccatcacgcagcgtttctatcattcgcagctcagcaatgcatgaataccctacgccaccttcacggattgcactaccataatcggttccctgcttattggaaacggtgcccgaccctatgatcgagcccgcacacagtgctcgtgttttcgctgcatgagcgattaactctgggaatgaaaaagtcatatccacgccggcattgggacagccaaacagttcgtggttataggtggtacgtaatggcagggcaaggcgcgcgccatcccacgcctcaccaagctcatctggagtcaccgcgacaggtgaaaaagccgaagaaggtttggattgatagaaaccaaaccctttcgcaagctcattcgggatcaagccacgcagtgacacatcattgaccagcatcagtagccgaatggcctgctccgcttcttgcactgagcttcccatcgccacatcagcagttaccaccgccacttctgcttcaaaatcgatcccccacgcttcatccgccatcaggatcggactccgcggggctaaaaacgtatctgatcccccttgatacatcagaggatcggtccagaaactggcgggcatttctgcgccacgcgctttgcgcaccaattcaacatggttaacgtaagcggaaccatccgcccaatgataggctcgaggtaatggcgatagacagtgttcagcatcaaacaaacgcgcggtaatcgtgcgttcattaagtgcgaaatagacatcttgcagcgagtccaccaccgagtcccagttatccaacgcctgctgtaatgtactggcaatgtcaggtactgcaacacacagggttaaatctcggctcaccaccaccagttgaccatcacgcattccatttttcagagtcgctaatttcatatcgccctactccactttgctctgccaactgtaaacatactgacgattttccacctgctgcgctgcgtcactaaactgtagcgcatggcgggtatcaatcattactgccacttcatcagtgaattttttgcgatattccaagccggcttggaacgctttcggatgcggcccgtgagtaaaaccggctgggtggaaggtcaccatgcccgcttcaatattgtcacggctgaaaaaatcgccagcgtggtaaaacagcacttcatcataatcatcattgttgtgataaaacggcactttcagcgcgccgggatcactttcaatgggacgagggacaaaagtacacaccacaaaaccttggccgacaaaggtggtatgtgccgaaggcggaagatggtagcgatgcgacatcagcgggcgaatatcacgccagttgaggcgcacaacagagagatcgccatgccaacccaccgcatccaaaggattaaacgggaaggtgatggtgcttagctgcccatgacgttttacctgcacttgcgtctgctgctcagagtattgcgcgcggaattgatcattgatcgaaggcacgtccaacacggcaggatcaaacaccgcgtgattgccgactaagcctttttcgggtaacgcataagcggcatcggtgttttcaatcatcaaaataaacaagggctcaatcggctctagacgccagttggtcgagcgcgggatcagcgcatagtcgccctcactgacgaccatatggccatagtcacaatagagatccgctttaccttgatggataaacagcagctcatcaccatcggcattgcgcgccaacgctggcatagcttgctctagcttccacacccgcactttcacttcatggttgtgcagtaacaggggcacttgccaaggagacaaagcattcactccctccacatgattgaagttgaaggcgcgtggacgcagttcgccttcccactcgctccaacctgtcggtgcatgttgatgatgaaaatgcgctgcggggccaaaaaagccactgcgccccgcttcacgttcgtaaatcgcctgctctgggaaatccgcatgcgcctgccttgaacaagtgccttcacgatgcggaaaagtgatccatttatgcatcagtcaatactccacggcggatctgatcttcttcaatcgattcaaacagcgctttgaagttaccttcaccaaatccttgattacctttgcgctgaatgatttcaaagaacacaggcccaatcacagtttgagtgaagatttgcagcaaaatgccatctttcatcggtgcaccatcaatcaaaatacgtaagtcacgcagtgcttgcacatcttcttgatgtcccaccactcgctgattcaccttgtcgtaataggtgtccggcgtgggcataaagtccataccacgttcacgcaaggttttcacagtgtggtaaatatcctcggtactgagcgcgatatgctggataccctcgcctttgtactcacgaataaactcttcgatttgcgatttatcgtcagaggactcgttgatcggaatacggattttgccacagggcgcggtcatggctcggctcaccaaccccgtcagtttgccctcgatatcaaagtagcgaatttcacggaagttaccaatccgctcataaaaaccggcccacaggttcatgttgccacgtttcacgttgtgggtgaggtggtcaatttcatacaaccccacttgcgctttggcaaggcgctctttgctatcagggtagaaatgaaaatcgacatcatagatgctgcgatcgccataacgatccacaaaatagagcaagctatcgccaatcccgatcaccgccggaatgcttaactccataggtccaatctcagttttgtactcgacggcaccattggcctgcgcatgcttgagagcaatcgccgcgtctttcacgcgaaacgccataccgcataccgaagggccatgctgtttagcaaacgcttcagcttggctacgaggctgtgcgttgacaataaagttgatgtcaccctgacgatacagccaagcttctttagaacggtgtttagcaatttcggcaaagcccagagaggtgaagaggtgtttgaggctggcaatgccctgctcatcagcggcagtatattccacaaattcaaagccatctgtaccgagtgggtttacgctatccatcatcatcgtttccttggtgtgttgagttgaagtaaccatggctgaaatgatccataaagaaaatcccagacctgtaaatggtttaactcaccccaaaccaccaaaaggtaacaattttattacatttaacacatctaagatcaacgccacaaaaacccttgccttaatcctacaaaacttaaacacaacccattgaatattaatgggtggttaaaaatttatgtctaaatttcgtgaatttacactcatctgagaagagtaaagccaagcttacaatgtaacaatattgttactttcaattcatagcagacgtggctggagcctctctattgacaccactaagtcttgcaacgctctggcttctatttccctctgcttttcaggctttttttgatttaacgcatcatcagtcaagtcaattgcaggcatggtgacaacttctgttccctaagaggtattcctatgagtctgattaatacccaacgccttgttgaccacttcctgcaactgattcagatcgatagcgaatcgggcaatgaaaaaaagattgctgaaacgctcgcggagcaactaggcgaacttggtttcaccgtacataaactccctgttccggcggaggtgtcaaacggctttaacctgtatgcccgcctagaaggcacactcaatgacagtattctgtttagttgccacatggatacggttaaaccgggtatcggcattgagcctgtgattgaagatggcattatccgttccaaaggcaacacgattttgggtggcgacgacaaatctggcattgccgcgatccttgaagcggtacgtgttctgcgtgatagccagcaagcgcacaaaaccattgagattgctttcactgtgcatgaagaaggcggtctgaaaggttctgagcattttgatatgagtaaggtgcaagcagagaaagcgattgttctcgacacaggcggcccaatcggcactatcgtgcgtgcagcaccgggccagcaaaaaatcgtcgcactgatcaaaggtaaacccgctcatgctggtttggtaccggaagatgggatcagcgccattgcggtggccgctgatgcaattactcaaatgaaactgctgcgaattgacgaagaaaccacggctaacatcggtattgtgcagggcggtcaagcgacgaacattgtgatgcctgagctgaaaatcgtggcggaagcgcgttcactcaacgatgccaaactcgaagcgcaagttcagcacatgattgaaacttttgaacgtgccgcggaaaagcatggcgcaaccgttgagattgaatcgactcgcgcttacaacgcctttaagttggaagaagataacgcgcatatccaagcgatcaaagcgagctttgaaacaattggtattgagccgaaaaccaaactgagtggtggtggcagcgatgccaataatttcaatgcgaaagggttaactacggtaaacctctcaaccggtatggctaaagtgcatactactgaagagtacatcgcgattgcggatatggtgaaaattgccgaattcgtctgcgcttacactaccgcctaatcaagtacttgagtcatcaataaaaaccggaagcaaatggcttccggtttttatttaaactgattttaatatgtggaacttactatcggagcttttaagccgcggcgagccaataacacaaacagtaaaatcagcacgggatagcgcagagtttcacccactaacatatagaatgaactgtgattgaagggctcaatcaacaaggagattccctgatcggctaacagtaacagcgcgatcattagcaacaccccacgcaatgaaagcgttgaagagcttggtgttaagagggtcactagaccagagatcgtcaccaataacgcaagccattgcgtaaaaatgggttgcggccagatgatagcaaggatcacgcaagcgacggtcaatccccaccaaaccgacttagagcaaagtaggctctcgacattcacacccggttttaaatcgaggcgaataatgtgccaagcgaccaaggctcccactaaggcaccagtggcaagatcactgagaaaagcactacccgaataaaaagaagcaaatgagagccaagcaaacagaccgacccacacacgcatcacccaacgctgagtgaactcttgttgcacatgccacaccagcacacctaagcagctccaaagcgcgataggcaaattcgggaaggcaaagccgtagcttggaaacagctctaatgcaggttggtaaacatgtggtcttggtaacgcgaacccctgctgagcgacgaggcacagcaaggatgtgaccgacatagcaaacagaatcttgtaacaataaggtttgccaagctgccaatagagcaaaggaaacagaaccaaagcgaccacgggaagattaaaaatcatcccgcttaagatcaagttttgtaaccacggcatactcttttttagttgggcgacaccatgttgtaattgccctaaccactctaattccacctgctgaaattgaggagccgctttatggagctctgccacataatctaccgcttgctcttggcttaatttgaataaatcggcaataaaagaccactgttctggataacgatactgctcagccttgatgaaacttggattaaccaacatggcagaaacggtttctaccccataatccggcgcaaaccagatcggcagttcataccctccaaaaccattttggtaagagtaagcgatcacctgagattcactaacgcattcatagactaccgcggtcgatgtctggccaatcaagcgtccaacagaaaccaccatgccagtctcttgccatgtttcacgctgagccgccatttggggtgtttcacccgcttcaatcgtaccgccgggcaaggagagttttccggtgagcacttcttgggtcatcactaatttatgatcaccacggatcagacataaagcgccgcgataagctgcctcttcttcttggctagataacgccgaaaaagaaagccccatgcagaatgtgaaacccaacattaaccaaaatgcgcgaacatatgccaacaagattgtttcctttaaaaaaacgaactgacctaaaccagcggtttacgcaaccagtgaatatgctgaacgaaaccagcacactgataaaaatcttgggcagactggttaaagtcccagacttcaacaaacatctgttttaccccgtaatctttgaaaacccgctctaatttatgacatagctgactggcaatcccttgtccacgaaaggccggaagcacataaagctcatcgacacttcccattgcaaccgcctgactcacggttgaaaccagctcacaaaaatggcccgtaataaagcccaccacctgctcaccttgtttggcgacatacaccaaacactgcgggtcatccaaataacgggcaatactcttctcttgttcaatctcttccgcggtcttgaaatgttcagggcattgctgatggtgttcatcatgcagctcaaacatcaactggttgagttgttgtaaatctgcactgcttgccgaagagagtgagatattggccattttgtgatttttatcaatttatagtggggcgaaattgtatatgaagctcgaaaaaaaatcagctttcactgtggggattttgtgcaatcagattgttatctgtgtcacagagatgagataggccattaaaaagtgctccatgaggagcactttatgttttgttcactgcattttcagtgctgaaacaggttttccagctcattgaggctcatgggatcgtcaatcgtagatggaatggtgtaactctcaccatcggcgatttggcggatgatacgccgcaaaattttgccggatcgcgttttcggtaagcgttcgaccactatggcatgcttaaagcaagccaccgcaccaatttgattgcgcacactggcgaccagctcttgctccagcgtttgcgcatcaatcttcactccatctttgagcaccactaacccaagtggcaactgccctttcagctcgtcgtggacgccaatcaccgcacattccgcgacagccggatgcgcgccgacaatctcttccatctcgcctgtcgatagtcgatgccccgcaacgttgatcacatcatcgatgcgtcccatgatgaagagatacccgtcgtcatcaagataaccgccatcaccggatacataataaccggggaattgcgccaaatagcccgactcaaaacggtcatggttacgccatacggttggcaggcagcttggtggtagaggcctttttagtgcgacaaaaccttgctgattggcaggcatattttcgccaagctcattaagaatctccacctgataaccggggatgggtttggttgccgagcccgctttgatgggcatagattcaagacccgttgggtttccagcaatcgcccaacccgtttcggtttgccaccagtgatcaatcactggcttgcctgttttgctttgtacccattccaaggtcggcgggtcaagccgctctccggccataaaaatggtggttaacgccgacaaatcgtacttttttaaataatcgccattcggatcttcttttttgatggcacgaaacgcggtcggtgcagaaaaaagcgcggtgacttggtactcctgacacactcgccaaaacgcgccggggtcgggtgtgcgtaccggtttaccttcatacaaaatggtggtgcaaccatgaatgagcggcgcatacacaatataggagtgcccgactacccagcccacatccgaagccgcccaaaacactccatcttgcggcatgttgtagatgatctgcattgaatacttgagcgcaaccgcgtggccgccattatcgcgcaccacccctttcggtttgcctgtggtgcctgaggtgtaaaggatatacagcggatcggtagcgagcacaggcacacaaccgtgtggcgtggccgattgcacgaccgtgttccattccaaatcacgggcatgagtgagctcagcgcggcattcgctacgctgataaaccaagactttttcaggtttccagcggctatccataatggctttatcgaccatgggcttgtagggaatcaccttattgatttccacgccgcacgaggcggtcatgatcactttcggctccgcatcttcaatccgtaccgccagctcattcggtgcaaagccgccaaacaccaccgagtgaatcgcgcccaaacgcgcacaagccagcatcgccatcgccgcttctgggatcatcggcatgtaaatgatgacacgatcacctttgctcaccccttgcgcagccagcatgcctgcaattttcgcgacactgtcacgcagtgccgagtaactgtagcgctgctttttgcccgtcacgggcgagtcgtaaatcagcgcagtgtgatcgccacggccttgctcgcagtgataatcgagtgctaaccaacacgtattgagcacaccatcgggaaaccaacgttcgataccatgttcgtcattggccaaaatggtttgcggcggttgaaaccagtcgatctgctgcgcttgtttacgccagaaggcttcgggctgctctttcgcccattgatattgctcttgataggcagacatcgcattactccttgctctcactgagggcagcgtaatttgcgggaacgcgtacccatccttccattagaattctggcgctgcggctcatgatcgcgcgctcaatttgccagccttgtttaccttgcttggctttcgctccgacttttaacgtgccggagggatgaccaaaggtgactgacgtacgctcgccgcccccggcagccaaattgaccaacgtgcccggaacggcggcagcagaagcaatcgccacggcggccgtgcccatcatggcgtgatgcagtttgcccatcgagagcgcgcgcaccaacagatccacggaatccgcttctactcgcttaccgcttgaagctaagtaacttttcgcgccactgacaaaagcaatttttggcgtgtgctgacggttttgcgcttcttcaatgcgctcaatcagacccattttcagtgcgccataagcgcgtagcgtttcaaacttggccaaggcttgtggatcactgttgatggcctcttgcaactcagtgccttgatagccaagcgcttcggcatcgacaaaaatggttggaatgcccgagttgatgaaagtcgcatttaacgtgccgatacccggcacttgtaaatcatccatcacgttaccagttgggaacatagcgccgctgtcatccgcaggatccacaaaatcgacctgcacttcggcagccgcaaaggtcacgccatcgagttcaaattcaccgcactcctgcactgcgccattgactatcggcacatgcaccacaatggttttgctgatgttgacttgccacactttcaccgccaccacaccattgtgcggaatgcactcagcaggaatcagcccagcatggatcgcaaagggccccaccgcagcggaaaggttgccgcagtttccgctccaatcgacaaacggtttatctatcgccacttgcccgaacagataatccacatcgtgatcagtgcgcgaactggcactgacaatcaccgttttgctggtgctcgatgtcgcgccgcccatgccatcaatctgtttaccgtaaggatctgggctaccaatcactcgtaacaacagagcatcacgggccgcaccgggaagctgcgcttcaagcggcaaatcgttcagacggaaaaacacccctttgctggttccgccgcgcatgtaggtggctggaatacgaatttgtggcactgtctcgttcatgctgcctcctactgcgccaaaaagtcttgcgcaaagcgttgcaacacgccacccgcttgatatacgtgcacttcatcggccgtgtccaaacgacacgtcaccgccacatcgagcttctcaccgttttgtctggtaacgactagggctaaatctgcaccgggcctgatctcacccaccacatcaaacagctcagtgccatcgagcgctagcgagtggcgattgacgcccggcttaaactctagcggcagtacgcccatcccaaccaagttggtgcggtgaatgcgctcaaagccttcggcaacaatcgcttcaacgccggctaaacgcacgcctttggccgcccagtcgcgtgatgagccttgcccataatccgctcccgcgatcacaatcagcggttgtttgcggttcatgtaagtttcaatcgcttcccacatgcgcgtcactttgccttccggctcaatacgcgcgagagaaccttgcttgatttgcccgttttctttgaccatttcgttaaacagtttcgggttggcaaacgtcgcgcgctgcgcagtcaggtgatcgccacggtgggtggcgtaagagttaaaatcttcctccggcacacccattttagttaggtattcgcctgctgcgctgctcgccaaaatggcattggagggcgataaatgatccgtggtgatgttgtcacccaaaatcgccagtggtcgcatcgctttcagggtacgcggtgcagccaacgccccttcccaatacggtggacggcgaatatacgtgctcatcggccgccagtcatacagcggcgagctcgcgctttgtgtctcatcgagtttaaacatctggatatagatctgcttgaactgctccggcttgaccgcgcggccaacgacggcatcaatctcttcatcacttggccataagtgattgagataaatcggcttgccttgcgcatcgtgacccagcgcgtcacgctcaatatcaaagcgcatcgtgcctgctatcgcgtaagccacgaccagtggcggcgaagccaaaaacgcttgtttggcatacggatggatacggccatcaaagttgcggttgccagacagtaccgctgtagcgtagagatcgcgttcaataatttcttgttgaatagcgggatcgagcgcgccactcatgccgttacaggtggtacaggcatacgccacaatcccaaaaccaagctgttcgagttcagagagcagcccagcttcttgcaaatacaatttggcgactttcgagccgggcgcgaaagaggttttcacccaaggttgacgtttaaggccgagctgattagcttttttggcgagtagccctgccgcaaccacgttgcgcgggttactggtgttggtacaggaagtgatagcggcgatgatcaccgcgccatcaggcatcaagccctctgcttgttgtgcttctcgttgctgagcaggtatggcaatgccgcgcgcgctcagatctttggtcggcaaacggcgatgcggattggaaggccccgccaaattgcgctcaacactggagagatcaaactccagcacacgttcgtattccgcgtgctctaagctgtccgcccataaacctgcggctttggcgtagctttcgaccaaagcaacttgctctggctcgcggcctgtgagtttcaaatattgaatggtctgttcatcaatgtagaacatgccggcggtcgcaccgtattccggcgtcatattggaaatagtcgcgcgatcgccaatggtcagcgctttcgccccttcgccaaaaaattccagataggctgagaccacgcgctcgcggcgcagaaattcggttaaggccaacacaatatcggttgcggtaatgcccggttggcgcgctccggtcagtttcacaccgacaatatctggcaagcgcatcatggaaggccgaccgagcattacggtttccgcttcaaggccgcccacaccaattgccagcacaccgagtgcatcaacgtgcggcgtatggctatctgtgcctacgcaagaatcagggaaagccacgccctctttcacctgtatcaccggcgacattttttccagattgatctggtgcatgatgccgttaccggcagggatcacactgacgtttttgaacgcggttttgcaccactcgataaagtggaagcgatcttcgttgcgtctgtcttctactgcgcgatttttttcaaacgcatcaggatcgcagccagaatattccaccgccaacgagtgatcgacaatcaactgagtctctacgacaggattgacttgcgcggggtcgccgccttgttcggcaatcgcatcacgcaagcccgccaaatcaaccaacgcggtttggccgagaatatcgtggcacaccacgcgcgcgggataccaagggaaatcaagatcgcgtttacgctcgataatttgcagcagactttcgctcaattgctccggcgggcagcggcgcactaagttttcggccagaatacgtgccgtataaggcaaagtttggtatgcgcccggttttaacgcctcgaccgccgcgcgcgtatcaaaaaaatcgacctgagattgcgcagggcttggcgataaggctttacgatacagactgttcatgtttttgcttccattgcttaggaactaaaagatgctgctggccattcaaatggctctgaaccctccgctggagggttcgttgtacttgttcagtgttagccacgctgttcaatcggcagccaagtttgatgctcaggccctacataatcggcacttgggcgaataattcggttgttggcacgctgctcataaacatgcgccgcccagccagttaaacggctcatcacaaagattggcgtgaacaatttggttggaatgcccataaagtgataggccgaagcgtggaagaagtccgcattacagaacagatctttctcgcgcttcatcaccgcttccacacgctcagaaacagcgtagagatgagaatcccccaccgcttcagaaagcgccttcgaccactctttgattaaggcgttgcgtgggtcactctcgcgataaatcgcgtggccaaagcccatgattttctctttgctcgccagcatgcgcataatgcccgcttccgcttcatcggcactgtgccactgctcaatcatcgccatcgcggcttcattcgctccgccatgcaaaggcccgcgtagcgtaccaatcgcgcctgtcacacaagagtgaatatccgacaaggttgacgcacagactcttgccgcaaaggtagaagcattgaattcgtgctcagcgtacagagttaacgagcagtgcatcacttttttgaacagctcgctcggcgcttggccagtgagcattttgaggaaatagccgccaatcgaatcttcactttgatcggcggtatcaatccgcaccccttcatgactgaagcgataccagtaacaaataatcgcaggaaacagcgccaacatacgctcggtcgccgcttgttgctcagcgaaggtatgttcaggctcaaggttgccaagaatggagcagcccgtgcgcatcacatccatcggatgcgcttcagcagggatcaattccagtgcttgtttaagtttttcgggtaaaccgcgcaggccaatcaaacgagttttgtactgatccagctccgcttgtgttggcaaataccccaccaatagcaggtgcgcaacctcttcaaactgagcatgatgggccaaatcggtaatgtcgtaaccacggtaggttaacccggtccccgtttttcccacagtacacaaagcggtgcttcccgcgctttggccgcgcagccctgctccgcctaactcttttgcagcagacatgtcgaactccttttctggctctccttttggtgctagtgcaccgacctcttagtgtccaccttcaggtgttttaggagagcaatttcacgttattgggtttaatgttctcttactcgcgcagccacattggctgtcaaacctaagagaaggttgttttccttgggctcccctcgacttaagagggttgtgaaaacagctgatccagcttgtcttcgtattcgtggtaatgcaggtaggcgtaaagctctttgcgcgtttgcatttgatcgagcagcgcttcctgattcccgtgttccagcaagtggcgatacacattttccgcggctttattcatggcacggaaagcgctgagtgggtacagcaccatatccacattcactgccgccaattgctcaccgctgtaaaggggagtctgaccaaactcggtaatgttggccaaaatcggcacaggtttacctgtggcactacgcagtgccgttgagaactgttcgtactgtttcagctcggtcatggcttcggggaaaatcatgtctgcgccagcttcaacacaggcgatcgctcgttcaatcgcactgtccatgccttctaccgctaaggcatcggtgcgcgccatgatcacaaactcaggattgatgcgcgcatccactgcggctttgacgcgatccaccatctcttgctggctaacaatcgctttattcggacgatgaccacagcgtttttgcgccacctgatcttccatgtgcaccgccgcggctccggctttttccatcgctttgatggtgcgcgcaatgttaaatgcgccgccaaagccggtatcaatatccaccagcaaaggcaaatcgcaggcgttggtgatgcgttccacatctaccaacacgtcattgagtgtggtgatgcccaaatctggcaagccgtacgaggcattggcaatgccaccgccagagagataaatcgcttgatggccgatacttttcgccatcatcgcgcagtaagggttaatggtgccgacgatttgcagtggatgatgggttttcactgccagcctgaatttggcgccaggacttaaactcatgggattctccttaaccttgttgttgggcatccagcattatttgttgttcgatcaattggcgactgcgcgagatgtggcgacgcatcagcatttcggccaactcttcatctcgttggcgaatcgcacgcagaataaatttgtgttcttccaaagcttctaccggacgcgaatgcgaacgcggcgattggtaacgatacatgcgcagcaagtggtaaagctcatcacacagcaaaccaatcagttgttgattgcggcaggcctgaataattcggtagtggaaatcgaaatcaccctgctggtgaaagtaagaagcaccttcgacctgatcgatatgggtcgaatgtgtcgacaataagctttctaagcccgccagttcgatttcggtaatattgcgcgctgcaagccttgcagccatgccttccagagcttcgcgcactgcatacagctcaaccaatttggtgggtgacaattgaatcactcgcgcaccgatgtgcggaatacgctctatcaagccaagcccttcgactcgcattaacgcttcacgcagtgggccacggctgacttgaaactgtttggcgagctcaggttcagagattttactgcccggcgcgagctgaccttcaacaatggcttcaatcagatattcggttagattctctgatttggtgctctctttttcagtgctcgcttggcggactaacggactacttttcatcaatcgtgattctcatgttcgcacctaactgttcacaactcactctgtgttaaatgcgcatcgctatcttggtctgatgaaaaaatagcccataaaagtgtcgacaatcaagataattgtcgacactttagactaaggtataaagttgaatacgtggagaaagaaagagaaattgaagtaaaaacctttaaaaacaaatagtaaaacaaagtcctcttttttatttatcactgactggttgcgtatcacgattaatatctgtctacacaatacgcctttccatgccgtccacatcgccttaatcaggccgtaaactttatgaacataattcacttaatgcccaatattgcttttattgacggattaaagacatttatttaacagcttattaaccttggttacatgctcattatcaggagcagtggtaccccaaaccttggccacagaatcctcacgattgacgataatgactgacaagcgttaatcatgcctcttttcgtgaggtcgtggtgaaaaagagataccccaatgacttgaatcgtagccgacaccgctgccgctgcaggtcgaaaggggacaaaacaataagcatcaatgagctatatgatgcgccaacataaggaacgtgaaacatgctgaagttttttaaaccctccctcactgccgccatgctggccgctactttttctttctcctctctcgcggctgaccttgaaaaaatccactttatcgtacccggtggtgcaggtggcggctgggatatgacggcacgcgccaccggcgatgcgctaatgaaagcgaaattggtcgggaatgcttcttaccaaaacctctctggcggcggtggcggtaaagcgatcgcacacctgattgaaaccgccgatcgtcagcaagatacgctgatgattaactcgaccccgatcgtcattcgttcgctgtctggtgtttttcctcaatctttccgagatctcacgcccgttgccgaaatcgtctctgactatggtgctttcgtcgtggcgggtgattcgaaatacacctcttgggaacaagtggtcgcggatttcaaagccaatccgaaacaaatcaaaatcgcaggcggttcagcacgcggtagcatggatcacttagtcgctgcggcagcctttaaaggccaaggcttagatccaaaagaagtgcgttacgtcgcttatgatgcgggtggctccgccatgactgccctgctctctggcgaaactcaagtcctttcaaccggtctgggcgaagtgctggagatgtcgaaatccggtcaagtgcgcgttctggcgatcacctctccaaaacgtttggacatcgcacccgatattccaacccttgccgactatggcaacccaaccaccttcgttaactggcgtggctactttgccgcaccgggcgtgagcgcagaaaaagtcgcggagtggaacgaagtgttcaagaagatgtttgccagcgaagagtggaaagtgatccgtgaccgtaatggctggattgacagctacaaaggtgacaaagagttttacgctttccttgaagaacaagagaagcaaatgggcgacctgatgcgtgaactcggcttcttgaagtaattgcagcagaagcggagcaatccgcttctctcacactgtttgccgagtaaacgtaaacaccgtgactcctttgtttatgggtaaagtttgtttatggataaagttcctttgacttgcagtcatacccaaacaccttaatgctgcctgcatttttgctggcagtgtgacaggtttggttaatccccatttattaacttgtgtttactcggctcttttctcctctaccgttcacaaacccaatggagttggatatgtcggacctgccaaccaaaattttcaccaaagaaaacttactctgccgtgaccgagtgggagccatgttattcctgctgttcacccttggttacggctatcaaacctcactcatcaccatgtttccgggcgatgagttggaaccctttaacgcccgaaccttaccgaccattctgacttatgctggtatcggtttatcgctgctactgctcgtagtgggtcagccggataaaaaaagcggtgcggtgcttgagtttaactggaaactgctgatcggctttttggtactgatggcgctgtacggccttggcctgacttatctcggttttgtgctggccacttccttcttcttacttgctggtttttacctgctgggcgaacgacgtaaaagcatcctgtttggtgcttcattccccttcgtgctcgctttttatttgttactgaccaaaggactggatgtgtatctagagccgggtcatctgtttactttcggataggaaatcatcatgttagacggaattttacaagggctggcaacggcggtaatgccgaccaacctgatgatggtcatgatcggctgctttgtcggcaccttcatcggcatgctcccgggcttaggccccatttcagcgattgcgctgatgatcccgattacttacggattagaacccgcttctggcctgattttgatggcgggcgtttactacggcgcgatttttggtggctcaacctcatcgattttgatcaacgcaccgggttgttcttcaactgtcgtgaccgcatttgatggctacccaatggcgcaaaaaggccaagcgggtaaagctctggcattggcggcttacgcttccttcactggcggtacactctcagccattatgttgctgtttgccgcgcctgccctagccaaagtatcactcagcttccaatcctccgactatttcgcgctcatgctggttggcctttccgccgtggccgcctttgccggcaaaggccaagtcatcaaggcatggatgatgactgtactcggtttaatgctttccaccgtcggtattgataaaggcattggtgtcgaacgcttcaccttcggtctgaccgatttgatggatggctttagcttcctactcttagccatggcgacctttgcccttggcgaaaccttaatgggcattttaaaaccagatgcagacaacagtgccaacgagcaagagcagatgaaaaacatcggcagcatgaaactgactaaggaagaagtcaaagaagcggctccggtttcactgcgctcctcaatccttggtttcttcactggcgtactgcccggtgcaggcgcaaccattgcggctttcttggcttatggaatggaacgtaacctcgcccccaaagctaaaaaagaagagttcggtcaaggctcgcttcgtggcttagtggcgccagaatcggccaacaacgcggcatccagcggctcattcgtaccactattaacgctaggtattccgggttccggcaccacagccattatgttgggcgcattgatcgcttacggcattcaaccggggccacgtctgtttgttgatcatcccgatattttctggtcagtcatcatttcaatgtacgtgggtaacatcgtactgctgattctcaacttacctttgatcccgtacatctccaaactactggcagtaccacgcactgtactgttgccgatgattctgttcttctccatcaccggcgtgtatttggtgtcgttcaataccatggatgtgtatgtgatgattctggtcgcgatgggcgcaattgccctgcgtctagcgaacttcccactcgcccccctcctgctcggctttattttgggcggtttgatggaagagaacttacgccgtgcattgatcattacggatggcgaaatcagcttcctgtgggaacgcccaatcactttagcctttaccgtattggcgattgtgacactcctcagcccactgtttggccgcttgatggaacgtaaaaagcgtccaactggtgcgaaactgccgcactgattaaagtctattctttgcaagaagataagcacgccaccttgcggtggcgtttttctatatttcgcgacgatctgttcactactcttggaacaatcgacgttcccagccattgtttaaaatatctcaataatttccatcattagaaatcaatcattcgacccgcaaaaccacaattccgggttttgaacggatataatccataaaaggaagatcgacaactttattgtatttggataaggatgaagcgttacggtagagaatttgattattttctttaacgataatgccggtgtgagtgacatctaaccctatttttggagaataaaccccaactaagtcaccattttgcagattatcgaggacagattgagtaattttatcactcggaatataagtgatcattcgtggaataactcctaaaccttgaatatattccccgccttctactttttgatttaactgtttaggtatagtgatagcatcaggactcatcttttcagtaatatcgatagcaatctgtggtgataatgcataccaatcactgaagaagtgcttgcggtcataaaaatgaatatgggactttttatagcgaatattcatcagggaactgaaaaatgatggcgtatcggaagcttggcttaacgctacgacataatctaaataggtaaaacaatccatcccatcaaagttcactactagcgcgtatggcaggtcggaatgatgaactaatgtattcgcttgatagggagtatccataaataagcgagatgtatgaacgagtaagtcacccgatgctaaatatgcattcggctttatttcactttcgataatagcgtttactttctcaagagtacgctcgctaatactaatggcatattcatctgagtgatgtgttgaacaggcagcgagtaatattatcagcagagcgctaaaaggccgtttgagcatcgattttttatccttattattgtgactcataaatcatgtcatttattcataatggcaatgcaccctgcctacttgtactttgcacactctaccactgttctatcctttgtcgacattcagtttatgctgtaaaaaagccgcctaaattggcggctcgattagctatcatacccaaacggcttggagttgcaggcagcaagtgagttcatcccaatgagcatagataaacactgtgattggagtgaacaaacgtaaccaacaccgctgcagcttcaagtaggaaagggatatttttcaagctcgctttagtttgtaactgataaccctagcaagtcttttagaaaaatagattagtagttatagttcacaccaagaaatacttggctggctttagtaaagttaacattgtccaagccatcaaatttgttgctagccagatattgatacttataacctaactctaaattccaatgttcagtgaacataatgccagcaccaacagacgctgcgagcaaagctccagtattactttgatttttgtcagcacgacttaagcttcttactgagacatctaattcatcatgatatagaccaatctctgcacccgcttttacgtaaaacagatcattgaagttatgttgaatattctgccctacaccaaggatcgcgagttgacgctcgacgacaagcttattgtatgcatcaaatagtgtaatttccgtattaccataatctaaaaacacatagcgagtggtcaattgctgttcattcagttgctttgtcgcgccccaatgaatacctagcatggcgaatttttcatcgatatctttgagatctgaacttgtatctttgttgaaatcattaccaaaatcagagcttttgaaactaataccaaattggttgttggacatggtttcttgggttgtttccgcttgcacagaggacgcgaataaaatgctagtagcaagcaaagaaataactgttttcataaaaaataacctttaggtatttatagtaataacgaatgtcttttgcacaaaatcgattaaatttaactcattaattcacaataatcagattatgaaccttagagactatcgacattgagaaaagagtcggcattttactcataaacacaaaaaatgaaagtcaaataattcattcacttttggtaactaaattacacaacatcgtttactcatctctctatatcaaaaagttcttcagcattcagtctaacgctttcgaaaccatacattattttatatttagttgttttatattcagaacgtatcctcaccgtgttcatccaaaagtagtaattcaatcctccacatatacccaataaaaaggcctgataatcatcaggccttaaaaacagacaaatcgacaatctgcttacttcttattggcgtatttcattgaatccagcgctacagcgaagatgatgatcgagcctttaatgatgtactgccagtatgggctaacgccgatgtaggtcataccgtagttgattactgtgaagatcagtaccccggttacgaccccagcgatactccccaccccgccagcgaatgagacaccgcccaccacacacgccgcaatcgcatccaactcatataagaagcctaagttgttggtagcactaccaattcgtcccgcttcgagcataccgccaaacgcatagaacacaccggaaagcgcatacactttaagcagagtcaaaggcacgttaacacccgacactttcgccgcttctgggtttccaccaaccgcaaaaatgtttttgccgaacacggttttattccacagtacccacataaaaatgatcgcgataatggcgtagaaggtgatgtaggagaaccgaaaatccccaattcggataaagccttgagtgaaggtagtgaagcgttcatcaaaacccgcaatcggtgatgcaccgaccgagtcgtagtacagcgagttaatgccgtagacgatgatcatggtgcctaaggtcgcgataaacggcgttactttgaggtaagcgacgatcacaccgttgaccaaaccgataatcgcaccaatcaagcagacactaatgatgaccgcaagaatcggaatttcacccaagcttgggaatactttgttcacgttatccattgattgcaacaaagtagcggaaatcaccgcggcgagacccacttggcgaccagctgataagtcagtgccttgagtcacaatcaaacctgctacccccaacgcaataatcacgcgcaccgaggattgagtcaggatattactgaggttacgtaagcttagaaatgagggctcttgaatcacaataatcgccagcagaataaacagcactgcgtagattgcgccctcttttaaatgtttaattgcaaatgatttgacagcatccatagtcatttccttagaggtatcgagaggccagttctagaatttcgttctgagaagtttgtttggtattcacaatgcctgcattgcggccgttgctcatcaccatgatccggtcggtaattccgagcagttccggcatctcagaggaaataatgatgatgcctttgtctttcttggccagctctaaaatcagctgataaatttcgtactttgcgcccacatcaataccgcgtgtcggttcatccaacatcaaaatctcgggttgagtcagcagccagcgcccgatgatgactttttgctggttaccaccggaaagcgaaccgatatgagtttgatgcgacggggttttcacccgcatagaatcaatcacccattgcgtatcacttttcatcttcttgtcactgagtagaccgtaaggcgttttgtactcgtccacgttggcaactaacgagttaaaagtgatgtcgagattggagtaaatccccgtcgagcggcgctcttcggtcacgagtgcaaaaccgtttctgatcgcttcatgcgcatcgtgatttttcatttcacgaccatggagcagaatatgtccggcactgcgttcacgcacaccaaaaatggtctccacaatgtcggtacggcgcgaaccgacgagacccgccacgcccaaaatttccccagctcgtagttcaaacgaaatatcttgaatcgagggttgattgagtgcggtgagattcttcacctcaagaatgacattcttcggttcgttgcttttttcagggaaacgctgggtcagttcacggccaaccatcatcgaaatgatcttgtccatgtccaaccctttcaacggacgcgtatcgacccactggccatcacgcaaaatggtgatctcatcgcaaatagaaaagatctcttccattttgtgcgagatgtacaccaccccacagcctttttctttgagctttttgatgatggtaaaaagatggtttacctctttttcggtcagggatgaggtaggttcatccatgatcaccactttggcatcgtaggaaaacgctttggcgatctcgagcatctgcatctgtgaaaccgacaaggtcgcgactttgaccttcggatcgatatcaatatcgagttcggcaaaaatcgctttggtatcccgatacattttgtcgtgatcgacaaaaaatcctttggtgggataacggccaagccaaatattatccatcaccgagcactgttttacttggttcaactcttggtgaaccatagagacaccggattccagcgcctcttttgatgaggaaaagttcacatgctggccaagaaaaatgatatcgccttcatctttctcataaataccaaataagcatttcaacaaggtggatttgcctgcgccattttcacccatcaaggcatgaaccgaatgcggacgcacttttaaattcaccttatccagagctttcactccggggaactctttactcacccctgtcatttccaacaggaattcatgtgtttgattgaccatggcatcacttttattatgcaaaaattcagacaacacatatcaatgcgtggtacacacggcgtgatatctctgtgcggcaaatccgttgatctgtcgctgaatctttcgatgttgcaaaaatatatccaaattacttagcgttgcagcttcaacataagaagggattgtgaagaggggatgtttccttcccctcttctcgccaaggttattcgacgttattgatgtcaacgcctacgtaaggtacgcgaacgaccttattctcaatagtccactgagtgccttcggcagcaggtttgccattggctagattacgcgccaattcaaaggtcgctttagcttggttttgcgcatcattcagcaccgtacccgccatgtcgccggacttaatgagtgccaaggcttctgccagagcatcgacaccaaatactgggattttttggccagcaccgcgcagagcttcaatcgcgcccatcgccataccgtcgttgttggcaatcacgacttcgatcttgctgccgttaggaccagagagccacgcgtccatcttgtctttggccatcgcggtatcccacatgccggtatccatgtgcagttcttgagttttgatgccgttgtcgttgatggtttgcacggagtaagtggtacgcgcttccgcatctgggtggcctggttcgcctttcagcataacgtattgcagtacaccatcgccgtttttatcccacgctgggttagctttccactgcgcagaaatcaaatcgccttgaatgatgccagactctttagagtcagttccgacataaaacgctttgtcataactggccatcgcttcagcggacggttctttgttgtaaaacaccacaggaacgtcgtcgattttagctttctggatgatggtgggtgcagccgccgggtcaacaaggttgatcgcgagcgcttgtacgccacgcgccaacatcacatcgacttggtcattttgcatcgactggctattttgcgagtcattcatgaggatacgcgtgttgctatccgccgcagcttctttttcaatcgcttggcgaacaaccgacataaagttgtcatcgtatttgtagatggtaaagccaatggtggtatctgccagagcttgtgtaccaaaacccataccagcagaaagcattgctaaaacagttaactttctcattgaacaagtcctatttgttgttttgtattacgtgtgtagggaacaacgcttactcgacctttttgtacaaaaatccacttgcacagtcagtgaaaacgtttactcagaagtatagttttaaaaaacacaattaatgtgaaccagttaaaaaattgttcttcaaactgccaaactgtaaccatttgtttaaatagtttgaactcaataacaatttagtccttatatgatgacaatatccgtgctcactcagtggcataatgtcatatctaaaaaaacaatgagtgataacgtttacaccaagctaatggtggtgataagaattgagctgcttatgaagtgatagaagtatagatggtgttttaacaagatgacgaaaaatacccattcattcgctactcacgctccacagagacgacagataagtttgctgatttcattattggcatatgccaataatgggcgcaagatagcgacgtaatcttatttaggagaactaaaatgattctagccgttcctagccgccacggtgtgccgtttaaccattttgccaaagcgccctcattttccgttatcgattccaatacacagcagttacaaacggaattccatcttgaacttgacccatcaaagtcctgtggcaaaaagtcagcgattctgcatcagctccgccactatcaaatcgaaggagttgcggttagccaaatcggacaatccatgctgcaagccttgtttaacgcagggatccgcgtctatgctttacctaggggagttgctttaaccgatctggtattaacacagttacagccaatcacggatttaagttatggcaaagcctcaccaaataaagtccatggtgaacgaggatgtggtaaacacagtagcaatccttcaggctcgcgtaacacattcgtttcgccatcgacacacctgtttcagcgtgggttttccatcaaacggttatggaaaggagaagagagatgacgtatctactggctttcggtgcctttgtgctctttgcggttttaatgacgttaggggtgatggctaagcgcaaaccgattcagggcagttgcggtgggctggctaacgtagggattgataaagagtgtaattgtgaaaccacttgcgatactcatcagcgcaagctttaccaaatttccgaacccaaaaaataagccccctctgcagcttcaagcaggcaagacataaacgattaggcaggaaatctcctgccttaatcttattgtgcttatatttattgtgtgcttgaggggttcatcgtaggtcggcactcttgctcattcggagccagataaggcgataaaatcggtgccatacctttcaatacctgcaccggcagtgccgaggtaaaggtaaatttctctgaatcacttcccgcgacgtacgcggttagtgttccaaagtgacgatcgcccaaatagaaaacaaaggtggcagttcggttacgcgctagagattgcacaacagtaccagcgcggttgaccgtttgtaagcggttatcgcccgttccggttttaccacccaatactatcggcgtaccatccggcagtttaaacacaccagagatccgtctggctgtaccactgtccaccacctgagataacgccccgcgcaacgctcttgcgacttcgacaggcaagacacgcacgccttgagtttcaacaggcgtgaactcggtttcaaacggagtatcttgcgcaaaatgcagatggttaatccgtttcgtcggcacacgtacaccatcgtttaaaataatacccattaattcagacaaggcggcaggcctatcacccgagctacccagtgcagtagcaagagaaggcacaaggtgatcaaacgggtaacctaagcgttgccagctttggtgaatatccgtaaaggcttccacttccaacatggtgcgcactcggctgtcacgggcattacggtgacgagttttaaacaaccagctgtacacttcttggcgtttatcactgctggccgcaacaacatcgctaaaagatgcctgatggtgttcattgagataccccaatagccacagttcaagcggatgtacccgagcgatataaccttgatccggcagtgaatatttaccacgtccatacttgttatacagtttctcaagctgtttatcagtaagcttatcgcgcgtaataggcggtaatttatcatccataaagcgcacaaactcgctaacggatgcctctggcaataggtaacgatgtaccgctgctaagcggtcggcactcggttttaaaccttcgagcagcgtcgccatacgctcgtctgtcgttttatctttgtatttacgccagaagcgaagtagatatgctctaccctctttatccgcaaactgacgcaagtattccatgcggcgcggatctttatcatccttcatcaattgagctcgatacccttcactgtatagggtgtagcgctcaatatctttcattagtcgcacgaaaggcaggttgatcgactcacgcaatgcatcacgcatcgtcacgatacgttcatcatcttctttacggaagttattgaaggtatggatacctccaccggtaaaaaagcgctctttcggatctgcggaatattctcgttccaatgccgcttctaacatagtcgccaaatcgcgttttggactcgtcagtaaccattccaatgaccagacgctcaaagtatcttgtgcctctaccagatggcggcgaagttccattaccgacaagtcatgatatttactgtgcagtttggcgataatctcaagataagtcgttaatacacgcagcttagcggtagagcccaactccaacttacttccttcattgaggtcgaacggttgattggtgttgtcggtttgcacacgcactttgaaaccttcatccgttcgttcaaacagtgtgaagctgtaacgcacatccgccgttttttctgccgccagtaaacggaaaccaagaatgcccacttgcgctgcgtactcaggattcgccaatttctgcaaataacgagtaacttcactttgtaattcaaagttcagcgtggttgaggcgctaagatccattcggtcaagatcatacaaactcaccccaagctgacggcttaaatgggtacgtgccgccagtaaacctttattggtattaattcgagtcaccgcaggttgacgcacaaaatcacggaactgcaatgttgcgttcagtgccgcatccattaatgattttgaaatcatcttttcacggtagaaaagtcgtatgtgactgtcggttaaggcatttaaatcaggacgacccgatacggctaggtagtatgacgggcgacgatgagcaatcatcagcgcaacaacctgacgcaatgccaaaccttgttcggcgagattaacagactgattgagtcgagtatccagcagttgattgacacgctctggatccgctgcaaaccatacccacaaaccatcacctaaaccatgcacttcaccataaccgggcgcagccgacagcggcactgagttcaaataagcccacaccaccaacttacgcgcctctagggtattggccccaagtcgataagcacgtacactcgccgaaaccatttggcggattttctcttgtgggctgtaagtcaacccatcttctgagtgacggtatttctcaacttgagtcgccagcgtacttccgcccgccgattgcccatccaaatcgagcgctttaccgacctgagtcaaagccgctttaaaaaagcgtggccaatctacagcagggttcaccagcggatttttatcgctcaacaaatcgcggttttcgatgaacaatagcgactgcacaatcagatcagggatcgcgttaaagtctgcatagtggttgccgggataacggaattgataaacgggttcagtacggcaatcaaataaggtaagtccagcttgcactttttccgtgtaaggcacatacagtccatattgcgcataacgctgaagctcatcggaaaaacgcacttgctggcgaattgtaaaaccacgctgcaatagacgctcttgaatattcggtagcgccacataacctaaacgctggtcgaaaggcccgtaactcgggaacgcgattttgtcactagctcccggctcaacttgataggtcaacccagccgcataacgactgatttcacgcgattgcagtgttgaggtttccatttcatggaacagagcggcaccacctgctgtaccaataagcagtaccgcaattagccagtatcgaggtttgtttttttgtgcgcgtcgacgcttttttaacacgcggcgaggaattgagtcagaagccacttagttgaatccgtttaatcactgagagtgtagccataaagcaacaagaagaactcatcgataaccgatgataatagtgtagaagtgtagagaagttactgagtttagcgaacagcattttcttatctggttaaaatcgtacctgatgtatttttcgaacactatgcatggcgcacatcattgcataatgccgatcgtgtgaacagtacctatgaaaagaaaaaatactcgtcgtgccacatatacagaactctattttgataaacattccgttttctgacagaaacaaacagaaatattcgttttactgatgatattttcagttagtattggacgtttgttccttgatggataaaccgtaaatacgaggtccccatgtctaaccaacccagtctctacattatcgaagacgacactaaacttcgcgaaatgttggccgagtacatgaccaatcaaggtttccaagtaaccacttttgcgactggcgaaaccgctcccgaacaaattctgcttaatcaacctgatctggttctgctcgatcttatgctacctggcgaaaatggcctgacaatttgtagacagatccgtgcacaatttctcggtaagattctcatgcttaccgccagtgatgatgattttgaccatgttgcggctcttgaaatgggcgccgatgacttcgtcaacaagccaataaaacccagagtgcttttggcgcggatccgcatgctgatgcgccgagaagagcgaacctccgccagtgccgatgctacccatttattgcaatttggcggtcttttacttaaccaaagccgacgccactgcgaattggatggagaagtgatcaacttatcggatagtgaattcgatctgctgtggctcttagcttcagcggcggatcaagttgtatcacgcgagtttttgaccaaatcacttcgggggattgagtatgatgggctagatcggacagtcgacaacaaaattgtcactttacgtaaaaagctatgtgatgactctagcacgccgaaacggatcattacggtacgcggtaagggatatttatttgtgcctgacacttggtaaacctaagttgatttaaaggaaacctatgcgccgcatttacatcgagtcacttgtctcactgatcgtgctgttttttggcagcttggtcagctatagctttattgtctatgaattagataccgactatgactacgtactggaagattatcaggcagaagccttacagactttattaagtcaaattcgtcagttagacagtccagaatcggcgaaaaccgcactgcgtggctatgccgaacatatccacaaaactgtcgacttactaccactcaccgaattaccaccagaagtacaacagcacttttcgagtgaggcagcgcattctcctattttccacgatgatgaccgtaatttatggcttcagttggactccaacgagcaaatttatctcctcaaacccgacagccactctcctgtctatcaagccatagatcgcgccgataacctattgtttgtctttatgttaggtggatttgctctctattgtatgttcttaatttggtttttgagtcgccggctacgtgagttggagcgggtcactcacgatttcgcaaatggtaatttgcaagcgcgagcgagtactaaaagcagtaaaagcgtgggtaagctcaaccatagctttaacatgatggccgataaaatctctcacctgatcctcagtaacaaagcgctcaccaacgccatcgcacatgatttacgcaccccgatcttccgtatccagtggcaagctgaagtgttagccgaaagccagttgaatgcaaaacagcaacagcaagttgcgagcattattgaggacacggaggaaatggaaaccatggtggatgaactgctgtattacgccaaactagaacatccagaaagcgacatccagagtcagtatttagaagttaatcagtggcttgccgactttattgacgagcaaagccataaaagcagtttacaaatacaatacctcccttctctgcaacccttaatgctggatgccgaccctcaattgctcacaagggcattggttaacctcatccgtaatgcagaaaagtacgcaggtgatcgtctactgattgaagcgagtaccgtcgacgctaagctctgcatcgccatacacgacaatggaccggggattgaagagcaacattggccgcatatcttcgatgccttttacagcactgactcgtcacgcaacaaagcgcagtcagggtttgggcttggtcttgccatcgttaagcagatcatggcgcgtcaccaaggtgaagtcacgctgaccaagagtccattgggcggagcttgtttctcgctatggctacctctataccccaacaaactggagttgccagtaaacaagcagtgagttgatccccatgagcatcaatagacaatgcgattggggtaaaccctcgcgacccgcacatgatttcagcttcaattagaaaagataagtagacagggataagccgctctgacaaaagtcagacatagccatacaaactattgatattgtcctcgctagcgattttgtacagtgttcacatccaaacataagctcttaattggaaggacataatgaaaaagatcgcactatttatcacagcatcacttatcgcaggcaacgctctagctgcccaaacttacattcgtaacggcaatatctatacccacgaaggtcaatgggctgcggaagtgggtgcttttggcagtactgacctactcaaggatcaagacaaatcttacggtgctttactgaactttggttaccacggtgaagatttcaacgctgatctttcaggcctcaactaccgcttcttaggcaacacaggcgatatcgtgaatctaggcacttatctgactggcagcggcgttgcttatgaccaagattcagcaaacagtgtcaaaggcatggacaagcgcaaagccacggttgacctaggtttaaacgccgatatcgcgctgggtgacggtacggtatcaacctacttccaacacgatattcttaatgagaacaaaggctacaaaacgggcgttaactacttccatatcatcgatttgggtgtcgctgacttagtaccttttgctggtatcagttaccagagttcggattacaacaactactatttcggtgtaaaagacaaagaagcaaccgcgcagcgtaaagcctaccatgcgggtggcgacttctcttacaacctaggttacaaattggtttacccaattaatgaccgttgggaaatcacccaaaccagtgcttacactcgtttaggctctgatatcgctcattcacccatcgtcgacagcgcaaaccagtggctcgttggtgcaaccgtcgcttaccacttctagtcggctagcacttctgaacgataccgccttcagacaggagctcctcctgtctgatttttctgcttgaactgccctgcgctaccgaaatggctttgatatgaacccacgcattgattatttaaaaagcttatccactctcgctgctgaaatttatcccgatattcgcggggtcaagaagcttcgctataacgctcgtttctgtctgtgggggatcttgatgccggataccttggctcgtatccaagatttactgaatcagccctcttttcatccggttcgccaacactatccacgcaccttggaaaaaccgttgaaaccttatgtctgtgtgaaatggccaccccaagagcgcgcacaacggctgattgaacattttgcatttctggaaaagcgccatgctcaactgcttccgctcatttatcgtcatcaaggctggtcgctgtttcaacacgagttgttttcgattcagctctgccacggcccagagcgcgaaggttcacttgctctggtcttgctcagtcaagatcaccaacccctgttcacgctcgcgttcaatatcagtggtcgtaacaagcctgtgattcatattggcgcgttgcaaggcccgggacccaacgttgaaaatcgccaagagatcatccgtcaattaacccatcagttgcatggattgcgtcctaaggcgctgattatggaagtcctgctgattttggcacgctactggtgtgtagagaaagtttatggtgtgactaatgaggggcatgtttatcaagcgctgcgttacatcggctcaaaacgcagttcggtacgctttcagtattccgagttatggcaagaaatgggcggtgaagcgattaacccttattggcattcgctcccaacgcatccaccgcgtaaagcccctctcagcttgtcgaaaactaagcgccgactctataccaaacgttatgcttggctgaccgagcttgaacagtcgattcaagctaatttgcagccttgggataacgagattcaccactaagctcacctaacatcgcctttcccgacttcaaccacgcagtcgggaaagcacaatggtattatccaactcgctttgccattcggtgtaatctaaacgctgatcaaacacatagtgagtcactaaactgcggacacaatccaccaagattttagcgctccacggtttgtcaaagtagtgatgaatcccagccgtgttgatggcattaatggtgtcggtgtgggtagcttgcccagtgagtaaaacctttttagtgtgtatgaagcgagggtcagcgctgatttcactgagcaactcgacgccacttttgcccggcatcacgtgatcagaaatcacgaccgccacccattccccttgggcatcaaggtcatccatcagctccaaagcttcgtctgccgattcgcagtcttcaatattgatccagcggctcaagggctctaaatcctgtaacaccgcactcagtacttcgcgttgatcatccacgcaaatgatgttcagtttctccatggtatccctcaactggtaatttaatcctaaaaatggttttgtcctgatcgcttttcaccgcaacggttccgccatagccagagacaatacgtttgacaatcgccagccccagcccaagcccaaacgagagcccctctttcttggtggtaaaactgggttggaaaatcttacgccgcgtggcctcatctatttctggtccattattggcgaccgtcacgtatagacgctggcgagaacagcgggtttgaatatcaatcgtaggttccgtggtttgcgccatcgcatcacaggcgtttttaattaaattgatccacacctgtacccactcggtttgcgagcctttgatgatgggtaaacttcccggacgcatccgcacggacacacgacgtaagtcactttgtaacagggccaaagcgcgattgatggtgctgttcaaatccacttcttcatccaagcgaatatccgctcgaccaagctgcttaaccgatttgactatcccaaccgaatgttttgcggccaatcgcaagtcatgcaaatctcgccccatctgccaataacgaatcgctaaatgcggatttttcagccagtgagcggaaagctcattagcgggaaccgcgcgggctaactcgcgggcgatatctttgggtagctgatactgcttttcaaacacagcaccgcgttcacgcgcttcactggacgacactttctgcccaaacagcaaaccaaaatcgaaaaactgactcgcttctggatgcacttcttccagtaactccataaacaaggcttctaggcgttctgttttactgctgaccaccccaatcgcattgttgagctcatgagcaatgcccgccgcgagctggcccagcgtcgtcatctgctcagcagaatatagccgctctaaagcacgttctttggcaaccgcttcttgagtggctcttcgctgccgctgagataactcagccacaatcacaggcatgaattgagtgctgagtgaaccatactgctccacatcctgcactggtgtatcacgatcaatccacgctaactcgacctcactatcggcaatcacagtggatgacgccgtccacaagccagagaaaaaactgtgtaccccaataaatgcgccggaagcggcagaaaaaactttaatgcgccgctcacctttttccgcaaaatagccagaaacgtggccacttcgtaaatagtaaagccgatcgttataaccattttgggcaagcaaaattgacccagccggtaaggtaatacagcgatcggcatggttgaaatagcgctcaataacggccgctaagttggacataacgtttccttaatggccgaccatgttgaggatccacaccatcacaaagctcatcagtaccccaaaaatccccaagataatgcccacttttgccatttgttggctctgtacattccttgttgcatgagccagcgcattcggtggcgtactgatcggcaatgacatccctaaagacgccgcaaaagtgaccaccagaatcagcgtcacctcaccgcccaaaggattgagtggcgtcatggatgccccaagcgcggccatgataggcatcagcaagttagcagtcgcggtgtgtgacataaaattcgccatcagcaaacagaggatagccgcaccgagaatcacgacatagggcgaatattggtcaaacggaatactgtgaacaaccagttctgccagaccggttttatctaaggctaaacctaaagcaataccaccagaaactaaccacaacacatcccaagagatcatttttaaatcttctttgccaataatgccggtcaccgaaaagaccgcgacagggattaaggcgactgaataggagttcataccgtgcagtgaaccgagcatccacaataaaatggtcgacgcaaatgtgatgtaaacaatgatggctttgggcgtttttaaaaacttacctttgatggttaattcaatggttttctgctccgcgcgatacataaactcaatcagcagccaagcgagcgccattaaaatcaccacgaacgggatcccaaatgccatccattcggcaaacgtaattaagttatcgcccaccaaatatttcaacgcgattgcattgggtggcgtccctatgggagtaccaatacctccaatattagcggccaccggaatacagagcgcaaacgccacacgccccggatctttagggccaaaaacagcaatcactggcgttaaaatagagagcatcatggccgtagtagctgtgttcgacataaacatcgagaacactgcggtgatcatcattaaacccaacatcacgtacttcggattattgccaaatggtttgagcagtacgcgggctaagttgacatccagccggtatttggttgcggccatcgcgaggaaaaaaccgcctaaaaacagcatgataatagggttggcaaaggttgccatgatttcagttgatttcagcaaagcaccaaattcgcttgtcccctcacccaaccgaaacaaaatgaagcctttatcggaaagcatcagcacttcgagcacaatgatcaccaccgacgtggaatagataggaatcggttcaaatacccacaagagcgccgctaataggaaaatcgcgatgaccctttgttgtatgacagtcagcccttcgaaagggaatgcggtggcaggaagcatcaagaccaacatggggatcagcaacggaataatatatttaagataagggcgcatcatattcactcttcctgagaatcgattatgtgtttggcgaggagctggcacgctatcaccgcggcaatcgtcattattgatgcttaaaaaagaaatgtttggtgttagatcaatgattaaagtttcttaacaggggaatacacaaaagtgagtcacagttaacaaatcgttcactgaaaatggctcttaaggcagaaataataaaaacataaataaatttatctgcgctttctgtggcatttgctaactttatttataagagtcgtcaattgacaattgaaatgatagtatgcgccgactttgggacatacgtaactttgtcgcagataaggatgttgttattcacgcgactttgagtgacatcaatctaaaggtaaaacattcatgtttctaaaaaacttgtcgataggcaaaaaaattgcagcctcgttttcggttattgcagtaattagcctaggattcgccatctacctgatttcagagctagataaaatccaatctgaattactcaactacaccgatgacaccttaccggcaatggaaaatgtcgatgcgataaaagacaagatgtcttactggcggcgtacccagtttgcggtactgccaatgaaagatgaagcgcaaattcgccaaactatcgagcgtaataatcgcgttcaagcagaaatcaacgattctctggtggcttacggtaaaaccgtatggccgggcgaagaagagcaaaccttcaaacgtctcatgggaaattggaatgcttacacggcggtcaccgatcaatttaaccagacgcttttgacccaaggtgccgatgacgcttaccccattttggccaactcactcagtactttcgaagcgttagagagcgatttcacgctcctgatcggcattttgcatcaagccatggacagcaacaaagtgcaaatcttaagttcagtgaagacgctcaactccacctcagtggccagcaatatcgctattttagccatcatggtgctcatgacttggctgttaactcgcctaatctgcggtccgttggcgattgtgatgaagcagtcgaatgcgattgccaaaggcgatctgtcgcagacgatggatcgctcctctattggtaacgacgaattgggaaccttggccaatgcgtctgagcagatgcagcaaaacctccgtcaactgattgatgaaatcatttcagcggtgactcagcttagtagcgcagtagaagagatgacgcagatctctaaccaatctgcagatggtatgaaagagcagcagtaccaaatcactcaagtagcaacagcaatggcgcaaatgaaagcggcagtggcggacgtagctcgtaacaccgaagactccgctagccaagcgatggcagccaatcacaagtcacaagaaggggctcgtgaaaatgcttctatggttcgctcgatccaacaagtggccgatattatcggagaggcgggtcaaactgtgagtgaacttgagcagcaatctagccagatcaacgttgtggttgatgtgatccgcagtattgccgaccaaaccaacctcctcgcgctcaacgcggctatcgaagcggcacgtgccggtgaatcaggtcgcggctttgcggtggttgcggatgaagttcggactctggcgggtcgtacccaagattcaaccggtgaaatcaccacgattattgaaaaactgcaagtcatggccaaacaagccaaagatgcgactgaacgttctcgctcgagtatcgataagtgtgtggaacaaggtaaccactctcagtctttgatgatctctatcgaagagtcgattgccaatatcgccgatgtgggtacacaaatcgccagcgcatgtagtgaacaagattcggtcgcggatgaactcagccgcaatgtggaaaacattcacttggcgtcacaagaagtcgcgcagggttcacaacagacagcccaagcttgtcgtgaactgactcagctcgcggtttcgctacaagatacactacgccgatttaagattcgttaattttcacgctacctacagggcggcgtctttctctattcttcttgcgacttggagcagccgcttctcagtcgcaagaagaatgttccatcaatgataaccacaggagatatcatgcattttaaagccacgctgctttctctctctatcgcggcgactttgccttctttctctctctctgctgcgccattacacatcgacaccgctttaccggatgccgctcaaattcagcaaagtaattcttggctggagattagcttaggccaattccaaagcaacattgaacaattcaaatcacacatgaacgccaacaccaaaatttgcgccatcatgaaagccgacgcttacggtaacggtattcgtggtttaatgccgaccattatcgcgcaaggcattccttgtgtgggggtggcaagtaatgcagaggcgcgtgcggtgcgtgaaagtggctttaaaggtgaactgatccgtgtgcgctctgccagcctaagtgaaatgtcctcggcactcgatctcaatatcgaagagctgattggtacccaccaacaagccctcgatctggcggagcttgccaaacaaagtggtaaaacgctcaaagttcacatcgcgctgaatgacggcggcatgggccgtaacggcattgatatgaccacggaagccggcaagaaagaagccgtctctattgcgactcaaccttcgttgagtgtcgttggcattatgacccacttcccgaattacaatgcggacgaagtgcgcgcaaaactggctcaattcaaagagagctcaacttggctaatgcaacaagccaatttgaaacgtgaagagatcacactgcatgttgcgaactcttacaccgcgctcaatgtgccagaagcacaactggacatggttcgtccaggtggcgtgttgtttggtgatttgccaaccaaccctgaatacccatcgattgtttctttcaaaacacgtgtgtcttcgctgcaccatttgccaaaggactcaactgtgggttatgacagtacttttactaccagccgtgacagtgtgctggcgaacctgcctgtgggttattctgatggttacccgcgcaaaatgggcaataaagccgaagtgctgatcaatggacaacgcgccaaagtcgtgggagtgacatcgatgaacaccactgtggttgatgtgaccgagattaagggcgtgctccccggtcaagaagtggttctgtttggtcagcaacagaagcaaagcatcgcggtcagtgagatggaaaacaacgctgagctgattttccctgagttgtatacgctgtggggaaccagtaacccacgtttctacgtgaaataagctatacccaaacaacttggagaaaccacccaatcgaggtgggcgcatacgcccacctatctccacagacctttttacggcataatctcttcgcactttctgctgagtttttcattatttatgccaacaataaaatctcctttactcattgctattcttagcttgctcgccgctatgatcaccatccaatccggagcatcgattgcgaaacagttgtttccactggtcggcccgggcggtaccgtagcgctacgcatcagcctctctgcgctgattttaatgctgattttccgcccttggcgtgcacgcctcagctggccacaatggcgctctatgtgcatttatggtgcaagtttgggtgggatgcagctgagtttttacttcgctatcgaacgtattccactgggtattggggtagcgttagaattttcaggcccactgctgctcgccttactctcctctaagcgtaagaaagatctgatatgggttgcgttggctattcttggtattgtgttcttattaccggatatgaacggcgttgatgcgttagatccaattggcgttgcgctcgcattaattgctggcggtttttgggctggctacatctggttcggacaacgtgctggcagcgtaggctcaggcggtatgacggtttcgattgggatgctggttgccgcagtcatctatttcccaatcgccactcaattggccgaagcctcgatttttagctggtcgattctgccgatggcactgctggtcgccgtaatgtcgagtgccctaccttatagccttgagatggtggcactcagccgactctctacacagcatttcagtgtattaatgagcttagagcctgcgattgccgcgatggcggggttagccattttgggtgaaactctacaatggagccagtggctggcgatttttatgatcattactgcgtccatgggctctaccctgtccgcggcgaaatcaccgactaaagtgactcaagagtaaaagcaccgcggtcaatcataggaaagaaagaaataagaagagaaaaatccggccgaagccggattttttatgggcgctgcccgaattttactttgccttcgctactgaaccagagcgcttctttacgccggcggccaagcaaaaacgggccatcatcgtaaaacaggaagttcttccaatggcgcttaaacactgaccatttggtctccagtacgttgtatttctcgtagcagaaatacacggtgacatcatcttgccatgctaggtgggcggccaatgcttccggcaattctggttcatcgctctcccactccgccatccagcctgtctcaccagaccagctattggctttgcgtggccagtcgtgagagctcaaacgctcagcgtcaggacttgtcgcactgatgttctccttccaaaattgtgctgcgcgtagtggctccatgggtttgatctgagcgagatcagcttcaggcactggcatcgacgcatgggtaaaaatccattttctttggtattgatccaaaggcaaataagacattgagtttccttaaactttcagccagccgttttggctcgcttgttcaataatgtgttttgcgtgctcccaaagggtttggggttcgccgaacgggttattctttccaattgggattgatcagcgaagtcaggttatggtcttcccatttaccgttgatcagtaagtaatctttagcatggccctcaagcacgaaacccacgcgtttgagcacattttcactgcgtttattgtgcggaatgtaagaagccattatgcgatgcatgttgtgctcgctaaacatgtactgacaagccatcgtcaaagcacgcgtcatgatccctttgccttgcgcctcataggccagcgagtaaccgacattacacgcatggaatgggaagcggataatattgctaaatgagatggtgcctaacatggcatcattttgcgcatccaaaatcagtagatagtaaccgagcttcattttgtgcaattcattgagcttaattagcctttgcagccagccggactcagtaaaaaactcagcttcacgccttggctcccactcaatcaagtggcttcggttatccacaaaatactggcttaaacgctcggcgtcgttgatttgcgcgcagcgtacaacaatgtcaccatcggtttgatagaaatggcattcgctgtttaatccattcatcagcgcttccttattccataatccctcagcttattcgcgatcgacgtgtgagaaacattgagtcttttcgccaacttacgactggaaggaaaagattggaacagacgatccaacacttgcgattcgtactccttcatgatgtcgtcgagcgaaccatcgaggttgatactaggcgcagaacttacgctgtccacttgcggtaggtggaacggttcaatacccagcacatccccttcaatttcagttaaggcacgcagcaccatattgtccagttggcgcatattgcccggccactgatactgactgagtttatccagcagatcgtcggtcaacttaggtttgagcatgcccaacttgttacagtgtttggtgatgaagagttcaagcagcggctgtacatcacttgggcgttcacgcagaggtggaatacgcagcgtcaagacattgaggcggtagaacaggtcctcccgaaaacggcgcgactcggccaaatccgctaaattatgacgcgtggaggcaatcacacgcacatccacgtggatttcatgctcctccccgacacgacggaaagtgccatcttgcaaaaagcgcagcagcttaatttgcaaatgtggactcatttcaccaatttcatccagaaatacagtgccaccattggcttgctcaaaaatccctttatgaccttgttgatggttaaaagatcccggcgcatgaccaaacaattcggtttcggccacatcatccggcatcgaagcgcaactcagaaccaaaaagggtgcagaagaacgatccgaacggttatggcacgccttagcgagcatctctttacctgtgccggtttccccttcaatcagcagaggttgatcaagcatggccaattttttcgcttggctcatcaggcttttgtgtcgattcgaaacacccacaaaatgttcaaagcctaagttgctctgtagtgggatttgagttgtgctagtcaatcccgcattcgcagcacgtaacatcatcatcgcgctggctaaggtggattgtttggcatcgctcgaaatgtaaacgggcatgatttccatcacataatccagtccatccaagaccacatcttcacgcagacgagacttactgccttccagccaacgtgtgaagttgaagacgggcatcaaggctgaaatttgctggccgatcatgctggattcttcacgattgaacaatgcagccgcagcgtggttagccatatccaccgcgcctttgaggttgatcgccaataccgcatcaggcaagttattgagcagagaaatcaattcggtgttgtgccgttcaatcggcatgaactggattttacggacatctttcaccccgggaatgcggcgaatttccgccatcagttcactgaaggtttcaaaatcaatatcaggacaattgaggtaaataataccgatcacatcgatttcgatccctcgcagatcgatgcttttggaggcgagaatatccagtaactcgcgagtcagacctaatcggtcttcacagaggacttcaagacgcactttaataggatcctgtttgaaagtgtcacgaaaagttgacagtagtttcgcccaagcccagatcggcgtcaagcgatccgtgataacggatcgcagtttccgagaatgaaaggttatttggcgagcaaagcagccactttactcacgacttgcttacgaaccgcactcagtttgagttgacgatcggggtgccatggcagtggacgcagcaaccctaccgctttaatgcccaaacgtgcggtcagaatacccacgcctaccccctgccctgcacgggcagaaaggcgtccggccaagtccatggaaaacagatccacgctggcatcaacagccaattcactcgcccccgctaacgccatgttgagcaatacggctttaaacagttttatgcgtgaccagtaaccgagttcaacgccatacacttttgccagttgatccaccatggaaaagttacgccaagccaccagcaacatatcagcaatcgcgagtgggctaatcgccactaacgcggccgcttcagtcgcataacgagtgacaatttggctggcttgtttatcttgctcacccaccaccaacgcgtcgtacaaatcgagaatttctgcatcactgtggctactattgagtgccgatagccaacgttggtagccctgcttatccactttaccttgtttggctatctgctcacagaacgcttgaccttggcaaactgcatcattctccattaagatttgcgcttgttcttgaacactaaaatgctgacgtagacgacgcagtttccacaactctttcgcgatagcgcctaaccctaacgtcgccaaagcactgataaaccccacccatcctaggctgagccagtccaaatcttgaatggcttgtaccacgctatcgatagcctgccatgcgaccaaaccactgaaagccgcaaacaagccaccggcaaaccatttgcgccctttgctgggtcgaatgatggtgtcgagttcagcttccaatgcctcttctgctggcacttccatgttcatgggcacaaacttttcttgtgcgctgaactgctgctgagccgtcaagctcggcgtttctaaactaccttgcagtggctcgctaaaaatctgtttggttttaagatcgctcatcgcagtttatctccaatcagaatgtcgagggctttatcgactcgaatgtgctggcatggctcatccatcgccgtgggcagtggacgaaacgccgtaaaatcaaacgcctgacgctgccaataatcgggatctggcagtttgcgcggcacctcaccgggaaagagcgtgatggattcaccttccagagtgataccttgaatcgccgccaccttctgctctccctgcatgatgtaacctgactgcgtggcgcgcaccgaagccatgctgatgcagttcatttcaatattttcataggctgcatgctgccatgccggatggatcatctgctgcaatagagaaaccatattgacatgctgctccggtgttacatggtcagccttagtagccgcaaagacgactttatcgattttgggtgcaaataaacggctgagcaaaccactgcgcccatagcggaaactgtgcatgatttgctccagcgcgctgcgcatatccaaaaacgattcgtgcccaacattgagcggcgataggcaatccaccaacacaatctggcgatcaaacgtcgcgaaatagtccttataaaaggcttttaccaccttgttttggtactcctgatagcgcgcttgcagcaaagcgtaatagctctgcttgctcactgagccctgcggcgcatgacacgggaaaaattgcagcacaggcgcaccttccagctcccctggcaacacaaatcgtcccggctgaacccaatgcagtccactggctttacattgatgcagatagtcggtgtaactcgcggcaatcgccgccaaggtttgctcattagcttcttggtgaagatcaagctgctccacagcgtcacaccaaggcttagcgagctctttgcgtaacccatgcagagcatgaaattgctgtgctgaccaagtggcgtaatccatctctaatagcggtaaatcgagcaaccactctccgggatagtcgataatgtcgagatagagagttgcactactggtgagtagctttttgctgcgttttttcggcttgtatttgatcgccaaacgaatttcgcttacatctcgggttggcactggccagtttgcagggctgctttgcaactcggttaacgcttcatcataggcaaagcgtggcaccatcatgttgctttgcggcacacgctttgcgccaatcaagcgctgctcacgatccgccgctaacagagggagattatgatggctggacgtatgcagcagttgattgacgagagaggtaataaacgccgttttacctgcgcgcgaaagtcccgtcaccgcaagacggacatgagaatcgaggccacgatggataaagtcgctcatttcttgacgaatacgctgcattgttcactccaaatcaggatttcgcacagcttaataaactcaagcttaatgtgagatgaatatacccttcctacttaaagtggcagcagtgctgactacctgaaacgccaagtcgttcgggtatcgcttttgctcaggtaagtactaggcacagagcaaatcacaatgggtaatggctcgctcctgtctataagccattcaagtcacaggagcgataagagggattaatcttcttcgatcagtttgtagatgacaaacagtgcgatctcaagcagcacaaataaaccgcaggtgatggtgacgtatttatcattaaaaatgctgataccgttcaaaataaggtcgtaaccgaccacagcaccgatcaccacagcaataatgatttgtagaatctgaataaaacgaggcatgcctactaactcctgacctatcgataacgaaatgaattgtataccaaaactacagcttcgagtaggaaaggtatcctattaaaaaggtgcaacttacgtgcacctttgtcattttttgccaagttcctcgctgagaagaggcaagcctttacttggccgcttcagcgattttgacccgccaagtatctggaccgatttggtgcgcattcgcgcccgttgaatccacagcaacagtgactggcatatcttcgacttcaaattcgtagattgcctccatgcctaagtcttcaaacgcgactacgcgagctttcttgatcgctttcgccactaagtaagccgcaccaccgactgccatcaaataaacagctttgtgttttttgatcgattcaacggtagctgggccgcgctcagctttaccaatcatgcccatgacgccgacctcttccagcatcatgtcggtaaacttatccatacgagttgaagttgtagggcctgcagggccaaccacttcatcgcctactgcgtccacaggacctacgtagtaaatgaacttgtctttcaaatcgacactgtcaggcaatttttcgcctttttgcagcatggtttgaatgcgtttatgggcggcgtcacgaccagtgagtatcttgccagacagcagaaccgtttcaccggttttccacgtttggatctcttcacgggtgatgttatcaagattgacacgacgcgtattcgcgcccgcttcccaagtgatttgtggccaatcttctaacttaggcggtgttaactgcgcagggccgctgccatcgagtgtgaaatgcacgtggcgtgtcgccgcacagttggggatcatgcagacaggcttagaagcggcatgtgtcggtgccgatttgattttcacatcaaccactgtggtcaaaccaccaaggccttgcgcgccaataccgagcttattcacacggttgaaaatgtctaaacgcagctcttcttccgcattttgcggaccacgctcgataagctcatgaatatcaatgtgttccatcaaagcttctttggcgaggacggccgctttttccgccgtaccgccaataccaatgccgagcatgcccggtggacaccagcccgcgcccatcaagggtacggttttttctacccattccgcaatatcatcggacggattgagcatcaccatcttggttttgttttcactgccgccgcctttggccgcaatttgaatatccactttatcgccaggcaccatattgatgtgcaccacagctggggtattgtctttggtattgatgcgcttgcccgcaggatccatcaatactgaggcacgcagtgggttatctgggttggtgtacgcttggcgcacgccctcatccaccatctgctgcaccgtcatgtcggtcgaatcccattgcacgcccataccaatattgacgaaacaagtgacaatacccgtatcctgacaaatggggcggtggccttctgcagacatgcgcgagttaatcaaaatctgcgctatcgaatctttcgccgcttggctttcttcacgttggtaggctttttctagggcttttacaaagtctaatgggtggtagtaggagatgtactgcagcgcatcagcgacactgctgatcacatcttgcttgcgtattaccgtcattgctcgcctcgttattgttatgcttccgtgtactgcgacttgggtgaattactgcttccaaaaccgaaggagacgctcactctttaagtagcagctttgtatgagatttttatgatactcttgctttccctgcgatgctacgcaatgaacggtttctctgtcacaaattacacaaatgaataacaaccaaactttgtcaattgaacacaaaaaattaacttatcaccctgatattgctaaacaatttttcacatccattgagcagcaaccttgggcaatgctgctgcgctctgcgtctaccacccatatggatagccgctttgatattctggtcgccaatcctttcgccactttagtgacttttggtgatgaaactgaaattcacgcccagaacggcgtgacattgtcacgagaagatccttttgcgcttcttgctgacatccaagagcagtatcttcctcaagtgactgatgagtcggagttaccttttgttggcggtgctctggggtatttttcctatgatttaggacgccgagtcgaagtcctccctagcttagcagaacaagatattgctatgcccgatatggccgtgggcatctattcttgggcgctcgtggtcgatcaccaacagcacaccgcgcaattggtcggacaaaatgttgaagacgcttggggttggttaaaccaacaagaggcgataaagccaagcgaagtaactgactttgctctcacatcgccttggcgatccaatatgagctataccgcctatcaagataaatttgctcgtgtacaggactatttacgctcgggagactgttaccagatcaacctcgcgcagcgttttcaggctcactacactggtagtgaatggcaagcgtatttgaagctggaaaaaggtaatcaagcgcccttctccgcctttttgcgtttgccacaaggcgcaattttgagtgtttctccagaacgttttctgcaagtttgtgatcgagtgattgaaaccaaaccgatcaaaggcacacgtccacgccatgccgacaagcaacaagatgccctactcaagcaagatttagtcagcgcagaaaaagatcaggccgagaatttaatgattgtcgatctgctgcgtaatgatattggtcgtgtggcaaagccgggtagcgtgcatgtacctaagttgtttgatgtcgaaagctttcccgccgtgcaccatctggtgagcacgattcgcgcaacactggatgagcaataccaagccgccgatctgttacgcgcctgttttcccggcggttcgattacgggagcgcccaaagtgcgggcaatggaaatcattgaggagctcgagccgcatcgccgtagcgcttattgtggctcaattggctatctcagccgtcatggaaaaatggataccagcatcacgatccgcactttagtggcctatcagcagcagctttacgcttgggcgggtggcggcttggtggctgacagcgaaggcgctgcggagtatcaagaaacgctagataagttaagccgaattcttccaaccctagaatcctaactctcagtttgaaccaccgtcagcaccgcctatgctcgctggcggttttcttctcaagccatccccttcctacgtacagcgtcaagtcggtagaaaggggatatcatatctggcaaatgtgcagtaaccgacagcgcatccttttgaaacacgctataacaggtgttatacgttaatcacggtatagaggcctgctttgcaaaacattagccgtcacgagtttatccagcagtttcagctccatttacccgccgcctatcctcaggaaagcttgcggcgcgtcgcacatttagcgccagagaagctacgtaaagcgtcggtattgattggcgtagtagaacgcccgcaaggcctacaagtgatcatgaccaagcgcgcagcacatttgaggcatcatcccgggcaaatcagttttcccggcggaaagtacgaagagagcgaccactcgttacagcagacggcaaagcgagaagcacgagaagagattggcatcccagaagagaaaattcgtattgttggtcagttgcctgagttagtgaccgtaagccaatttgccgtgacgccttttttagcttttgtcgaatccgactacccgattcagctcgatcacaacgaagtcgatgaagtgtttgaagtgccgatcagttttttgcttgatcgaaaaaagatctacagcgggacttttcagttaaaaaaacaccgtcataaactgttcgccctctcctataaacaacattttatatggggtatgaccgcacaaatcatccaatcccttcaaaaacaatttattaattacaatgagttagtttgaaggcctatttttctcactttgggcaaggcaatacaaatcattagaaaatctaatcaaaaaaacaagcaaacgttttcctgaccattcactgagaatttttcacgcaaacataactaaatctaatccaacccattaacaattctcacatgtggcacgccaatttcgtgatcaaaaataggtttttgatagaagtttcaataagtacaaccaatcatgatttagatctagttttcttatgtgaaaaatgtgcaaaaatgcgctccgacttatttcctgttcccaaaatgagtaaaaacatatgaatactacaacagcggctacttctacagcacgttctgctagcaagtggacctacaaagatttcacctgggctctgtcccttttcggtacagcggttggtgcaggtgtcctgttcctacctattaaagcgggtgcgggtggcttctggccattagttcttctcgcactgattgccgccccaatgacttggtttgcacacaagtctctcgctcgtttcgtattatctgcaaaaaatcctgatgcagacatcactgacacggttgaagaacattttggtaaagctggcgctaacctcattacttttgcttactttttcgccatctatcctatcgttctgatctacggtgtgggcatcactaacacggtggattctttcctcgttaaccaaatcggcatggaatcgattcctcgctggttactatctggtgcactgatcacggcgatgactgctggtgtggtatttggtaaggagctgatgctgaaagccacttctgccatggtttacccactggtattcattctgctggctctctctttctatctgatccctgattggaacacttccatgatggaagtcgcacctgactggtcagcaatgcctgctatcgtatggcttgcgatcccaatcatcgtgttctctttcaaccacagcccaatcatttctcagttctctaaagagcaacgccaacagtttggtgataaagccgtacaaaaaacggacatgattactggcggtgcagcgatgatgctgatgggcttcgtgatgttcttcgtattctcggtagttctatcactgtctcctgcagagctggcgatggcaaaagagcaaaacatctctgttctgtcttacctagctaatgaacacgcttcaccgatcatctcttacttaggtccaatcgtggcatttgcagcgatcacctcaagctacttcggtcacttcttaggtgctcatgaaggtctagtcggtctggtgaaatcacgcagcaacatgcaagtcagcaagattgagaaaatctctctgggcttcatcgtcatcaccacttggattgtagcaattgtgaacccaagcatcctaggtatgattgaaaccatgggcgcaccaatgattgctgctatcttgttcctgctgcctgtatttgcaatgcacaaagtgcctgcaatggctaagttcaagacttcagcacctgtacagatttttacagttatttgtggcttggctgcgattagttctgtaatctacggcgctctttaatctctacctctgcgtatgagcttaaaacacaaaacataactataccaaaagcctccctacccttaggggggcttagttttgaggcattcaaaatgattagtgtatttgatatctataaaatcggtgttggtccttcaagttcacacacggttggaccgatgaaagcgggtaaagagtttattgacgaactacgctcaatgggaaaattgcgcgacgtcactaaaatcaccgtggacgtttatggatcgctatcactgacagggaaaggtcaccacacggatatcgctatcatcatgggtctggcaggcaatacgccagagaaagtggatatcgactcgattccgagctttatcgctcgtgtagaagaaacagaacgtcttcctgttggtatgcactgtcataccgtctctttccctcgtgaaggtgggatgaatttccaccgcactaatctgcctttgcacgaaaacggcatgcagattcacgcatggatcaacgacgagaaaatcttcagcaaaacttactactctatcggtggtggtttcattgttgatgaagagcactttggtaaagagaacgaatctcttattcaagtgccttacgctttccgttcagcggaagagctgctgaaccaatgtaaagagagtggcctctcgatcagcacgctcgttatggcgaacgaaaaagccatgcattctgacgaagaagtgcgcacctatttcgcgaacatttggcgtaccatgcgtgagtgtatggaacgcgggatgaacaccgaaggcatcctacctgggcctttgcgtgtaccacgccgtgcggcagcgctgcgtcaacaactgctgacgtccgaaaaaaccaccaacgatccaatggcggtggttgactgggtaaacatgtatgcgtttgcggttaacgaagaaaacgcagccggtggccgtgtagtcactgcaccgactaacggtgcgtgtggcattatccctgcggtactcgcctactacgacaaattcatccaaaccgtgactgagaaagactacatccgttacttcgctgcttctggcgcgattggtggtttgtacaaacgtaatgcgtctatctcaggtgcagaagtgggctgtcaaggtgaagtcggtgtcgcttgttctatggcagcagcgggtcttgctgagcttttaggcggtagcccagagcaagtctgtatggcggctgaaatcgcgatggagcataaccttggtttgacttgtgaccctgttgcaggacaagtacaggtgccatgtatcgaacgtaacggcattgcagcggtgaaagcgatcaactcaacccgtatggcgctgcgtcgttcttctgccccacgtgtttcactggataaagtgattgaaaccatgctggaaaccggcaaggacatgaatgctaagtaccgtgaaacctcacaaggtggcttggcgatcaaagtgatctgttaatcagaacctttttgtgcttacaaaaacgcccggatttccgggcgttttttatgtggggcgttttcactctgaatctcaaatcgattcgctattcaccacgataaatacaacccgcggtgcaggtttctttgatctcgactttgctcagcagcggtaagctaggcttgagttgctgccaaatccatttcgccaacacttcactggttgggttttctaacccttcgatatcattcagataatagtgatcgagacgatcataaatcggtttgaatgccgctttgatttccgcaaaatccactacccaaccggtatggggatcaacctcaccttcaacatacagacgaactaaaaaagagtgtccatgcaaacgaccacacttatgaccagcgggcacatgcggtaagtggtgagcagcctcaaacataaactctttgtataattctgttttcatcatcattctcggggcataaaaagagccgcaatactaagaaatctctgctgctgaaacaaggctattcaaaacataattcggacaaaccgcccctctcacaccagcgactgagaaacattcctcaataatcaatgcaatatacccaaactacttggagttgcaggtaggcggcaagtgagtgagtccccatgagcatagatagactatgtgattggggtgaacgaacgtagccaacaccgctgcagcttcaagtaggaagggtatagctaagagtatgcgtcatacctcatatttaaactcacactttggttaaggtcacactaacaattggtctacgtttgtcacctagtgaattaacgctatatttacataagtcggggtcacttataattacaaaactatcatgaactcatccattcttagtaaattgctgctgacattaatcaccgtgtttgccttagttttggcgggctcaacgtcttatcaatattggcagcaaaaagatctcattcattccgtgttaagtgagcagctgcacgacaaagccagtaactactttgatagcctgaacatgatgatgctgactggcaccatggcacaaaaagagacgctacgccaaaaagcattagcacaagatggcattgaacaagttcgcgtcattcgagcgccttctttaaacaagatttatggccccggaagcacggatcaacaaccgaaagatgaaattgatcaacgggcattacaaggcgaaaccattatagagccctatcaagccgattgggggaaaggcattgtggttgccttgccgatgaagtcgagtgaaaactatcgtggtactaactgtgtggcttgtcacatcgcaccagaaggtgaagtgcttggtgtaattcgtcttgagtttaatcttaaccacttaacgcaaatggtgaatcatcgcactcttattggtgtcggcattatgtcggttattgcgctgtttggttttatgttgacgctgtttttcatgcgtagaattatcgttctccctttgcaaaaaacgtcggcctttatgtgtgaggtgagtaagagtaaagatctttcccatcgactcgaaaacgatagaaaagatgaactcgggcaactggcggtatccatcaactcactgatggatacggtgtcagacagcttgcaacaagtgcaagacacttcccattcccttgctgattcggccaaaaagcttacgaatgtcgcgcaagtcaccgatcaggcggccaacaatcaacaaaaagaaactgcagaagtgcaaaccaacatcacggatatgcaaggtaagcagcaacaagtggagtttgcgaccgaagaagcgtctaaattggtcaatcacaccaccagtattgttcagcaaagtgccaagcaagcacacgcagccagtgaagatatcaaaaatctggtgggcgatattgaggcggtcaaacaacggattgtggaattaaataatcaaactggccaagtatcatccattcttggcgtgatcaaaggcattgccgaacaaactaacttacttgcgctgaatgccgctattgaggcggcgcgagcgggcgaacaaggtcgcggttttgctgtcgttgcagatgaagtgcgtcatcttgcatcacgcaccacggaagccaccggaaatattgaaaacatcatcgcaggatttcagcgtgacagccaagcctcgctctcttcggtagataccgtctgctctcatgcgcatcagcgttcatccgaagtggaagagctctcagcggccatgactcgtgtggtcagcgaaatgcaacaagtgctaagccatgctatgggtattcaagagcagaccaaacgcaccacggaagtcagtcatgagatccaaaataaggttgatgtcatcactcatcacgcgaacaacacatcacaatcggcaagtgagacgcgtgagatcagcatcgatcttgaacatttgtcacaacaattggagtccttgctgaatcaatttactttgattgctaagaattctgcgcggaaaccacattaaaggttgaagctgacaaattgacaggtaatatgttccgttgaatctgtaaaactctctacaacccaatgtttcgtctattttttgcgcgatgacgagcgcaaatggcattgggatgtctttatatctcaacggagactgtaataaacatgacttacgcgcctgtaaatgacgtactcagcggcaagctcgcagtagacagtgaagtcactgttcgcggctggattcgcacacgtcgtgattccaaagctggaatttcgtttcttgccatctatgacggctcttgtttcaacccgattcaggccgtggttcctaataatctcaataattacgacaacgaagttctgaagctcactacaggctgttccgttgaagtaaccggtaagattgttgaatctccagcttcaggccaagcattcgaactggctgcgtctgacgtaaaagtcgtcggttgggttgaagatgccgatacttacccaatggcgaaaacgcgtcattcgattgaatatctgcgtgaagtggctcacctgcgtccacgtactaacgtgatcggtgcggttgcgcgtgttcgtaactgcttggcacaagcgattcaccgtttctaccatgaacaaggttacttctgggtttcagcgcctcttatcaccgcttctgatgcagaaggcgcaggtgaaatgttccgcgtttcaacgctggatatggaaaacctaccgcgtactgacgcaggtaaagtggattacaaccaagacttctttggtaaagaaaccttcctgaccgtatcaggccagctcaacgcggaagcttacgcttgtgcgatcagcaaagtgtacactttcggcccaacattccgtgcggaaaactcaaacaccagccgtcacttggcggaattctggatggttgaacctgaagttgcattcgctgacctgaacactgtagcaaagctggcggaagacatgctgaagtacgtgttcaaagccgtactggcagagcgtcgtgacgatcttgagttctttaacgatcgtattaataacgaagtgattgcgcgtcttgagcaatttgttgaatctgatttcgcacaagtggattacactgatgcgattgaaattctgaaaaactgcggcaaaacgtttgagttccctgttgaatggggcattgatttagcttctgagcacgagcgtttccttgcagaagagcacttcaaagcaccggttatcgtgaagaactatccaaaagacatcaaagcgttttacatgcgtatgaacgaagatggcaaaaccgttgcagcgatggacgtcttggcaccgggcattggtgaaatcatcggcggttcacagcgtgaagagcgtttggatattcttgatgcgcgtatgcgtgaatttggcatcgatcctgagcacatggactggtatcgcgacctgcgccgttacggcacagtgccgcacgcgggctttggtctgggcttcgagcgtctagtctcttacgtcactggtatgggcaacgtgcgtgacgtgatcccattcccacgtaccccacgcagcgcgagtttctaattccgctctgttgaatgtaaaaaccgtctcaagcgagacggtttttttataactcaagctcactcttattggcttttctgctggcttttagccatttgcagtagataaaaatggtgtatcggcccataaccttggccgatccttaattgatcggcatgcacgatcgcttggtggatatactgtttggctttatccaccgcttccactaactcagccccctgcgctaagtatgaagcaatcgcagatgagagtgagcagcccgtgccatgcgtattcttcgtagcaatacggggcgcacagaaatgacgactatcaccactttgaatcagtaagtcatcactgttggcttgctgatggtcgtgaccacctttgagcagtaccgctggtgtgtttaactgactaagcacggtaataccctgctgcggattctgctgccattcttgttgcgtcatccccgctaaaaccgccgcttctggcagattaggcgtaatgagattggctaacggtaatagctcacgttttaacgtctcgactgcctctgccgccaataaatgatggccactggttgagatcatcactgggtcgagcacaatccatttcggttgatattggcgtaatttcttagcaaccagagcgatgattggggcatccgccagcataccaattttgactgccaagacgggaatatcgctaaacacggcgtctaactgttgctcaaccaccgctaatggcaaaggaaaaacggcggaaacaccctgcgtattttgtgcggtaatcgcggtaatcactgagcaggcgtacccccctgtcgctgaaatggctttgatatcggcttgaattccagcgccaccaccgctatctgagcctgcgatagtcagcactatgggagtatgaatagaagagattattgacataaaagctcctgtgaaaacaggaactgatcccaaactgcaaatcaatggtgagacaataccagcggttgaggatagttccctacgtcagtcctaactgaatcaggttcaacgggtctcgctacgcgatctcagcctttaattcgcacgttgttatacccaaactacttggagttgcaggtaggcgacaagtgagttcatccccatgagcatagataaactatgtgattggggtgaacgaacgtagccaacaccgctgcagcttcaagtaagaagggtatatacgctctcaggctccccgactacaggacgtatcttaacagtattccttgatacaaaaagcaattattgctcctctcaatcgttacactctgatacgaccactcaaaaaatgttcgttttaaagtggtcatcacccagcaatgtctataaaatccgcgcctttattcaaaatgataataaatcacactcactttaatgacgctgcttatacttaactagccgtaacttattgaccatttgggttctatcacttgctatgaaaaacacgatttaccatgccccactgacgtttggactctatgcgcttgctggagtgctctttgcgctttacacaagccgagtctgtccttttctcgcgacattaagcactcgtgaaatcgccactcaggtgggtgctgtcttcatcctcgcatggctgattcggcatactctgcttcgccagcacatttgggcaagaaaacagcaatttatccaattggacacggcactcctcttcgcaatgagcctgcctttagcgctttactacaatctgcaataccagttcacgttagacagtaatttaaaagtactgtttggaatgaccttatttggtttcttcaccggagcgttattgcaattaagcagtaagttaagaacgctgcgccaaatgcctcaaagtcagaaccttgctctctcttctgatgagcgacgttccttagtcaaacagctgattggcttgatcgtccttttaatcagcacactgacagtgatgctcagcatggtcgcaatcaaagatattcactggctggaaaataaccctgcgcgcctacttgatggcagtggcaagatcagcattgtgaaagagtttgcctttttgtccttggtgttaggcggctacatcacggccattctcgtactctggagtcgaatgatgaaagagatcctcgaccatcaggagcgctcattgcaagccgtgacgcaaggcaacctccaagtacgccttcccgtctactctaacgatgagttaggcaatgtcgccatgttgaccaatcagatgttagacagcttagaagctacgcaaaatgaggtcaaaaccacacgtgatgtggctatcgtcagcttatcggctcttgcggaatcacgagataacgagacaggggcacatattcttcgcactcaagaatacgtcaaagcgttagcagaatatctcgctgcttttccccaatattcaacgctgttaaccccggcttatatcgaactactctacaaatccgcgccattgcatgatgtaggcaaggttggcattcccgattcggttctgctcaaaccgggcaaactgaccgatgaggagttcaccgtcatgaaagagcatccgcgtatcggggcgcaagcacttgcgattgctgagcgccatttagggacgagctccttcctcgccattgccaaagaaattgctctcactcaccacgaaaaatgggatggcacgggttatccggcgcaattacaaggagaagccatcccgctttccggtcgcttaatggcgttagccgatgtgtatgatgccttgatttcagctcgggtttataaaccggcttttagtcatgacaaagccaaagccattattgtcgaaggcagtggtcaccattttgatcctgccgtggtcgaggcttttctcgcggttgaggaaaagttcgtagccattgcagcacactttaaagatgccgcataaggttgtagttatacccttcctacttgaagctgcagcggtgttggcgacgctctgctttgcgaatgctcaatccatgacgatggaaagaaatgaaaatttaatacgtaatgatctgaacatcgccaaatcttatcttattgatgtattgcctcaataaccggacaaaaattcatctcgccttaggctgaaaagcccaaggcttttacatcacaaatgaccaactattcccagtttttcagccaagtaaaaatttttcgatattttctttcaggtgctgttgtcacctgaatacgagggaggtataaatacggtaaattttgatgagttcaatcatcccttcccaccctaacttgacatggatgtgctttatgttcgaaaaagtcgttgccgctcccgctgaccctatcctaggtttaactgaagagttcaaaaaagaccctcgtaccgacaaaattaacctcggtgtaggtatttataagaatgaagcaggtgaaaccccggttctcgctactgtaaagaaagcagaagccgcactgcttgagtcagagaaaaccaaatcttatctcacgatcgaagggacagctgagtacggtttagcagtacaaaaactgctgttcggcgcgaattcggacatagtgacacaaaaactggcaaaaacagcgcaagcccctggtggcactggtgcgctgcgtgtggcgggtgaatttattaagcgtcaactgggcgatgtgaaagtctggatcagtaacccaacttgggctaaccatcacggtgtgttcaatgccgctggcttggaaactacgcaatacgcttattatgatgccaaagccaaagacaaagattttgccgctatgctggcagatttagagcaggcagagaaaggcgatgtggttttactgcatggctgctgccacaatccaacgggtattgacccaacagagcaagagtgggaagtactggcgaaattggtggctgacaaaggcttactgcctctgtttgactttgcttaccaaggctttgcttcaggtgtggaagaagacgcggctggcctacgtatttttgcgaaatacaactctgagattctggttgccagctctttctcaaagaactttggcttgtacaacgaacgtgtcggtgccttcacgctggttgcaccttcaacaaccgttgcagaaacggcgttctcacaagttaaagcgattatccgctctatctactcaaacccaccagctcacggtgctgccgttgtcacttatattctgaacaacccagaattacgcgcagaatgggaagccgaagtcgcggaaatgcgtgaacgtattcaagagatgcgcgtacttttcgttaacacattgaaagaagtgggtgtagacgctgactttagctttatcgagcgtcaaaacggcatgttctctttctctggcctaagcaaagagcaagttgcacgcctcaaatcagagttgggtatctatatcgtcggctctggccgcatcagcgtagcggggatgaccaaatcaaacatgctacccttgtgccaaggcattgctgcggtgatgtaatcgcatcgtcaatgactctcttaaaccggctggaatatggccggtttttgtttttttactgttcatatacccaaactacttggagttgcaggtaggcggcaagtgagttcatccccatgagcatagatacaggtaaacgaacgtagccaacaccgctgcagcatcaagtaggaagggtatagatagactcctttccctatctctgcgtgctccgattagccctaaggcaataaattgaggtagtatggtctgccataccgccaaaaacattgcctaacgcatgtttgtaacgataggagcctccatggacgccgagttaatcgagattcaacaattcctgcaacagcatccgccttttgatgccttacccaacgaacgactgcctgaaatcgctcaacaaattgaaattgcctactttcgtaaagacacaccgattattggctataaacaagccatcagtgatttatatttggttcgtagtggggcggtcgaagtctatcgacgtcatggtgagctgtacaatcgactgacggaaggcagtctatttggacaaatggggttattaacgcgtaaccaagtgtcttttgcggtcactgcaattgaagatacgctgctgtactgtttgcctgaagcgctctttcaccgtttacaccaagagtttgatagttttgccgattttgttgaagtagagcaagccgtacgcttgcgtcaaaccgttgctaaacaaaaagaacaaaatgatcttatcaccagcaaagtcaaacagctgttaacccgttcagcaccaacgatagacaaacaagcctctattcaacaggcggcacagcgcatggcagatgaaaatgtctctgcgctgctgatcctcgataaccagatcctgcttgatacggaagatgactcaacgcccatggtcggcattgtcacggaacgagacctctgccgacgcgtcttggcgcaaggtatggatgtcacacagaccgtcagccaagtcatgactcatgaggtcatctcgctggatcataacgcttacgtctatgaagccatgctcgccatgctacgcaataacgttcaccacctccctgtattaagagaaaggcagccgattggtatcatcgacatgaccgacatcgtacgccatgagtcgcaaaactcattgcttttagtcagtcgtatctaccagcaaacttgtattgatgatttggctcaactcgccaatgaagtcaaagcaagcttcgtacgtttagttaacgaagacgccaattcacacatgattggtactgcgatgtcgaccattggccgcgctttcacgcagcgcatcattgaattagtcgaggccgagttgggtgctgcgccactaccctactgttttgtcgcctttggttcgatgggacgcgatgaacagttgattgtgaccgatcaagataatgctctgattttagatgatcgctacgatgtgcagcagcatggtgcttattttgctcaatttgctgagttggtgtgtaggggattagaccgctgcggatacccattgtgtgatggtgagatcatggctagcaatccgaaatggcgcatgactcgcaaagaatgggaaacctgctttgctgactggattgataatcccaacccgcaagctctgctcaatgcgtcgattttttttgatctcgatggtgtctatggccgcaccaaatgggccgagcaactgtctggttttatcgtacgccgcgccagacgcaatcagcgatttttagcctgtttggcgcgtaatgcgctcaatcgcacgccgccactgggcttttttaagaatttcgtgatggaaaaagatggacgccataacaactccatcaatttgaaacgtcgcgggacagcaccactggcagatttgatccgcgtacatgccctcgccgcaggttcacgcgctaaaaactcgtttgaacgtttagatgatgtaattgaagcaggattgctcccacaaggtaaaggcaaagatctgcgtgatgccttggaattcatcgctatggtgcggattcgccatcaagcgattgatgttgaacaagagcgtgaggccgacaacagtatcgagccggaacatctttcggactttgaacgacgcaacttaaaagatgcgtttcagatcctcagtaacggacagaattatcttaagtatcgttaccaagccaaccaacattttaagtgagcgccatgttcgattctgcgatttactggcccgctcgatttgctcacttagcccagcaggctcggcaaacccatttacagcgcttttatgctcaacctctggttgaaggctcaacaccgattcatcagtgctcactggttgccctcgattttgaaacaacgggactgaatgccgagcaagatgccattgtgagtatcggtttagtgccttttactactcaacggatttttcttagtcaagctcggtattggttagtaaaaccctctcaaccgcttgaagatgagtcgatagtgttccatgggatcacgcactccgagttgcagcatgcgcaagctccagaacaggtgttgaaggaattactcgaggcgctgcacggcaagattgtcgtcgtacactttaggcatattgaacgtgattttttgcgccagattagcctgaatatatggggcgaggcgatcgagtttcccgtgttggatacattagaaattgaacgtcagttactggataagcaacgctcgctgtggcaacggattgcacgtcgacctttaccctcaatacgccttgggcaatcacggatgcgttatcacttaccgccctactcacctcaccatgcgctgacggatgccattgcgaccgcagaactttttcaagcgcagtgcgcgtaccatctcccaccccacaccgctattcagtctttgtggctttaggctctgtgctctgtgctctgtggctaagagccctatataggtctttgaccgcgaatcgaaactcgaaacgacgagatacataagaacgaaaaaggagcgcatcaagcgctccttactctgactttgtcagtgacgtcattacagtttaaaacgacggatctcttgttctaactcatgagacagttcagacaactctgcagcttgttcagcagcggagtgagcttcttgcgcgagatcatttgaaacatcacgaatacctacggtattgcgagtgatctccgaagtcacagaagcttgctcttcagccgctgacgcaatttgcgtcgccatatcactgatacgttctacagttttatggatctgctccaagctaaccgaagcttcattcgcatcatcaacactggtgtccgcgaggcgacgactgtcgtccataatacctaccgctttacctgtggtggcttgcagcgtttcaatcatctgctggatttctttggtcgacgcgtgggtacgttgactcaacacacgaacttcatcagccacgacagcaaaaccacgtccttgctcacccgcacgggcagcttcaatggccgcattcagcgccagtaggttggtctgttcagcgatgttctgaatcgtcgacagaatcgtactgatttggtgaccatgtgcttccagctcttgaataacttcggtcgcgacttgtacttcttcagccaaagattgaatcgaacgctgcgtttgagtgacttgacccgcgccatggacacacgccgtcacggcttcacctgcgttttgcgccgtgtgatccgcattacccgcaatttcttgagtggcagcagccatctcattaattgcggtagccaccatattgatttcgtcttgttgcaagcgaattcggctactgcgctcttccgcttgtgccgccgtcactttcgactgctgcgccaatgcggctgaaacatggcttaacttgagtaccatggtgtgcatgttgctcacaaaggtattgaagttgcttgccagttgtccgacttcatcatcactgcgaggttctaaacgttgtgtcaaatcggcatcaccagaggcaatttcctccagcgctttcgatacacgacccaaatcacggaacaagaagctaacgagccaagagacaatcacaaccacaatcacagtgatcagtaacgcagtagtgataaggcctgttaataactcagaatgagaggcgtattcggtatcactgtccatctgtactgcgaaataccaaggtgtatcgggtaccgcagtgaaaaagaagaacttctccacgccattcagtttaagcgcaagcaactcaccttgattcgcagcacgctcgatagtgcgcatgtccaaagcagaagagagcgtcgtcacaggcttcagtagcaaggatttgtctggatgcgctaggaacgaaccgttttgaccatcaatcaacatggtttgtgcattttttcctgcgtccatgctgatcacgtccgcaatcagctgatcaatgagaacatctgcgccaactacaccactcatattaccgttaaggcgaacaggttctgcaatcgtcacaagcagtgcgccggttatcgcatcactgtatgcggtggtgatgatctgcttacccgcactggctgcatctttataccaagggcgcgtacgtggatcgtaatccgcacgattacgctctggatgtgagcgatacatcgcgccgtcagtcgtaccgtaaaaaatatcgtcaaaaccacccgcattgcgcgcttgttgcagataagggacaacattttgtgcttcaatgtgagcattaaacgcagtactaattgatttacggatagaaatccaatctgagatgcctttagcagcggtcgaagaaattgcgtcagcacgagtataaaccgcattgctggtttgctgttgcaattgactggcggaaaaccaagtcaatgccgtcgccatcaccaccactgccgataaacttgcgccaatcagtttgtgttttagtgttaatttcattatgtcaaacaaaaggttggaacgaaggagtcgcgatagtaaacactattcgattaaagcgcactcgttttgtcattttttctcacaacttgtcacagaccagaattaaccttttatgttataaggtcttaaacgacaaattactggcttatgccaaactttttgctctcacgcaacgtgatttgccttccaaaatcacatataactaaaggatataagcttatgaatagaaaatatctgataaagacagttctcaacaacatatgttgtgcatttttttacagttctgctatctttcgcgcttaatgagacctgcaatttcctgcgataccgtccggtcagcaaaattgcagtaaactcttaagctatcttcgtatttcactttgttatcggttcatttctatatgattcgtgtgtccagcgccgtgcaacgtcatgcgcaaaaactgattgtacttttctccctgctgtttggggcttctttgctgatgtctgataatggttttgctacagacattaaaaatactaatgcctcttctccagtgaattcagagtctactaagccaacaaaagctggcgaagttaaaaatgtggttcgctttgccaaaacgggatcgtttgataacgacaccgttgttcgcctagctcgccaactggcgaaaaagccttatgttgccttaaaagatccgctaccagagagtttggccaatatcagttatgatgagtaccgcgatattcgttttaaacccgacagtgcagtgtggaaagcagatggcctaccatatcaaatgcaactattccatcgcggtttcttcttccaagatctgattgaaattgcacttgttgaaggcaaccaagccactcacctaagttacgaccccaatatgttcaccgctggcgaagttctacaacagaacctgccgactgaagatattggttatagtggtcttcgtgtgcattaccctctcaacagcccatcctattttgatgaactgtttgtattccaaggagcaagctacttccgtgctctgggtaaaggcaatgcctatggcttgtctgcgcgtggcttggccatcaaaactgccgatccagcgggtgaagagttccctattttccgtgccttctgggtggaaaaaccaaactacgacaccaacttgattgtggtccatgccctactggatagcccaagcgtgtctggtgcgtatcgtttctctattcgtccaggagaaaatactcgtatggacgttgaggcggtactcttcccacgcgtggagttaagcaaagttggtctagctccggcaaccagtatgttcatgcattcgccaaatggccgtgagaagactgatgatttccgtccttctgtgcatgattctgatggtttattgatgatcaacggacgtggtgaacgtttgtggcgtccattggctaaccctagcacactgcaagtgagcgcctttatggacaactcaccgcaaggctttggtttgatgcagcgtgagcgcgattacgccaactaccaagatttggaagcccattacgaaaaacgtccaagtctgtgggttgaaccggtcggtaactggggtcctggtgctgtcgtgttgacagaaattccaactcaatcagaaattcacgacaacattgtcgccttctggaagccagcacaacctcttgcagcaggcagtgaatatcgtttctcttatcacctcaactggggtgcgcaaccagaagcgaatccacaagcgatcactgtaagccgtactgcgagtggacgtgccgatattgccaaaccaacgccaaaacgtttgttcgtgattgattaccaagtccaaggtgccaagcctgcacagatgccagaaccgaaagtgcgcagcaatgctggggtaatcagtaacgttgtactgcgtgataaccctgccaataatggctatcgcctctcatttgaatttgatccaggcgaagtgacgctggctgaactacgggcagagctgactttgcaagaagcgcgtcctgtagaaacttggttgtatcgttggaccctgtagtaagtactcggattttttatgacaaacccaatggttgaacaaggagcctcccagttaatgggaggctctgccatgccaccagaacaacacggcgaaatgccggaacaaaatcttaaacgactgagtgaaggttttccgcgtgatgctattcaaacgggtggggtcaaatcctgctcgtggcgacgtgtgtttgtggttggttttgctttactcatatctgcttttgccatctttgaaatgcgcggcgtatttttggtcggtggactaacgcctatcgaatacgcggtactggttctctttgctatcaacttctgttggattgccttagccttctcaagctcgattgccggattttttgttctcgcgagtcgcaaacctgcccccaatacagagcaacccctaacgacacgtaccgcaattttgatgccgacttacaacgaggcacccgatcgtgtctttgccgcagtagaaaccatggctttggctctagcgaaaactgaacacggacatgccttcgattggtttattctcagtgacaccaccgatcctgaagtggcgttatctgaagagcaagccttctggttgctgcgtcaacaaaccgcaggcaaagctaacgtctattaccgccgccgtcgtaaaaatattgcgcgcaaagcgggtaatattgccgatttctgccgtcgttggggctcggggtacgaccacttattagtattggatgccgatagtgtgatgcagccaagtactatgatttcattggctcaacggatgcaaagtgacccagatgctggattgattcaaaccattccggcgctgatcaatggcacgactctcatggctcgtgtgcagcagtttgccgctcgcatctatggtccagtggtcggtactggtctggcttggtgggtacaaaaggaaggtaacttctggggtcacaacgcgattattcgtacggaagcctttatgagtgccgctggcctaccgcatttatctggtagaccgccttttggtggacatatcctcagtcacgatttcgtggaagcagctttaattcgtcgcgcaggttggagtgttaccatcgccgcggatctgagtggctcttttgaagagtgccctccttcgattatcgatttagccgtgcgcgatcgccgttggtgtcaaggcaacctgcaacacagccgcatcataggcacaaaaggtctgcactggatcagtcgtttgcacctgactacgggcattatgtcctatctctcttcgccattttggctgctgttgattttgtcgggtttgttactggcactgcaagcgcactttattcgtcctgagtattttaccgagcagttttcactgttcccgacttggccggtcatggactccgcacgcgcattgcaactgttttacatcaccatgggtattctatttagcccgaaaattttcggattactgctgctgatgtttgatggtgaaatgtgtcgtaccttagggggacgactgagagtcatactcagcgcggtgacagagatcctactgtctgcactggtcgctcccatcatgatgctcatccactgtggcgcggttgtgtcgattttgtttggacgtgatagtggttgggctcctcaacgacgtgatgacggtagcttgccaatcaaagacttgctgtaccgccaccgttggcatatgacagcgggagtactccttggttatgccgctatgctcgactcatggaccctactggcgtggatgtctccagccttaatcggtttgtggttctctgtaccactctctgggatcacggcgtcatacaccatcggagcttggtttaaacaaaaacgcattcttgcgactccagaagaaattgaaacaccggcgattgtgcttgctgcgcaagctcgtcgtgacgagtatgtggtggatcttcaggaagtatggaacgcacgcatggtacttgctgatcacaacctgatcgctctacatattgcgatgatggataaactgccgtcgcgccaacccggcaccgcgattgagcctttggatgcagtagcacgcattaaagtacaggaagcggagagtcaggaaagcctactggcgctactgaccaaagtcgaactgagttatgttctgggcaatcccctgctgatccagcaggtagccaaactgccgcccagtttagcgaaccagactgtctaaactgaaagtgtcgcctacacgattgtgttcgcgacacttttttatccgctcttactttttatccccgctgactttttactcccctattacttaacgctacagcagcgttagcgttggctgtaaacttcaaatcactaaggggcgtttatgagtcttgcctttcagctattttcgacagtggttgatcggcgtgacgcttttttaagatcggacgaaagctttgcggaccgactgtcggttgctgtttcaccatcgcaatcaatgactgcaccgccgcacgtgccatttcgctgatcgggaaatgtaccgccgtcaccgttggatatagactctcacacaaatcaacactgtcaaaactgacgatagaaatccgtcccggcaccgcaataccttgttcatgtaaatactgcagcgccccagtcgtcatctcctcactacacgagaaaacagccgtgatctcggggtggcgagcgaatagctgctgcatcgcaaaataaccacttttgcgaccataattgccttcttcacacagtgacttgctcgggagaatccccgcttgagctaaggcatcgagatagccttgctgccgtagacgactattgtgtctgtgtagcggtccggtgatacaagcaattttcctgtggccttgctgaatgagatactccaccactatctggcttgctccacgatggtcaaaagtaatgcagcgctcttccaaacctgccacataacgatcgagaagaacaaagggagtcggctgctgagctaatgctcgcaaatcatcgtctgataaataccggctgtgcagaacatacccatcgcaacgcagatcgtgaaagcgctgtatcgcctctctctctccttgtgcagagtgatggccttgtgctgtgatcaaaaacttatggtgcatatccaactcagtttgcacctgttccatcatttcaccaaaaaagccacctgtgtaatacgtgactagaagacccatcatattcgatgaggaggtcgccaaagaacgggctattgcactcggccgataattaagttgagccattgcttgctcaaccttacgccgcgtttcctctttaaatttcccctcaccattgatgatcctcgatacggtagagcggttcacacctgcaagttcagcaacatctttaattcttgccatattagagcctataggaagtcagaaacttcagaaaaacaaggaactgcgagcttgcacgacactcccttacggaagtctccactcggcgagacagctcccatcatacacaggagtgcagaggagcagaaatcaaagccgagtaatccgtgatttcgatatcatgcgctaccaacaattgtattaattgtgcgctagttagaatgtgcaactcttcttctctttgcttggcataaccgctgcacttttcgagtaatggatccacgaacgcgggatggcacataacctcaaccagatcgaagcgttcttttagctcaagcagatgtttcattaaagggtcgatgcccaaacgttgatcatagaaaaaatcagtgaaatgataacggcagccgaacgcctcctcccctgccataccaatatcccgcagtggaacatggtattttttagccacttcataaatgatcggagccaattgaggatgagtatgggcgtgatgatggctatcaagatgacttaaagtgagtccaagctttagaaaatgttcaacctgggcgatagcttcatggtatatcgcctcaggttgatagtctctacgctgccaaaaatcacgataagcggtgaagacaccatgttcatcggttaagtttctttctcccgttaaagggcgtcctgctgtaaacctcagatgaaggccaatttttaagtcgggaagctgttttgccaattgaaccgcatgctgctctgcaggcatgcccaccatcaaagtggttgattttacgaccccatcaaggtgggccttgacaataccttggttgacaccttgagttaaaccaaaatcgtccgcgttaaaaattaccttcatcgagagattcaccttattaccgttaccatgtggtgagtttaaattggggtagataaacggcattttcacgcagaatatcatccaaaatggctttcgcccgaccaatatcaggcaccaatgggttattcgttaaagccattaaagcaaggtgatagtcaccgtgtactgcggcttctatcgcaagctgctcataggctttcacttgatgtagcaatccactgatttttggtgaaagttctccgaccgcaatcggttttgctccccaactgcccaccaccgcactgcattcaatcacggcatcatgaggtaatgaactgatcgccccatgattctgcacattaaccacatgaatactattgcgattattgtagatggcatcaacaagatttaacgaggcatccgaataataagcaccgccacgcgcttctaactctttaggcttatgagccagatgtggatcttgatagagctcaaataaggccttttcagtgaccatcacttgctcagctcgcgttcctttctcttgagcactttttttctcttctgccaacatagcatccgtttggtaaaagtagcggtgataagggcaaggaatcgcgcctaacgcttttaagaactcaggatcccaaggttcttcccagatatttttcatgctgaaattggcgccatcacccaccttttctaaaacggtttgagtgatattttgaccatccaaccaagcttggtgcacccaaactaaatggttcagcccagcgaactcgagctgaaggtcttgaggttcacaggccatcatttcagcaatcatcatctgcatagaaacgggaacattacataatcctatgcttttgacttttgagtatttactgactgcctccgagaccaagcccgcaggattggtaaagttgagcatccaggcattgggtgctagctcttcaatatctcggcaaatatccagtatgactgggatcgttcgaagtgctttggcaaaaccaccaggccctgtggtttcttgcccaatcacatcatatttcagtggaattcgttcatcattcgcgcgagcggcaagccccccaacccgaaactgggtcataacgaaatcagcgccggcaatcgcctctcggcgatcaaagcccgctttaatttcaatgtcagctccaactttgtcgaccattctctgcgtaagatctcgaatgatctgtaatttttccgcaccggcttcaatatccacaaagtgcaactgcttcactggcagaaaatccaatcttttgagaaccccttccacaagctctggggtgtaactactgccaccgccgatgactgccagctttaatgcatttcgagacattttgcttcctcacccgccaagtgtttatgtaaagccaccatttcagtcgccatttcctgtgccagaattgtcgtcattaaatgatcttgagcatgcaccatcaccaaggtcattggtactttgccttcaccctgatcggcttcaatcaattgtgtttgaattaaatgagctcggtttaagcactctttagcctgacacaatttctcttctgcctgctcaaaagatcgagtacgcgctaaacgtaatgcttcataacacaagcttcgcgcttcaccggcgttgcaaataatttccatcacgataagttcttgttccatttctctctcccgaagctaaggctgcccaccggcagccttaaactgcttatgccgtgacgccttgtctacctggttgcgctgctttgactttactttccacaggttgctcttgttcaagcacttgcttctcaaacattttgaagaaaggtaagtaaatgagcagatcaaggatgagtaaacccacgaccagcaacacaggcgtaaacgtccaaccactaccccatgacgcaccgataatggccggtgttgtccatggcgtggttgctactcccataccgacaaagcccaactgaatcgcaaaataagcaatggtggcattgattacgggagcgaaaacgaaaggcaggaataaaatcgggttcatcaccactggactaccaaaaatcacaggttcgttaatttggaagaatcctggtaccgcactcatacgaccgatgctttttaaatgagctgagcggctgaaggacatcaaaatcactaacgctaaggttgcacctgaaccaccgataaagatgtaaaaatcccagaatggctgtgtgaagatattcgggacgggctgcccagtaacaaacgcatcaatgttagcactgatattggttaagaagatgggagatagcagaccgaccacaatcgcagccccatgaatgcccgcaaaccataacaattgacacaccagcagcgcaccgataatcgctggcaatgtgtttgacgcactgatcaacggtttgaacatcgccatcacggcatcagggatcaacatgccatattcggcttgtacaaaaaggctcagtggataaagcgtcaagaaaatcgccaagacaggcaacaaaacttcgaatgagcgagcaatcgcaggtggaacttgctctggcatacgaatggtaatgttatgctttttcataaagcgatacagttcgacggcaaaaaaagcacacataacagccgtgaaaatccctgtgccgcccatatgcgccatcgatagactgtcttctttggcgggtgccgcgaccaacaaaaagctcatcagtgacagtactgcactcgtgataccgtccattttgtaagctttcgctaagctgtatgctacacccaacgagacaaatatggtcataatgcccatcgacatattaaacggcatcatgatgatatcgaaatgcgtcgtagcgaagtttaaccacacgcgaccaaaaacattggtggtatcttcagcaaaaggagggaatgcaaaaattaaaataaaactacccacaataataaatggcattgccacaataaaaccatcacgcatggcacgtacatgaggctgattccccacttttgctgcaatgggggctatatgcttttctacgattccaattatcgcatcataaagcttcataggattcaccttatatttaagataaagagttccctatcctcatttaattaatgaggattgagtgaaaatattgtccgaaaaacagatttagttaattaaatctaaagcttgctgaagaacctcgtcacctttcatcatgccgtaagcttgaggagagatagctgcaatgtttttgccatattcatcggccgttttgcgtagctcttccaactgaaaacggacttgaggccctaataagcaaacatcatattcttggatggcctcttcaaatgcattcactgataacgcatcaatcttgcattcaatgcctttactttcagcagcttgctgcattttcttcactaacatactggtagacataccagcactacagcagagtaggatctttttcatgctctacacttcccttgtttaaatatcgacctaaaaactgtagcaaaataaatccgcattaaaaagcgcaaccggttgcgttattcgtgaacaaaatcccatttcggatagttagcgctatttttatcgatgcacttctggataggataatgagaagaaatatataagcctaccagatggacttgttatttctatcaatataaatactagcaacgtcactcttaaatttctgatttaaaataatggatactaagatgaaattaaaaaaattggctctatttaccgcgatatcgttagccatttctggtcattcttttgcaaacagtacccctaagggcacgatttatttaacttttgatgatggcccggtcaatgcgtcagtagaagtcattaaggttctaaaccaaggcggggtaaaagccactttttattttaacgcttggcacttggatggtatcggtgatgaaaatgaagatcgtgctctagaggctctaaagttagctctagattcaggtcatattgtcggcaaccacagctacgatcatatgattcataactgtgtggaagagtttggccccaccagtggcgcagattgtaatgcaaccggtaaccatcaaatccactcgtatcaagatcccgttcgtgatgcggccagttttgagcaaaacttgatcacattagaaaaatacctgcctactattcgtagctatccaaactacaaggggtatgagttagctcgcctaccctataccaacggttggcgtgtcacaaagcacttccaagctgatggtttatgcgcgacatccgacaatttaaaaccttgggagccgggttatgtgtgcgatccagctaacccatcaaacagtgtgaaagcctcgattcaagtacagaatattcttgctaatcaaggctatcaaactcacggatgggatgtggattgggcccccgaaaactggggtattcctatgcctgccaacagcttaaccgaagccgttccctttttggcctatgtggataaagccttaaatagttgctcaccaaccactatcgaaccaattaactcgaaaacacaagagttcccttgtggcaccccactgcacgccgataaagtgattgtgctcacccatgatttcttatttgaagatggcaaacgcggtatgggagcgacacaaaacttacctaaacttgccgagtttatccggattgccaaagaagcaggttatgttttcgatacgatggataattacactcctcgttggagcgtaggtaaaacgtatcaagcgggagaatatgttctgtaccaaggtgtggtgtataaagcggtcattagtcacactgcgcaacaggattgggctccatcatccacgtcaagcctttggaccaacgccgaccctgcgacaaactggacactcaatgtctcctatgagcaaggcgacatcgtcaattacaaaggtaaacgctatttagtcagtgtcccacatgtttcacaacaagactggacaccagacactcagaacaccttattcacagctttataaaaagctgctcctatagccaacctgcagattcaagtagggatggtatctctatcgtcagatagtttgcgcggagagctctccgcgctttttttgaacattttggctaggaaatgattgatgcggattttagtttgcgccgcccttttgacaacgcataccgcgtattaagattggtgaagacgcttgctggaagccatgaactcaggttcggtttttaaccctttccataagctgacgcacatcagtagcaagatcaccgtaaatggcaaggctgtagagataacgcccgcttgcagcgcttgtaccgcttccgtgcctccaatccatagcagtgcaaccgcgactgcgccttcgagtactgcccaaaatacacgctgcaatactggtgaatctaatttgccgcctgaggtaatactgtcaatgaccagtgaacccgaatctgacgacgtgataaaaaacaccagaaccagcaccacggcaatcacggatagcaccttaccgaaaaccagcgaatcaaacatctggaacatggccagcgaaacatcggttaagccattttgacctaacacgccgatttcattaatcacttgatccacggccagaccaccaaataccgacatccacaccagtgtcactaacgttgggatcagcaagaccgccacaatgaattcacgaatggtacgtcctttagaaacacgtgcgatgaacatgcccacgaacggtgaccatgaaatccaccatgcccagtaaaagaccgtccaaccttggaaccacacttcatcttcacgaccatgaggattactcagcgggattaggttttgtaggtaagccattaaagtcgtcggaatcgaagtcaatgtgacgctataaccaatcacagccaccagtgcgagcaataaaaacgcgacaatcatattgatgttagagatgactttcaccccgccatcaatacctcgaaccacagacaatgtggctaaacctgtcaccacacagatcaccgcaatttgtagcccgatgcccgattcaaaaccaaatacatggtggataccagaagccgcttgctgcgccccaagaccgagagacgttgccagaccaaacagtgtggctaataccgcaagaatatcgaccacatgccctgcccaaccccaagcgcgatcacccagtaacggataaaaaaccgagcgcattgaaagtggcaagcctttgttgtagcagaaaaaagccaatgatagagcaacaacaccataaatggcccacgggtgaagtccccagtggaacatggttgctcccatcgccagttgcgcagcttgaggagtgttggcttctacgcccagtggtgtttcataccagcccgtataataggccacaggttctgcgacactccagaacatcaaaccaatccccatccctgcagcaaacaacatcgctaaccaagatagaaaagagtgatccgctttcgcggcctgtccacctaaccgaattttgccaaacggtgaaatgaccaatccgacacaaaacagtaggaataagttacccgaccagataaacaaccagtcgaagctcgcaataatgctctgctttacggtatcaagcccaatcttagcttggtgggcatccacgagtacggtcagtagtaaaaatgcagcaatcaaacctgcactgatcccaaacacgggattgtgtacatcaaacccccatttctgcacattatcttggcctacggtgtagtccgtattatcgatactgtacttatcaatttcttttgtcatgtatcctctctgagtcatttaaatcgagctcaacaacaatgacaacaaagcattttcggttttttaatcacaaattgctttgtactcattgttaattccattcattaaaagcacgattattttacatggatcacagaaaagatccagttttcaggccatttaagtcagttcaaggtagagaaacccttgtttatgtcaaaaaataatatcagaaactagtgaaatttaattcttattcaaagcatccatctggaatgcaaaattcaaaaaatgtcgcaataacgctatgggttactcttagctcaacactttaaaaatcaaggtaagtaaggtatggttcgcgacagattcagcacaaactgggtgaaccctctgtggaaaaacacgaagaagtattagtcgcactgcgccagatcatccgcgccattgacctacactccaaaaaacttaataaggacgcagggctcaccggcccccaattgattttgatgcgttcaattcatgacttaggtgaacaggtcaccatccgtgagctcgcggtgcataccaatatgagccaaggcacggctaccacgattttggatcgattggagcgtaacggctatgtacagcgcgtgcgcagtaacagtgataaacgcaaagttcatgcacacttaaccgatgaggggcgtaagctgctcgcacaagccccacagcctttacaagagagctttgttgagcaattccatcaattacaagattgggaacagagcttactgctctcttctgtacaacgcatctcagccatgatgaacgcgcaagatatggatgccgcgccgatgctgacgattggtagcatcacgcagccagaatagttcactccagtaaaccatgttgtagcgcgtattgagctaactctgccgtggagtggatgtcgagcttatgcttaatattttgcctatgggtttcgaccgtgcgataactgatattcagcaaggtcgcgatttttttactgctgcaaccttgtgcaaccatacgtaaaattgcctcttcacggcggctcagcgggtttggcttattcgccacaggtaaaatctcttggctaaacagtgtcgaggtggtggattcgcagaagtacgtcgcgccttgatgaaccgttttgatcgcttgcaccattttcagtgctgagatttctttgagcatgtagcccattgcgccggcttgcatcacttgcataatgtactcgcggttatcatgcatggtcagcatcaatactttggtgtgaggaacttcttctttgatcaagcgggtggcttcaataccgttcatgatcggcatactcacatccatcagcaccacatccggttggtgaagtttgaccaattctaaagcttccaatccattactcgcggtggcgacgacctcgatttccggctcttgctctaaacgcgcaataaaaccatccaacaccacctgatgatcatccaccatcaccactctgattggtttatccataaacacttccatccaacttcagtaaaaccgtaatttcggtgcccaattgtggctcgctgcttaattcaaattccccaccaataaactccacacgttcgcgcatgttacgtaaaccaatcccgcgtttttgcagcgcttctttgctggaaaatcctaccccatcatcacgcaccataagctgcaacatatcacccatttgctgcagtaacaccgtgactttctcggctttggcgtgtttttcaatattattgagtgactcttgcaccactcgatacaacgtggtggccacttccgattttagcttgccgggttgggtgtcaaacaacatctcgatctccatttgtgaatgcagtttgaaatcctcgagcagcgtcgtgagtgccgcttgtaaaccgagatcatccagcgcactggggcgcaaatggtgtgaaattcgccgaacttcattaattgcagtcatcaacgagtgctgggatttttccagatgcacgatctgtttagggtcgttcagttggttggccagtaactcaagatgacacttgctagacaccaataactgattaattccgtcatgcagttcgcgggcgagatgcttcttttcatcttcctgaaacaacacggttttgtgtaccaaatctttgagattcttatccgccaaacggtgttcatgcaggttgatggctaaggtcaacacaatgatcaccgctacagtgactatcaaaatcaccacaacagaaaagaaggtggtatcaatatttgcgttcactgccgcttgcatcttctcgacttcatgactgagatcttcaatgtacaagccagtgccgatcatccattcccagtcgtcaagccaagccgaatagctgagtttagggacagtttctccacttgagggtttgcgccacaaatattggtgatacccaccacccgattgggcttggaaaagtagcgcttggatgagaaagtcaccgcgttcatcttgcaactgccataagttttgccctaccagctcaggctggatcggatgcaccaagttcgtgccctgagcatcataagcgaaaaaatagccatcagatccataacgaatattggttaatactgctttgacctgctgtttggcttccgcttcacttaagttgggattattggcaatcaacctcaccgcatcaaacgccacctcgacgctgtctttgagtgaggtttcgcgctcttccatcagcttagctcggaagatctcaatttcacgctggcctaaggttttagcctgatggatcgaaatccaactgatgcttgctgtggcaattaagagaggcagtaaagccagcaaaatcaatttggctttgagaggcattccatttccccataaaaaaactgctttccgacccttcgaaaagcagtttcactctaacaacttgttgttgtggattgaatttcgatacgctcactcttgagtcggatcacattccataaaagcttgggaataccatcaacgaaatcaacaccaaaatctggatcaggataaagggcaccacgccgcgatagatgtccatggtggtgaccgactttggcgcaacccctttcagatagaacaaactaaacccgaacggcggagttaagaacgacgtttgcaagttcatcgcaattaagatagcaaaccacgtcatatccacatccatcagcacagcgactggagccaaaatcggtactatgatgaaacagatttctacgaagtcgataaagaaacccaggattaagatcaccaacatagtgacaatcaagaagccccatttatctccgggcagattcatcatccactcttcgaccagctcatcaccaccggtataagtgaacgccatcgagaacgcggtcgcgcccagcaaaatagcaaacaccatggcagtcactttgacggtttctttagaggcatcatagaccattgaccaactgaattgaccatacgccaatgccagtaaaatcgcgcccgcgccaccaagtgctgcggattctgtgggcgtcgccacaccagcgaaaatcgagcccagaaccaccacaatcagcgccaacggcgggataaccgctttcagtgctttcaccacttcttgacgacgtgataaatcggcatcaggttcaataggcatcgccgcttgcggattcagcttggcgtaaatcaggatgtagatgatatacgccgccaccagcatcaagcccggccagagtgcggcttggaacagatcgccaaccggaaccccaagcacatcccccaatagaatcaatacgatagaaggtggaataatttgtccaagggtccccgacgcacagatggtgccacacgccaaccctttgtcgtaacggtatttgagcatcactggcagtgagattagtcccatcgccacaaccgatgcccccactacccctgtcgaggcggcgagtaaagtgcccaccaatacggtagaaatcgccacaccaccgtgaatgccaccaaataagcgccccatcgactctaatagctgctccgccagcttggttttttgtagcaccaaacccataaacacaaacagcggcaccgccattaacacggtgttttccatgatcgattgaatgcggtaaggcatgaacgcaaacatctctatgccttcagcccacaaaccaaaaatcagcgcaatgcccccaaaggtaaaagcaacggggaaacccagtaatagtgcaaacagggcaacgaaaaacatcacaataccaatcatacgtttcccttacttagtttggtctgcatgcatcagacgtgggttaaacactttattgagcgagtgaatgatcaagccgacgccacttatcgccatgaaagtgaaagagagtgggatcatcgccttgataatccaacgatatggcaaaccacctgggtcaccagacgtttcacccagcgcgtagctttctttggcaaagtcgatcccgaaatagaccaccaacaagcaaaacggcaacaggaaaaacagagtgccaagaatgtcgatcaccgcctgtgctttcatcgataaacgttcatagaacagatcgactcgtacatggccgcccgctttaatggcgtaaggaataccaagcaaaaaaaccgtggcaaacagatgccactctaattcttgaaaggcgatagaaacatcgttaaaggcatagcgcatcacaacgtcatacacgacgttggccaccaacagaataaacagaatactggagagcaaccccagtagatcgctaagacggttaaataaccgctcaacataaatcagacttctcattacacactccctgtctaatcaaattgctccgtgtcacaaatgtgcacggagcttatcgttatgtgcttttcttgggcttcctgcacacgcagttcagcttatcattgtgattcgctattgaggtaggctcgcagcgaaatatctgtccaactacgtgtttgttttagatagttggcttgcgattcttggatctctttagccagtggatcttctgctgcgtgtttcgccagtagtcggtcgttaacctcacgcagggctttaatcacaggcgctgggaaggtcttcactttcacatctgggaactcttgggtaatcgaaacccagtttttgccactttcatgaactgattgaacatacatgtcgtaagcggctgtgcgcattgcaacacgtaagatttcacgcagatcttcaggcaatttatcccacgtcttttggttgactaagaattgcagctcagttgctggctcatgccaaccggtgtagtaataaggcgcaatcttgtggaaacccatacgtaggtcaagtgacggtcctacccactctagcgcatcaatcgtgcgacgctcgagcgaggtgtatagctctcccggagcaatgttggtgggtttggcaccgagctccgctaacacttctccggcaaaaccgggaatgcgcattttcagcccttgcagatcttcaacgctgttgatctctttttggaaccagccgcccatctgcacgtcggtgttaccaccggggaatgagagcatattgtgtggagagtaaaccttctccatcagttccataccaccaccgtggtagaaccatgcgtattgctcgcccgtcgtcataccaaaaggcatagaggtaaaatacaaagtgttcggaactttgcctttccagtaataagacgcggagtgtcccatgtcgtattggcccgatttcaccatatcaaacacacccagtggcgctttatgtttattggcagaatcaatgcgaatttgtaaacggccattggacattttctccgccattgccgccatattctttgtggtgtcgccgaagattgggaagttaggtccccatgtctcagccagtgttaaacggtaaactttctcttctgcaaaagcggaagttgtgagcagcgcaacacccgccgcaataagcagcacgcttcgcttcataactcgtgatacagattgatgaatcagactcatggtttgacgtccttggttatccatacctgcgcaccctgcaacaggctcgtcaacaatgtggtcgatattcgtaagacaagaaatcggcgagaccacgcagccaagtaacaccctaaccgcacgatttagccattcgtcttaagtattactatgtaggacaaaaataaaattcattgaaaaacaaaaggataaaaaaagattaatgaatatatgatagggaaatacgtagtcatttctacgtgagaggattttaaagaaaagagtaaaaaatgtgacaaaggcatagctatcactttcaagacgataacagctcaagtgaactaggagccagtagataccttggtcagcagtagtaaagctccgatagcggagctttacttagaacttacaccgccagagtgtaagtcactttattgccgacttggtttttctcaaccagcttttcatcgagcagtttttttagcgcgcccgcggcccatgcagaagctttcgcttcctcttggcctgcctgcaaaccaatcgctttggggttaatcccctcaactgcgccacgcacaatctcgaggacttgctgctgttttggcgtcagttgacaagtcaccgttggcgttgccgcttgctcagattggtgtgccgaaagggcctttgagtgcacggattgcgcaggttgctgcacagaggtgctcgattttaccgtcgcttttaccgtggcaaggttagcaacgatcgctttaatgcgtttttgcagcttagcctgcactttacgcttatgagctagtctcatcgggtcggtctccatttcactgcccaaaggcagtcataaaattttgaagcgcgctttatagcaaattacgttcgacgtttgtagggatgaggtcaagttctcagcgacaaatgatctttagcccgcttagatgactataatttgggcgacacggccaaagagtgagaagggcatgcccactttgcaactgtacaatcatcagatccatttcacgcctttcgtgataaagggactgttagccttggctggccttatcactttagtagtcattggcatcgccgaatcccttttgcaagccgtggtcggaatactcgcgctcatggcttgggcaggcattgcctactggttgatgttaaaaggacaagtggcttacacattaacggcaacccatctccagcagcatttttatcaaggcggttgggtggtgaaatggaataatatcagccagattggtgtttgcagttacgagcgggaaggctggcatcaacctctaccttgggttggcattcgtcttaaacattacgcgccctacctcaacagtatttgccctcgcttatcgacccaactgttgctcagtcaacgcgccttactctatctcggtgctcaacaaaaagcgcggcatcatcaatttgaagatctggtattggattccacaccctatgtggacgccgagggtaaacaatacaccggactgcaagccatgctggccaatcgaatgcagtatcaacgtgacttctttggttacgatatttttatttcagagcaggacttagatcgcagtgcagaagagtttgtcggattggctcggcgctatcttgccgctgccgagccagaggatcttcagtagagcggcatttcgtccgcgacaaatgggttgctggcacgttcacggccaaaggtagattgggggccatgaccggggatgaaggtgacatcgctgccaagcggccagagtttatttttgatagacgcaatcagagtattgaaatccccttgcgggaaatccgtacggccaatactgccgttaaacagcacatcacccacaaacgccaaacgtgccgcttcactaaacagcacaacatgacctggtgtatgtccgggagtatggataacttgcagagtttgctgaccaaagtggatcacatcgccatcatcgagccactcatcaggttcaaaggcttccgtaagcggaaagccaaacattttgctttgcccttcgagcccttgtagccagaaattatccgctttgtgcggcccgacaacccgagttccaccgagagcttgcgccagtgactgcgtaccaccaacgtgatcaaggtgaccatgagtcagtaccagttgggttacttttacgcctagctccgcgatcaacatcgcgagctgtttcacatcaccacccggatccaccactatgccttccatggtttcatcacaccacacgatagagcagttctgagcaaaggccgtaacaggcaccacctgatattgtaaagacataaacctatcctgtctgattcttaactggcaggcactatgtcattaacgcccgcctttgacaagttaggcaccgacccattggcgtacagggccggtatcaatgtggataaattggcttttcggatagtaaccaacaccgcccgcttgcaaactgatcgccgcttcacggattttctttagcgacacaccatccaaacggaaatcgatggcctgcccagacatgtggtaacttttcttcgccacgccttttgatttactgcgtagctgcttgttggtcgcgggagagcggtaaccagagacaatatgcacctcggcttgagtgccaagtagcaattggatttggcacagttgatcaaacagcaacttatccatggcatgcacttcgtcacgacgaaaatcacggcataaatgattcagccgtttcaattcagaacgaacgtaatttttgccattaaaatagcgcgtttcaatgctttcgcctgtatgtaagttgcttaatgccaattctcttggcttggcggcataactcgcgaacgcgatgctgggcgtacaggcggctaaaattaatccgcccgcagtcagttttaagaaatctcgacgtgttgtttgcactttaattacctaccgaactgggctctatcgatacggaaagtaccggactctgggttcgatatcaaatgcataaaacgtgctaactatcactgattctagagagaatctcgcttattccttgagcagaaaggaaaaatatctgctgtcaaattttagtcaaatttggagacgcgtcaccattgccgagtgctaaagcatcatagtgataaatatcatcacgataatgcagcacaccttcttcataccacacggtctgatagatgatgtggactggaatacgctttttgagcgcaatcgcttgggtgctcactggaaaatcgtcgagcgtaatgccctgattagcgagcaaggtttgcgcaaacttttcagcgttttctacccgaatacagccagaactgaacgcccgagacgcgttattaaatagatgcttgctcggcgtatcatgcagatagatagcgcgtgaattgggcgtattaaacttataggtcccaagcgcattttgcacgccagcctgttggcgcagacggtatgggaaggtttccggttcaacggcttcccaatcaatcagcgcagggtcaatcacttctggatcgctccaaccacgaatgatttccatatgatgattggcgagatactcactatcacgtttcaccattggtaggatatcttccaccatgattttatgcggcacattccaagttggattgatgatcagtgaatcgagtttggtattcatcaccggtgtcggtctggtggttttgcctaccaccaccttggattcaaagacttcgcggccggcatcccaatacttcatatcaaaaccgggcacattgaccacaatcatgctgtcttgctgggttggccataagcgaatccgctctgcattaagcgctaataaggcaaggcgctcagttacggatgtgttcaaccacttcatggtttgtgggccaatcacaccatcagtctgcaagccatgcatcttctgaaactgcttgatcggtttttcaagcgaggcgtcgtaataggccacatcattcaagatggatgtggtatccagattcaccagagctaaacgctgcactaaagcttcacggtgacttaatgggtcacccggacgcttaagccgctccatctgctcgtatagtgccacctcattaaactcaatgctcgagagtgattgatacgcttgcagcagttgttgataagcagggtcttgtggggtgtattcatccattaagcgagcgagcgactggttaccgatcgccatatgcaaagccagttgcgcctcttcactcggcggagcaagaggttgatcaagttgaccttcaaaaaaccaagcaataccgacttttggtgcctgctcagcatagctgaggtattgcagtaaagtgtcggtcgctaacacatcatactcatgccatctatcttgctgacgatagcttttgagcgcgaaaagttgtcggctaaataaagggctgaaactcgcacggtgaatcacctcaagctgagcttcaaaatggttcgctgtggcaagatcgctccacagtaactgatcattgttactgtgatagatttgctcaaccaaagccgggttggtgatctgttcattgaccggcgaagtgctatcaatccaccccaattcaacaaaacgctgggtggcagaacacggaataacaaagaataacaatgcgatagcggcaacgactcggcttttcatcaaaacgccctactggctgaagatgcactaagtatggcaaaactcagccgcaaaattaagctattgataggactattttcactcgtgtctcatctttatcgtcggtcgttctattcccaaacgaatgagcgttgcaggatgatggcaagcaaggcggcggcaagtacgttcatccccataagcccagagagactatggggtgaacaaacgtggccaacgccgctgccacatcaagtaggagggttatgcctagatcgctgaccaatggttgtcccacatcacattgctcatatgcgattgcgagagctcaggtgcagattgcaaaatgattttgcccgaccccgaactgatttgaaaagcaccatggcgaacaaccacgccggaagcatcggctaaagcggctaattccaccaattcgcccgtggcttttgaccagatcccatagcaattcccggggggagaggtggcaagaatccactcatcggtcgccgcaatactggcaatatagtgattaaaacgcgcccactgctcaggctctgcttgtaatggcttaagcggaccagtccccgtgtgcatggcaactaagggaggataatcgtctggctggccgcgatattgctgaccacacaggactgtgttatccccatcatgagccaaatgacggatgctcagatggcgatcaggtaaagtgatttgctccagtacctcaccttgcgctgagaggtaagtcaaacttggctgcatactctctagatttaacggctcacggccaaaagtgtggacgccaccaacccccacaaccaaacgaccatcggccatcaagatcacttcgtgaggaccaatcccaaaaccgctccattccgcgactttttgatagtggtgagtcacatcataaacgccaatcacaccacgactggttttctgccccccttccgtggcatataagtagcggccatcatgtgaatagacaccatgtccgtagtagtgacgctgcgtatcggcgggacgcagcacaatttgctgagccgtttgataatcaaacaccgacataaactgaccggggcggcgtgcaaaagccaccgcatgcggcaacgttgggtgaatggcaataccatgccctcgagcaggtaaggcaagcttaccaaccgcctgcccagcgttatctgccatcactacactaaagcgttctcgcccttctattgcacagccaatcaaggctggctggggcgatcgcgcagagctacaaccgctgattagccaaggtgtcgtgcagccaaaaagcgccacttgcaataagtggcgacgtgttgcatcagtcaccatcggttgcattaaaccctatgaccacaccgagtcccacagccacttcgtcgtgcagcaaatagttcagttgctcgagcttgtcgcgcaaaactaaaccctcgcgataccccgctttggtttgcagcaaatcaaacaggcttgcttgttgcggccaagtttcgataatcccggccaactgcgtggtgacgcgatccgccgtggcaaccataccttgttggcgcagcatcgcatccatacctttgccatcggcaaggtataaggcttgaatcgccaacaagttataacgcatattgctcagcgaggttttcgagcgccacgactccgagaaataaggccgtggctgaccaatgttggccagcggccgattgagcttagagagcgtaaactccaactgattggaaagcagcgcgatgtactccgcacgccaagtgcgatcatccaaagattgccatgggttctcttgccaagccttagcaatgtgagtggcattacgctgcacagtcgcactgatagccatcgcggctggacaagcttgctgcggtgcagtcagcaaaggcgatgcgctatcgaaaatgagccattccaatgcccccaacccttgcactgccacactctgttttgcaatatcgtcgacttcccatactggcggtttggcgagcagctgcttcattttatgcccagtcgtgtcttttttatctggccagaattgcatattccagctcaaatctaatgcggcactcggcccacgctgctgtccttgtaaggccatccaaccttgcatgctggcttgccactcttgtttcagtgctgatatatccgtcgtcggcgcttggcaatagtgagccatacgctgctgtaactgcttggtttgctcagcgagaaggtgggcagattcacgctctagctcgaataccgcttgactaggatgctccatgtctggagcactctgacacgcagccagtaaagacaccgctagcagagtcactgtttttttcatctttctctcctagagtgaattcaaaaaggccaccagcgcttcacgctgcgctttatcaaactgcagtaccttatcgcggctcgcctgcgcttcaccgccatgccacagcaccgcttccagcacattgcgcgcacggccatcatgcaagaaataggtgtgtccattgacttcttgggtataacctatcccccacaaaggggcagtacgccattcacgcgcagatgccaaggcctctggacgaccatcactcaagccttcgcccatatcatgcagcagcagatcggtgtacggctgaattcgctgcttggaaagcgcaggacgctcagccagctcttgcgtcaacacattggttttatggcaagattggcaacccgcttgagcaaacagtttttcacccaattgcacctgaggatcttgcacgttacgacgcacaggcaccgctaagtgctgagcataaaactccacgaaatccagaatgttatcgcttacttctggtgagccgccattcggtaaatcacggcagagtgtctgtttttcggtgcagttttcttgcggaaagagatgactggttaatcccagatcgccgttaaaggcagccgcattttgctgcatgatgttgggttggcccgctttccagccaaaacggccaatcgccatttcgccagtgcgtacatcgcgcacttggttaacgcggccggaaataccatcgccatcgcgatcctcagggtcagcccactgtaataaggtcgcatccgggatcgcttctaacagtccaagtccaatcatcggcggtgcaacccgcgccgacatttgcacatctgggtgcatctcaccataagcgagatccaaaatctttaggttcggtttccgaagtgccacaggagtaccatcggcaaaagtgacgaccacttcatcatacgtaatgtggattcgcccttctggtttttggtcgggtagcgaaaaatcttgtagctgcccgccataagtcggctctggcactacgccattgaccgcatagatggctttttgctgctcagtaaccgcaggaatactcaaacgcaccagcatggaaaccgcttgggtgtcattaggctctggtggatggcctcgtccgtctttaatgtggcaattttggcagccattggtattaaaaagaggtcctagtccgtcgcgcgcatccgtcgaagcgggagcgggaacccaaggattgcggaaaaagctgttaccaacactaaaatcaaggcgtttcgccatcggcaaattcgcggccggcatcgaaaacgcattggctccctctttcgtggtactggtttccccacccgatttaatctctgttgccaaagcaaagttgctcaaggcgctcgtgagtaataacagagataaagacgacttcatgacatggttcctgtaaaaaaacgacccaatccctgattccctttaccgtataagtagctgcggaattgacgctgcataccaaactattgaggaattatcatcgacgtaaagcgagattgggttttattgcaaaaataagttatccctttctccatgcataaaccaaaggccattgcgcgaagaaagggatgaggacagtgacgagattaaaactcgtgatctgccgtatccgggtttagattatcgatcccgatgatgcctgccgcgcgctcaatcgaacccgtttgcgcgacgagcgccataatggcttgattgataatcgcatgccctgccgcgttatctgccgcgatcagttgatcaaagtgctggttatttttttcagctgccgtgactaactcacccacttgcgtgcgcgccgcttcaaactgttgcaggatctcttttgcagcattggcatctttctctgcaaccaattggtacagacttgggccttttagctcagaaccatcggcgcgagtgtagctacccgtgtagatattgtagataccttgttcgttgtagtagtgcgagttatgcgtgttatccgagaagcaatcgtgctcatcttccgttgaattcgcttccaacgcgactttcatacgctcacccgccaattcccccagtgatagcgagcccataccaaacagcattttgcgcagaccattttccgccgactcactcagcagttgttggcgataattatctttttcaccactcgcccactgcttctccatccactcaagatcggtcaccaaaagttgcgcggcggctttgaggtattgtgcacggcgatcacagtggttattggtacaggctttgccttgcagataatccgtgtatgagcgagcaccggcaccggctttggtgccgtttaaatcttgtccccacaacagaaattcaatcgcgtggtagcccgatgccacgttggcttcagagccaccgatttcgttgaggctggccagcagctcaggcgtgatctctttcacatcaactttcgttgcgccaatggtcagtgcagtattggcaatgatattggcatttgcgccttcattgcccagttcatgttgataacttcctgccacataatcgatcaaaccttcatctagcggccacgcgttcaactgaccttcccagtcatcgacaatcgcgttaccaaaacggaacacttctgattgttgataaggcacacgcgccgccaaccacgcttgtttcacttcttccagaccttgtgcggtcggagcttgtaagaaacggtcgatggttttttgcagttgctgcgcagtcacacgtgaatcggcataaacggcatacgcaatatcggcataatgttcaaccacttgggcttgagttggcgctgcagcgaagctcgctgatgtagtgagcgtcagtgaagctaagatggtggaagagagaatagacttaacgttcatggagcgtccttgttgagcttgatatgaattgcaaattattatcatttgttatttcggtgcaaataatacaaatttacaattttttttcaacctgaacacacaaaaaaccccacaagtgtggggtttaataacatgcgatattatcggcagcaacgcgaatctatttataaaactgaaggttacagtttgagttgatgcttaccgtgagaaactttggctttcaggtaattttcattaccgtctttgatgtgtgccgaggtatgaaccacctcgacaatctcaatgccatgttcttgtaactcacggatctttttcggattgttcgtcaccaaacggatcttcttcacccccaaggcttgtagcatttgtgcggcttccgtaaagtcacgcagatcatccccaaaaccgaggtgattattggcttcataagtattcataccctgactttgcaagcgatacgcatcaatcttgttgtacagaccaatacctcgcccttcttgacgtaaatacagaatgatgccgcctgactgccccatgcgagtaatggtttcttctagctgctcaccacagtcacaacgagacgaatggaaaacatcgcccgttaaacactccgagtgcatacgcacaagcggggcttcttgggtggtatccgctgatttgaaaatcactgcaacgtgttctttgtctgattgcagtccatgaaatgacaggatttctgcgtcaatattgcttttcgcaccgactttaaaatcgactctggctcttacttccgccatgtttgcactcacttgaatttctgtaacgggatgcacgtttctcaacatttgcataacttgtctctactagtgacctaactatgagggctcataccccttttttcaaagaaaagatcactcgaaggcttaaattgttatgttataacaaatgcctttttgagcaacaaaaaacccaaccggagtgggttgggttcattcaagcatcaaaatagggataaaaataatcagttttgcgacttcttccagacgctcaactcaatccagatttgctctaattgacgtaactcttcatcggttaataccgagagtgtcggttttgattgtggcgctgaatgagcttgcaacgcgctcaactgcgcgtagaactctttcttcagctgggtaacaaccgaattgtccacctactctctccacaatttcatccatttcttaaaaataataccttctttcataattatttcttatcacgcaataagatatggaagtatggtcacataatttttacactttagagaataattacgcagcgagtaccttggcgaatacctcaagcgatcccaacgcaacgcatttttctttgcccttaatgaaccgagactccactttgcaccgcttcggttggtattgctttgcgctgcagttgactaaacaacgccaacagcagtaaagcactgaaagcaccagttaaagaaacatacaaggtactgaaatagttataaaactcaccgactacgccaaccgataagctcgccaccaaagtactgatactgagcatgctcgaaaataaggtggaagccgtgcccaatcggtcttgcatcatgtcctgcagcaccaccatgcctagcgtcgcgcatacgccgataaaaaagccattgagcacttgcgcggccatcatggcaacaaacccagtgtgggtcagcatcacaccgtaaaacaagatgccgctggtgatcccaaacatcagcaatttatttgttccccatcgctcggcaagttttcccgccattaacatgaccggaatttcacacaatgcggccgtgccaaacagcaaccctagccaatgttcaggcaccatcaactcacgtgataaatagagcggcatactggtgatataaagattgtttgagccaaaagtacataccaaggtcacgcagtacagtacgatcaaagcacgcttacggggtgaatattgtccaagttcgactggcgtggttccaacggctgaggcggttttcacccctgctggcaagaagcgagcaatcagcactatgcctaaaaatactatcagagcagacaccgcaaaggcggcattaaagccgaaactggctttaagcataaacgccgccggagggccaaatacccaagcaatcgcaattccggcacgcatggtagagaggaaggtcgttttatcagttaaatgctgatcggcgtattcgcggccaagcgcaaaaagctgaccaaatgacgcgccactcacgctagcaaacagtaccaccaccatgatggcgagactgtagctgcgaataaacataaagctgaccacagtgatgagataacagattaacgaaaccaataagatggttttacgctgccaatgacgatctgattggcgtgcaagccactgcgacacgataactgagctgacgactgccaacaccatatacaggctcagttgcatcggtgaagcatcgagcgcctcaacaataaacagactggagagtggatagaaaaacgctccgcatagacccgtaaccagtgtcgacataataaacagtaaggcggttttatctcgatacatgcagtaacctcatagcaatattcgatggaatccccttcctacttggcagcgtcgctttatccctaaacgacttagagcatcaggggggattatggcggctagtgtactgaatctgggcatgagttattgatgttattcgagccagttctaatactattcaggcaaaatcacttgatgatttgacagaaaataagccattcctctagtctatctccatgcattgagcgcatgaaaactcacgtaaatcgttatgcgacctttaattgaaaatgtgatgagcggtattagtcaggattgggtgctgcgtgaatttcgcagcaagagccaaactcaagaattttcctgtccttggcactaccacaccgaatatgaattagtgctctaccagaaccctgatcagcgttttgtcggtaactattttgcaggggatgcgattggcgcggttgagcacaacacacttttactttacggccccggtttaccacatatgattgcgggtagacagctgatcaataaagcccaaactctgcactcaacgattatctggttcaaacaagagtggctagataagctacagagcgtattgcctcaagctcaagctttgcaacgcttgcagcaacatgcctcctatggcgtgcgtctcagtgagcaaaccgctacgcgcgtcgccgaactcctagccaatgttgatcaacagcctcacagttaccaatctctgcgcgtgattgagtccttgcttgtgatggcggacgatgcgcaggcacagcgtctatctgtcgcaccctatgtgatgacggcactcaccagcaacagtgacacgcataagaaaattcaactggccaaacaatatgtggagcagcactacgcacaagcaataaaaattaccgacttatgtcatcagttacatttgagcgaaagctcggcgtatcgcttatttgaaaagcactatgggatgagtttttctgagcatttaaagcagtttcgaattggtaaagcgtgtgagcttttagccagttctgcgctgccgattgcattaattgccgagcgaactgggtttggcaatttgtcgaactttaaccgccaatttaaaaccctcaaaaccatgactccgagagagtttcgccaacgatttcaagcagtaagtgggtagcaaaacggccacccactcacgactcgttagcctttctggccgcgctgcgccgctttgcgcgccagcttttctgcgcggcgtttttcaatcagtgccgcactctcttcaccgatatgactttcaccacgcagctttgctaactgaacttgcttttcacgctcacggaaacgctctagctgctcttcggaatgagtaccaaaacagcgcggacagctgacgccttgttcatactgttcgctctgcttatcttcttctgtgataggcaaacggcaagcattacagatttgataatcactttcggcaaggccatgccctaccgcaacgcgcccatcaaacacatagcaatccccttcccacaagctttgctcttgaggcacttcttcaagatatttcaagatgccgccttcaaggtgatacacctcttcaaagccttgctctttcaaatatgcggtggatttttcacagcggatcccgccagtacagaacatggcgactttcttgtgcttttgcggatcaaggttttcctgtacatagtgtggaaactcgcggaacgtctccgtttttgggttgagcgcgtttttaaaggtgccaagctgtacttcgtagtcgtttcgggtatccaccaccaagacttcaggatcggaaatcagcgcgttccaatcttgcggcttcacataagtgcccactacatgacggggatctatgccttctacgcccatggtcacgatctcttttttgagtttgaccttagtgcggttaaacggtggctcagaggcagaagactctttatacacagtgccttttaaactcggttcgttttctagccacgccagcagcgcatcaatcccttggcgagaagaagcgaccgtaccgttaatgccttcttgcgccagcaataatgtgccgcgaatgtggttctcttccatcagtgccagcagcggcgctcttagctcttggtaatgattgagctcaacaaatttgtagagcgcacagacaacatattgactcatggtatgacctttcaattacaacacctataaattgggcgggcattatacccaagcaaaccgatgacaaatacggagtgtttttgggggtatagcgtctgatgcgatcaatagtactgctatctaggcataggcaggatcaaaaaagccggacgattgtccggctttgattaggcactttatgaatttccctacccaagggtgattaggcaggggtatgacagagcaaattactcttgttcaccatcatcatcttgtgcaacaggtgcatcgttctcgacaagtgcttcctcaccttctggcaattccgactcttcgatttcatcgatacgctgcagacctaccacactttcaccttccgaagtacggatcagggtcacgccttgagtattacggcccacttggctcacttccgccacgcgagtacgtaccagtgtaccggcattggtgatcatcatgaactcatcaccctcggccacttgtactgcacccacaacgctgccgttacgctcagagactttgatcgaaaccacaccctgagttccacgacctttggttgggtattcagataggctggtacgtttgccgtaaccattttcagttacggtgagtacgtcaccttcggtcttcggcacgatgagcgataccacttggtcgccatcagccagtttcatgccgcgaacacccgcagcggtacgacccattggtcttacgcctttgaacttgatctctggctggccattttcatccagcacaggttgaccattttcatccacaaccgcggtttcttcggactctttaaagcgaaccactttaccgaatttagagaacagcataatttcgctttcgccatcggtgatatccacaccaatcagcgagtcttcgtcacgcaggttgagcgcaatcaaaccattcgcacgaacgttggcaaactgatccagcgatgttttcttcacagtaccgtcaccggttgccatgaagatgaatttatcttcactaaactcagtcactggcagaatcgcggtgatgcgctcgttttcttccagaggaagcaggttcacgattggcttaccacgcgcagtacggctggcgagcggcagttggtataccttcatacggtaagttttgccgcgagtcgagaacagcagaatgttatcgtgagtattggcaaccagaagacgctcaatgtagtcctcttctttcatcttggttgcgctcttacctttaccaccacgacgctgtgcttcgtagtcgctcagtaattgatacttcacataaccttcgtgtgacagagtcacaaccacatcttcacgagcgatcagctcttccatgtcgatgtcgtgcgttgctgccgtgatttcagtgcggcgcgcatcgctaaagccagcgcgaatcgcttctagctcttcacggatcacttccatcaagcgctctgtgctcgccagaatgtgcatcaatgccgcgatttcttcgagaagctgcttgtactcatcgaggatcttctcgtgctctagaccagtcagcttgtgcagacgcagatccagaatcgcttgcgcttgttgctcagtcaggaagtacttgccatcgcggatgccgtattgtggctcaagccactcaggacgcgccgcatccgtacctgcacgctcaagcattgccgcaacgttgccaagatcccaaccacgggcaattaagccttcttttgcttctgcaggcgtggcggcacggcggatcagttcaatgatttcatcaatgttagccagagccagtgccaaaccttcaaggatgtgggcacgctcacgcgctttacgcagttcaaaaatagtacgacgagtcaccacttcgcggcggtggtcgacgaaacacttcagcatctctttcaggttaaacagcttaggctgaccgttatcgagtgccaccatgttgataccgaaggtggtttgcagctgagtgttggcatacaggttgttcaaaaccacttcgccaaccgcatcacgcttacactcaatcacaatgcgcataccgtctttgtcagactcgtcacgcagtgcactgatcccttcgacttttttctctttcaccaactcagcgattttttcgatcaagcgcgctttgttcacttgataagggatttcgctgacgataatggtttctttgccgttcttatcggtttcgatttccgctttcgagcgcatgtaaaccttgccgcggccggttttgtacgcgtcaatgatgcctttacggccactgatcagcgcggcggttgggaaatctggaccaggaatgtagtccatcaactcatcaatggtgatcgcttcattatcgatgtaggctaaacagccatcgatcacttcacctaaattgtgcggaggaatgttggttgccatacccaccgcaataccagatgcgccgttgatcagcaggttcgggatctttgtcggcaataccgcagggatctgctcggtgccgtcatagttcggaacgtagtcaacggtttctttgtctaggtctgccaagagttcgtgcgcgattttcgacatacgaacttcggtataacgcattgccgccgcggagtcgccgtcgatcgagccaaagttaccttggccatcgaccaacatgtaacgaagtgagaaaggctgcgccatacgcacgatggtgtcgtaaaccgcaatgtcaccatgagggtgatatttaccgattacgtcacctaccacacgggcagattttttataggctttgttccagtcgttgcccagcacattcatcgcgaacagtacgcgtcggtgtactggtttaaggccatcacgcacatcaggaagagcacgacccacgataaccgacatcgcgtagtccaaatacgaactgcgtagctcgtcttcgatgtttacgggcgtgatctctttagctagatcgctcatagagccattatccctctatagtttgatcggtatacccaaattcttactgaaacgaagctcactacaagattgagcgccaagtcagtcgagaactggatattcttgatacttataaggtgaaaaaatataacacatctttccacgcttcggcattactttccctgaccttttatcaggttgtgaccttggttgcgtcttaaatgccgagaatttacacattccttgcacttggcaaagttagatggttgttttttaaacgctcatcgtcaaatctggcatctcaactggtgcgatttactcagcgcgctataatgcccactcttcacggatgcgtaacacaggcgatacaagatggcttcaatagacttggcttcgacaccactgacagcaacacagaacgtcgatcctaatgaaatcaaaaaatttgaggatatggcttcccgttggtgggatctggaaggcgaatttaagcctttacaccagatcaaccctctacgtttgaactatgtgctagaaaaagccaatggcctgtttgggaagagggttttggatgtcggctgtggtggcggcattttagccgaaagcatggcgcgcgaaggcgcacaagtgactggtcttgatatggggaaagagccgcttgaagtagcacgtttacatgcccttgagacgggtaccaaactcacctacatccaaagcacggtggaagcacatgctgaggccaacccgcacacctatgatgtagtgacttgcatggagatgctggagcacgttcctgacccactttccgtgatccagtcttgcgccaaactggttaagcccggcggccatgtgtttttctcgaccctgaatcgcaacgtcaaatcctatctatttgcgattgtgggggctgagaagctgctgaaaatcgttccagaaggcacgcatgaccacaacaaattcattcgcccttctgagcttttgaagatggttgatcatactgcgctgcaagaacaaggcatcacaggtttacactacaatccgtttaccgatacctatcgtttagggtcgaatgtcgatgtgaattacatcgtccatactcgccttttttagcgcatactccacgctaaaaaatcgatgcggtagcacaagttaccgcgcttttttagcctatttttcgtgcgtttgattccattttaaacgatccatttttagggtgaatttttccttaaagatcaagaaattttttttcgtttgtggttacgaataaagcgatgtgcaaacggcgattttttacaatcaattctgctcttagatcatcagtaagtaggtactaactgatttttttaattttgctagttatccacaaaatgtcccaaagctgtaacttgcaataccgatgctatagcactatcttgtaacccgaacactgaagcacccctacatatagtgtttatgacactatatgtagggcgagctcgatcacaaaagcctcgattcaatttacaagatttagacaaaaacacggcttttatcagttttgttagggaaatgaagcagaatgaaccaacaacttactgtcaccaagcgtgatggccgcaaagaaaacattgatctggataagatccaccgagtgatcacttgggctgccgaaggtctgcaaaacgtatctgtctcacaagtagaactgcgcgctcacattcagttctatgacggcattacgacttcagacattcatgaaaccatcattaagtcagcagcggatttgatctcagaagagacccccgactaccaataccttgctgcgcgtcttgcggttttccacctgcgcaaaaaggcctacggtcaatacgagccacctacactgctcgctcatgtcaccaagatggttgagaaaggcaaatacgacaagcatttgctcgaagactatacccgtgaagagctggagctgatggatcagttcattgatcaccgtcgtgaccttgatttctcttacgctgcagtgaaacagcttgaaggcaaatatttcgtacaaaaccgtgttaccggccaaatctacgaaagtgcacagttcctctatattctggttgcggcttgcctgtttgcgaagtatcccaaagagacgcgccttgattacatcaagcgtttctacgatgcgacgtcgacctttaagatctcgctacctacaccgattatgtcgggtgtacgtactcctactcgtcagttcagctcttgtgtactgattgaatgtggtgacagccttgattctatcaatgcaacggcaagctcgattgttcgctacgtttctcaacgtgccggtattggtatcaacgcaggccgcattcgtgcgctgggttcggaaatccgtggtggtgaagcgttccacactggctgtatccccttctacaaatacttccaaaccgcagtgaaatgctgctcgcaaggtggtgttcgtggtggtgcagcaaccgtattctaccctctgtggcatggtgaagcggaatctctgctggttctgaagaacaaccgtggtgtagaagagaaccgtgttcgtcatatggattacggtgttcagctcaacaaactgatgtacaagcgtctggttgaaggtggcaacattaccctgttctctccttctgatgtgccgggactgtacgacgctttcttccaagatcaggatgagttcgaacgcctgtacgtgaagtacgaaaacgatccttcaattaagaagaaaaccgttaaagcgctggaaatctttactctgctgatgcaagagcgtgcttcaacaggccgtatctacatccaaaacgttgaccactgtaacacgcacagcccatttgatgcggcggttgcacctgtgcgtcaatcaaacctgtgtctggaaatcgcgctaccgacttcgccactggcgaatgtggaagatgaaagcggtgaaattgctctgtgtaccctctctgcgtttaacttaggcgcgattgagtcactggatgattttgaagagctgtctgaccttgtggttcgtgctctagatgcattattggattaccaagactacccactgcctgcggcacgtcgttcttcaatgaaccgccgtactctgggtgtgggtgtgatcaactacgcttactacctagcgaaaaacggtgtgaaatactctgacggcagcgcaaatggcctgacgcaccgcacgtttgaagccatgcagtatcacttgctgcgcgcttctatgaagctggcgaaagaacaaggtcgttgcccactgttccatgagaccaactacgcgaaaggcttgatgccaatcgatacttataagaaagatatcgatctggtgtgtgcagagcctctgcattacgactgggataagctgcgtcacgagatcatggaacacggtctgcgtaactctacgctgacggcactgatgccttctgagacttcatcgcaaatctctaacgcgaccaacggtattgagccaccacgtggttacgtctcggtcaaagcctcaaaagacggtatcttgaaacaagtggttccagaattcactcgcttaaaagagaactatgaactgctgtggaacatcggctcaaacgatggctatctgcacttagtgggtatcatgcaaaagttcgttgaccaagcgatctctgccaatactaactacgatccaagcaatttcgattctggcaaagtaccgatgaaaaaactgctccaagatctgctgacagcgtataagtttggtgtgaaaaccttgtactaccataacactcgtgatggcgcgaaagacgagcagaccgatgctacggtgaaagtgcaggaagacgattgtgccagcggcgcttgtaagatctaagcgcctgcttctaaagcacaacacgagaaaatagtttaactctttgatttgcatgcctcttgcttaggcaagaggccaaacggatgaaggcaacaatggcttacagtacttttacccaaaagaagaatgaccaacttaaagaacctatgttccttggtcagcctgtcaacgtcgcacgttacgaccaacaaaaatatgagatttttgagaagctgattgaaaagcaactctccttcttctggcgtccagaagaagtggatgtatccagcgatcgaattgactacggcaaattgccggatcatgaaaagcatattttcatttctaacctgaaataccaaactctgctcgactccattcaaggccgtagcccgaacgtcgcactgctgccactggtttcactgccagagctggaaacgtggattgaaacttggtctttctctgaaaccattcactcacgctcttacactcacatcattcgtaatatcgtgaatgatcctgcagtggtgtttgacgacatcgttgaaaacgagcacatcatcaagcgtgcgaaagacatcgcccactactacgatgatttgattgagctgactaatgactatcaccgctatggtgaaggccaacatcagatcaacggtgaaaccatcacggtatcgctgaaagagctgaagaagaagctgtatctctgcttgatgtcagtcaatgcactggaggcgattcgcttctatgtaagctttgcctgctctttcgcgtttgcagaacgtgaactgatggaaggtaacgcgaaaatcatcaaactgattgcacgtgacgaagccttgcacctgacgggtactcaacacatgttgaatctactgcgcaacggcatggatgattttaccttcctgcaagtggcagaagagtgtaagcaagaaagcttcgatttgttcaaagaagccgctgaacaagagaaagagtgggcagaatacctgttcaaagacggttcgatgatcggccttaataaagatattctgtgtcagtacgtcgagtacattaccaatatccgtatgcaagccgtcggtttagagccggcatacccagccgcgacgaataacccgatcccatggatcaacgcatggctgtcttctgataacgtgcaagtggcacctcaagaggctgagatcagttcttacttagtgggtcaaatcgacaacgaggtaagcgccgatgatttcgagggctttgaactgtaatggctgcaatcaaaatcaacaagctgctgaccattgaatctaactcgagccatactctgcttgaaagtatggaacaagcagggttagagccagaatacaactgtcgcgacgggcactgtggtgcttgtcgttgtcagctcatctctggtgaagtcgagtatgttggttttgccatggcttatacacaaggcaatgaaattctaccttgtatctgccgtgcaaaaacggcacttgagatagaacaagtcacgtatcagctaaaagccaaacgcgcttaacccatcgcgcccaaccaatggttttcgactttatcaataagtcgatgaggtcgataaccgtttgagttgagaaaagtgaggtgaactctacccaaactatttggcgttgcagcttcaagtaggaaggggaaaagccattgaatatgaagttgccgccatgaatacggcggcttcacaggatatgcacaaaccagagcttaggctctggctctattcccgccacacaaaatcgcatccgcagttctcatggatacccacttattgccgatttcgcgtccgccatcatcaaatagcgataaccaatagccttggttactggcgttatcgaattgggttggagcgtgtaaccagagtgaaactacatcctcagttccgtcgctatgtgcttctcctaaaacgactttttgactggcgattttataccaaaccaagattttcgagtgttgaaacatgtcagcctcctgccgccacttttcgggggagcagtcagtgtaccgatccaaccaagggtttaaagcctctcttttgagacaaatcatgctctctaaataaatcatccgcttattgattagacaaaatacgcataacgaaagctaaaccatcaataagcagaataagtagcggattcattcagttaacaccgaacgcgtaacgataaaaaagccatttaaaatcaatccattattgtaagattttgatttttaattgagcacgctactcggcaaatgcatctctttgacccgctcaaccgcactgtaacccacaaacatagaacgtccagtgagatagcgcagtaacatgtccgcagccagtgttgcgatccactctttttgctcttgtgcgctaaaacgacgcacaaatttgactgtttgcccccactcaccatttggggttgagagcgcaaccgaaacgtgatcctctttcaaagcccctgtaaccagtgccatttgggtaccgcatttgtctttcgtcgctcctgctagggcaaacgctgctgctagtgggtcttgatgagcaagctcagacgatactctgtggcttaagatccaagaatggccggcgagggcttcaacgttgggatcactcagcagccaactcgacaacccaccttgggttgcttgctctgccaaagccaaagagagccctttttctgccatcacatggcctaaataggtcaacatgggttcatcaatgctcaccacatactgttctagatgcgaatgtatgattttcagtaagctgaggcgacgttcttgatcttggtctgggccaaacagtttgacttcaataaacggcagataagagcgataacctaaggtgtagccttccggcaaatgcattttatctagcttatcggagatggaggattccgaagtgccgaaggtatataagcggctacactgttgcccttgaacggaaggaaattgccgctgcagattaggcaagatctgctcgctgaccattttgtaaaactctttgggaacgcccggagtgaaataaaaccagcaatcgttgatctgcattttaaaaccacaagcggtaccaattgggttatcaatcacctcggcattggctggcagcatcgcttgtttgcgattactttctggcatcgctcgaccacgcccaatgaaaaaggcttccagttgactcaaccaatctgcgttcaaaaccagcggttgttctgctgcctgagccgcagcttgggcagtgatatcatcgctggtcgggcctaaaccaccattgacgattaccacatccgagttaaagctcagcatcattaattcttccaccagagcaggcaagctatctccaaccgtggcgcgtttagccagtgaaaagccatgttgataaaattcgcgcgctagccaagcggcgttagaatcgacgatatcaccgtgcaaaacttcttcgccggtactgagcattgctattttcaacatatttgccatcctgatgtaaatgcagtttccatattggcttacaataagctaatagaaaagaatgttttatcgactaagctatttcaaacaagcgcgaattatcggttccttgtttgtgagttttatggataattgttaccctgatcgacatatcacctaactggagacatctgtgctcaagaaaaacatcacctcaatgatgttgttgacattttccgcctgcgtaagtgcacagcaacaagatgtgaacttcaaatctgattttacctatccattgagctgtgaacagaacggctgctattcaagcaattattataccgactctgttggtaaccctttttctttgagtctcaatgatgcttcttcactcaagctcgatgaacatcttcccaaatatttaatggtgcaagacacccgtgactgggattatctgaaaggtcaaacctataccattctcggcctgagtgttatgaccgcaggattgatgactttactccctgaatccatcacaaaatgggacgcagaagatcgcaaactgagcggccttggtaaaaagtggaaagataatgttacctcaggcccaacttgggatcgtgacgaacattttctgaactacattatgcacccatactttggtggtgtttattacacggcggcgcgtcatgcaggattcaacgagttcgaatccttcctctactcggccaccatgtcgacgttcttctgggaatatggggttgaagctttcgcagaagtcccctcgtggcaagatattttcatcaccccgttttttggtgctgtgatcggtgaactgatgtttgaagccgaacaaaatattgtggcgaatgggggtgaagtcatgggctccgatactatgggtggcgtgactctcttcttcctcaacccaatcggtcatattcatggctgggtcagcagtgcttggggaggctctgcggatgtttccttccaaagcagcccttggtcaaacaacccagatgcagccaaatatgcgttggatgccggtgctccatacgattcacagtattacggcgtcaattttaaaatcaccttctaatctgtgcgacaggctatacctaaggtatagcctgtctgcattattcgccttcacgttccctttcattctctcctcgcaagagaaccaaataatctaaaattgaagctcagtgccagccagaaggggataaatctgtggcgcaagtagaattattgtccttctgctgagactccctgtccaaaaattgattttggtcaattccaccccaagttaacctcctacactcaaagagcgagcaacgcgtattccttgtcaggaggccaacatgaacagcacatttattgtgaattttgtcggaaaagcaacgcctgccaccataaagcaactggcagccgtcactcacgaaaatggaggtaagtggctcatcagtaaggtgaatttcattgaagacagcgttgctgctgtgatcaaaattgaattacctgcagacaatgccagcacagtgaagcaagccttccaaacctaccccagtcttttggtcgaaattaccgatgccgacccgcatgtccataagagtgatgctgtctataaggtcagattggatgccaacgatcgcgcagggatcgtgaatgaaataactcatctgcttgatggccaaggtattagcatcttagatatggactgccaacgtgtgtttatcgccggcggtggcggtatcagctcaagcctatttacggccaatgtcgctatgcgcctgccagtgaatattgaaatcgatgacgtcatcaatgagcttgaagcgttaagcgaagatactcgcgtgacgctcgaagcttaactcttttcatcccatcctaacgagggaggcttagcctccctgcttgcgtttgagttattgcactaactctcatcaaatagttgagctggttaacaaaatgaactgaggccagtggcaaatcagccgttgtgaaccatccttttattagtccttatcggcctattcattcaaacaataacctagccgaataagaccataaacattacagcgctcagttaggtggtaacgtcatgttgaagctagagaatatcaaggtcagttataaactggccgctattgtcatcgtcggtattgttggatttttgagcctgctctttatctctgccaatgccctaaaagaaaacttggttgctgagcgtgaagcacgtttgaaagcagtgattcaaagcaccctatctcaggtggcttatctcaaccaaaccctacccaaagaacaagcgcaagagcaagccaaagccctgattaacgcgctacgatttgatggcaacaactacatgttcgtgattgatgaatcacgctacacagtggtacacccgatccgtcaggatctggttggtcaacagatggggaatccgggtaaagatacagaaggtcaattctggttcaccatgatcgacttagcgcgcaatggtcaacaaggctcgttgatctacccttggaaaaatcaacaaggcaaccctgccgataaactctcgttcgtcaatggctttgcgccttggggatggattttaggctcaggcatgttgttggacgatattgaacacgcggtttaccaacagttcctcagaatggggttcgccaccctcatagtaacgctcgttatgataggtctgggtgttgtgatcagtcgtgcggtgattcaaccactcgataccatcaaagatgtgatgaaaaaagttgcccaaggcgatctcaccgcacagattcctgtgctgggtaaagatgagcttggtattgttgcccagcgcatcaataacagtattgccgccgtacatgatgccttggttgaatccgtacagtccgcctcttctgtcgcggaagcggcgatccgcatcgcctcctctgcagaagaaaccagccaagccgtggtctcacaacgtgaccaattaagccaacttgccaccgcgatgaaccagatgaccgcgaccgtggctgatgtggcaggccatgcagaagacaccgcgcgcgataccctcgatgccagcaaagaagcgaacctaggagataaggacgtccattcgagcgtagacagcattcgcgccttatcggttgaactgggcgttgcaactgatcaagtgaataagctcaaagaaggggtgatgcaaattagcgaagtcacctcggtcatcagtggcatttccgaacaaacgaaccttcttgctttaaatgcggcgattgaagcggcgcgagcgggcgatcaaggtcgcggcttcgctgtggtcgccgacgaggtacggaatttagccagccgaactcatcattccaccgatgaaatccaaaccatgattaaccgtctgcaacaactggcggtaagcacagccagtgcgatgcaaaaaagccaagcattggcggctaacagcgtggcaaccgcagaaaatgcgggcagcgacttatctctgattgtgaatcacattcagcacgtcagcgacaaagccactcagattgccaccgcagcggaagaacaaagtgccgttgccgaagagatgaaccgtaacgtaagtggcattaatgatgcggcgctggaaatgtcgcaagcggccacttatttagcagaagagagtgaaaaactggctgacttgtcacggcaactcgaccaaaaactgacggcctttaaactgtgacctcactctttttatgagcagacagagatcggcatgggcattcttcgatgaaagtgctacccttacggcattatctactgcgagagaataaaatgagcaaattaacggcagatatcgaagcgaatctagcgctgtttattcaagaaacccaagaaagccaacttgtttggggtttacgcaatgaagaaggttggctctcttgtgagtcgactgaatttgaagaaagtgaagtgatgcctttctggtcatccaaagaagatgcgcaaattcataatgttgaagagtgggctgactttgaagtggtagaaatcccgctggatgtttttgtagaggattggttaatcactcttgatgaagatggtgttctggtcggaacgaactggaatgccaacctcgaaggtaaagaattagagccatcacaactggccaaactctacctataacctattcactatgtaggttaatcggtatttcggttctccctaccgataaggcgcataattgcgccttttgttttttctcactttgtttttcaatcctttgattcatgtgctgacgtagccccgctgcacaagctttgttacacttgccctcctgttaaaccccattcggaacgcaagcatgcaattaactaagctgacgcaagagatcttcgaccacttataccgtgatatcagtgaattccgccaaacctttgatctgcctgtcgctgcaccacagaccttaaattcccaggctgacaccttacacacttctttggcgattgaagagctgactgagcttgcccaagccgacaataaaaccgaacaagcggatgcgattgtggataccgtctatgtgttgatgggaagattggtgcatttaggccacgctaaggtagaagacaatctagcgatcagctatttgattgacctacttttgcatgtcgcggccaacttaaatatcgactttcttccatgctgggatgaagtacacagctccaacatgagtaaagtgtgtcgcagtgaacaagagtatttagatactgagaaattctatgctgaacaaggtgtcaagctaatggcggttcatcaaggtgagtatattattgccaaatgcgcagaggattttatctctgagtctaaaaccgtgcgtcagggcaaagtgctgaagtcggtttattaccgccctgctaacctcgcagcactcactcagtaatcagcctctgctttaccttggcaaggtatcgagtatccagataaaaaaaggccaccttagtcactaaggtggcatactgcgtctgattggggccaatcagttcagcacaaactcaatactcttataccaaggcaccattcaggagagagtgccaagggatctgccgaagagtgatgagcctaacaagaacgagaatgtatcaaatctagtattgcgaattgtgtgccaatattttttccttgcgttaaaaaacacaactcattgataaataaacaaatactaaaacactttctcgcctattcttccagcaacatgcgctaaaacagtgctccatgcgccatgattggtcaacgcaacacctgataagatgctggcgtcttaggctcaatcgaacagcaagtgaggatgcccttccagttccactcggcgaattgacgtgccaaacacggattgcagcacttcttgagtcagtacctctttcgcacttccagcacggtatagaacgccacgactgagcagtaacacttgatcagcgtgacgcaaagtgcggttcaagtcatgattggccatgatcaccgttaatccctgccctgccatacgctcaatcagacgatacaacaggctttcttgcgcaatatccaagggtgccgctggctcatcccaaatcagtaaacgcgcagaaggattcaaaaccggtgagacctgtagacaacttccggctagacgcacacgctgccattcaccaccagaaagctggtgaatcgaacggtgtagtttgtcatcaatattgagtaaacggctgatctgatcgatttcgctggccacttccgagcattctagggctacgttcgcaggaaccgacagcgccaaatattggaaaacgtgcagttgaaagctgggtttattattttgtgccaaataagcgcgatggcgggcgagttcagataagcttgcttgactcacgtctaacccatcaacctgcacagatccagagaaagggatcatccccgctaaagcggcaagcaaggtgcttttgccacagccgttggggccaatcacatgccaaacttcgccagcgttagcctgtaatgacaacggcagcagacgagaatccacctgtaagctgttaacacgaatcatggtttctcaccaacatccagataaaaatgggcgcgcccagagtggtggtgactacccccaatggcaattcgccgctgcccagcgccaaacgcgcaatcaggtccgcactcaccagtaataaagcgccgcacagagcagaaagtggtagcaatagacgattttccgagcctagcgttaaacgcagcaaatgaggaaccactaacccaacaaaaccgatcactccccctagtgcgacggaagccccgaccagtaatgcgatagcgagaatgagccgccagcgaacacgatgaatatcgatccctaactgtttggcatgcccttcaccaagcatcagcttatccaaaacgccaccttgcaagacaagccaaatcacgacaggtactgccaccaaagagaggagatgttgataccaactgacgcctgcgacactgcccattaaccagtacatcagttgacgcaaaccaaggtcatcactgaaatagaaagcccaagtgactaccgcgccagacaaaatccccaatgcgaccccgaccagtaatagccttgcagtggtcaagcgtaacttacgagccatcaccaccaagagcaacgtaaacagcagcgcgcccaataccgcggccgccataaaagccacgggggaatttaaactcgggaaaaacagcagcagaatcaccatcgccacgcttgcaccacccgatacccccaccacgcccggctcagcaagcacattgcctagcaacacttgtaaggtggctcccgctacggccagagaagccccaatgaccgccgcagccagtaatcttggcaaacgcagttcccacaccaactgttgttcgagggaagaccaagcggaaaaaggagatagccacagctctcccaccaacaaataaaggacacacacactcaaaaacagcccgatcagcagataactgctgcgctgccagcgttgctgtttatgttgaagcagtcgatgaaaatccatcttgtcgttcatagaaaaaagaatggcctaaccttaccgttaagccatttaaatagaaaggagatcatgaccaagcaagatcagtcgtacaccaattggtcatcttcatagcgcgtgttcaccttacacaccatcaaggcagcacgctggccaatggccactttacggttcgggaaaacaatcgcttccccttcatttttcgccattaaaggcttatcaccatcgtgaccaaacacttccccatgcataaaggcggtgaagttttccacgtcgtcactgaagcgaaaatcaaaatcatcatgcagacgcactatggtgcgactgactcggtacatcaccgattttctcggtaagtgctcgggtttatggcgagagatgagatctcgcatcgccagatcaaaggccagcagacggtctaatagattttcacctaagcgtgccacttgaccaagctctaaggttaaggcttgcgcagcataatgctcggctgaataccaactaaacgtactggaaggcgcattcgatagcatcacggcttcaatatgggcttgctcgataaattgcatcaggctacggctgcgcaccggatgacgcgctttcgggcttactgcaaacgaatagtgtttcgagccacgaatggcacagtgcaaatctagatgccaacgcgagtgttcatccgtgttggcaaaaaactgtctaagcagaactttgaggttatcggcaatcgccagctcagtgctcggagtgtggggcttatcatcaaataagcggttgagattctgctcaataaaacggacatggcgcaccgtggcttgcgggtgcgccataataaataagcagcgctcagcaacgggttgaaatccgctgacgatatcgtcaatccatttatccagcagttccataggtgcggtttcatcaccatgtatcccacaggagatcaccatattttttgtcgccgcatccgtttgagctgggatcacttccaacacgccacgttgatgcagctttaaggtcacaccctgctctgtacgtacggtttgcgcgaccatgggatggtcaagatctaagctgtcgaaaagaaaagattggcggaagagagacttcgtcatgcgctactcctttattgcacagcggtatgttaagaaattgtacgaacaatttatgccaagatgatcgcacttatcatcacccattcaatatccgtggtcgttaacggcactctacccaaacgacttggagttgcaggtggagagtgatcccccatcatagaaatactcagtgattggggtgagcgaatatagccaacaccgctgcagcttcaagtatcaaggaatagatctttttattcccagccagacgacgatataggcgcggattctaccactaattcaatgagatgctccatattcaattcgctttatgggctaacggcaaagcgcatttccgatgctggtcacgctcactatcggtggctcaccgggataaaggacaagctctgtcaccgattgatgaggaatggttaaccgagtatgccagtgtgggttgcgccaatcgacacccaatacgtgtgccaaaatcaaacgtatggttcctgcatggcagaggataagcgtatcgctctcaagcttaggtaaccattgttgccaagcttgactcactctttgataggccatagcgagaggttcagcttgtggcagtgtgttctttgcggggtcttgccaaaaggcatccaatattggccattgagtctccaagtcggcaaaactttgtccatccaactcaccaaagttaagctcttggagctgcgggtcgaaatcgagcataacgtgcggacgagctgattggagcaatcgcgccagatcggcgcagcgacgtaagggggagcttatcacacgagtaaacggcaaagtgctcaattggctggctatcgcttgctgcacgctcggcttcaccgcgacatccgttataccattcagggctgcagggccttgtgttttgccgtgacgcagtaaccaaattcggatcatgccttgctactcgccttttaaacgctgtggcagacccgccacgacaaacgttaccgaatcggccaatgccgcgattttctggttcatccatcccgcgtggtcaacaaacatgcgagtcaattcgcccataggtacgactcccatacccacttcattgctgaccaaaataatgtgagcttgggtttgagccaatgccgccaacagcgaatcgacatgctgctcaatccgcgctgcacagagcgcggcttcgtgttcaaaaagcagattattgagccataacgtgaggcaatcgactaacaccaaatcttggcgttgaaagcgagttaacgcctcagccaaagccagcggcacttcatgttcattccactctgcggttcgtcgggcttgatgatgagcaatccgctcgcgcatctcatcatctaaggccgtggcggtcgccacataatgcaaggtcgcccccaaagcttgtgcagtttgtttggcgagtaactctgcgtaactcgatttaccactacgggcaccacctaaaacgaaatgaaccgtcactttgccccctaaatcatcacttcatgctgtaaaaaagcaagcaagatcagatagatcagaatttccatcaactgctgtgcggcgccaaggcaatcgccagtaaagccacccaaacgtctgataagccattggcggaaaatctgtctgaaaatcaagctggcggcgatcatcactccaataaactgccatgagaagtaaagcagtgtcgctaaggcggtaagggataacacggccacatccgtacccgacagctgctgcgccagcggcttacttttactgctgtcggtatcggagacataaggcgtattacgaatcaaagacgccgccaccgcgcggcttagggtataagccagtaaccaaacaggaaccagtgaagtaagatcggccaattcggtgagtagcaaatatttacccagcaaaaccataatcaaagcgctagagccataagtgccaatgcggctgtctttcatgatctctagacgtcgctcagccgtcataccaccgcccacaccgtcagccatatccgctaagccgtcttcatgaaaggcaccggtcaataacaagctcaacaccatggtcaaaaacacgctgatgttggtagaaaaaagctgcgtcgcgagcgaataaaccaaagcgcaaatcgccccgagcaggagtccaaccagagcaaaatagcgcccagcttgattcattcgctcactgctataaggcaaactcaccggcacaggaatgcgggagaagaagctcacggccagcaaaaacagctccagttgataacgtaaaatggccgccattacactgtgactcctgcatcagcaaaactggccatgtggttgtaaaactccactgcagcacgaacaagacccagcgccaacacagctccggtaccttcacctaaacgtaaacctaaatccaacagtggctctgcggccagcatttctaatactgcgcggtgccccgtttcttgtgagcagtgggcaaacagcaaaaagtctcgtacatttggctcgattaaggtcgcaacataagcggcaaccgtcacaataaaaccgtccaccagcactggggtttgcttttcgtatgcccccataaatgccccgaccatttggacaatttcaaacccgccaacttgctgcaagacatcttgtggcgcagcgcctaaacagcgctcaacaccttgggtaaccaacgctcgtttacgttggtactgctcatccgtaatgccggtgccacgtccaacacacacttcaatcggcaagccggagagtgccgccaagattgctgctgcactgctggtattgccaatgcccatctcaccaaacatcaatagattacagcccgactcaacttcacgatgaatcaacgccttgccaagtgcgattccctcttgcacctgctctgaagacatggcggcttgctcggccaaattatgcgtgcccgcaccgagacgctgctcaatcaaatccgcgtgagcgggctgagctcgcaaaataccgcagtcaatcacccgcatcgcggcgtgttcagtacgacaaaaacagttgatggccgcgccgcccgcgagaaagttttgcaccatttgctcagtcactgcgcttggcgcaatactgacaccttgcgcagcgatgccgtgatcggcggcaaaaaccaaaacggtcggctgatgaatcgccagttgagttaccgcttgatcttggttttggctttggatgagtgctaaatgatgcgcgacgcgctcaagttgccctagcgccccgagtggcttggttttttgatcgattcgttgttggatttcggcgctgaatgagcgatctaacatgcgggcatccttacttctttttaaggcatgaaaacaaatgcggcacagtctactcgctctgaacaacaaagcaaaagccttcacttattttgcctactacaccacactctcagcgcaaacgacttgccgccgcgtctgacattagtctcggcatccaatatacccacactacttggagttacagcttcaagtaggaaggagataagacggatataagcatttgaaccagtctgttctatactttggtacaaatagtgcttcatcttttaatgcttcagtttggttatcctgttttaacgttgtctcttgcttgagacaccacaaggagctgtaccatgattgctaaccaaagatcaccgaaaccaaagccgaataaacctgccaataaaaaaggcaagcgcgtaccgtttgcactgacctaattccattgaaaaagaaatgcccatcaggcctgcggaacacagacctgagggcatgagcttatacccaaacaacttggagttgcaggtaggcggcaagtaagtgaatccccatgagcataggcaaactatgtgattggggtgaacgaacgtagccaacaccgctgcaacttcaagtaggaagggtatatttatgcactgagtttgttcacggcaaccgaattgatgcagtaacgcaaaccgcttggcggcggcccatcaggaaacacatgccctaggtgcgactcgcaagtgttacaacgcacttccactcgagcacgcgctaagctttgatccatatggtaggaaatggcattgaatttgactggctgcgaaaacgaaggccagcctgtgcctgaatcaaatttggttgccgaatcaaataacagggtttggcaaccggcacattggtataaacccggctcaaacagctcacacatcgcattagaaaaggctctctctgtgccatgttgacgcatcacgtaatactgctgttcatcaagcaaagtgcgccactcttcatcactgcgcgtcacttcacgctctggcttaggattgccttggtttgcaaaatccaacacctgttgccagttcaacattgctctctcctcttgttggactattgactatgctcaaacgacttagtacggcagcgtcaagctggaagaatatagaccgcggatgcaccaatcttattgcattcagatcaccaaaatacacacctgcaaaagcagcacagttcgggcaatgcttagtcaaattgatcgccaattagtcaaccctctgtttttgataaccattagttataaaacatgattttttctcagtttattttcgtgatagcgatcgctatattccaagaaaatcgttctcatttaggatagaacaatcggcttgctttgatggccgttgttactctccttcccccttttaaggatttgcttatgtcagtggttacccttgcagcactggtgattttcgccggtctattgctctatctgtttgggctacagaaaaaagccgccaccctttctcgtcaagttttgtttggtttagtactaggtagtgcatttggtttggcactgcaagtagtgctcggtgaaggccatcccgctattcaagaaaccctatcttgggttgctatcgtcggcaatggctacgtgggtctactgaaaatggtcatcatgccactggtgctggtatcgatgatctctgccgtggtacgtctggataaaaacggttcactgggcaaaatctccagtctgactatcggtattttgctggtgactactgcgatttctgcgctgatcggtattctcatcactcaagcatttggcctgacggctgaaggtttggttgaaggcgcacgcgaaaccgcacgtattgcagcacttgaaagccgcgcatcaacggttgccgacctaacgattccacaaattctgttgagctttatcccaaccaacccctttgccgatttaaccggcgcacgttcaacctccatcatcgcggtggtgattttcggcgtgctcactggtattgccgcacgcaaagtgattgccgataaacaagagttagaaacgccaattcgcacttttgttgaagcagcacaagcgattgtgatgcgtttagtgaaaatgatcatggcgctgacaccttacggtatcgccgcgctgatggcgaaagtcgtcgcgacatccagtgctaccgacattctgaacttgctcggtttcattgtggcttcttatgtggcgatagccctgatgtttgtggtgcacggattactggttgctatggtgggcgttaacccaacccgttactttaaaaacatctggccagtactgacttttgccttcacatcgcgcagctctgcggccacgattcctctcaatgtggaagcgcaaatcaccaaactgaatgtgccacctgcaattgctaacctgtcagcttcattcggtgccacgattgggcaaaacggctgtgcgggcatttaccctgcgatgttggcggtaatggttgctccaaccgttgggattaacccactggatattcactttatcgtatcgctgattgcgatgatcaccattagctcctttggtattgcaggcgtgggtggcggtgcaaccttcgcagctctgattgtgctgccagccatgggcttacccgtcacgattgcggcgcttttgatttctatcgagccactgattgatatggcgcgtacggcgcttaacgtatcaggttcgatgacggcaggcacagtcacaagccgtttgcttaaagagacaaacgaagagcctgagccgcaaactcagcaagcctaatcttaccttgccaaagccgatgcccagcatcggcttttttttgttgaaaggctgaacaaataatgggatagcacaagggcagcaattgctatgtcagggtcaggatggtctaataacggcaatttttagcgatttggtaagccacatgcagcaagaacaccagcccacattcttctttttcgactacgagacttggggagtcaatcccgcaaaagatcgtcctagtcagtttgcgggtgtgcgtaccgatatggacttcaacatcatcggcgagcctttggtaatttactgtcagctgcccaacgactatttgcccgcccctgaggccgcattgatcacagggatcacccctcaaaaagccaatagccaaggtctcgcggagcccgaatttatcgcgcgtattcatgctgagctctccacacccaataccatcaacctaggttataacagcatacgttttgatgatgaagtgacgcgctacacctgctatcgcaactttatcgacccctatgcttggagctggcaacacggcaattcccgttgggatctgctggatgtgcttcgcgcgtgtcatgctttgcgtcctgaaggtatcgagtggccggaaaatgatgacggcttcaccagctttaaactggaacatctttctgttgccaacggcattgagcacagcaacgcgcacgatgcgatggccgatgtgattgccaccattgaactggcgaaaaaagtcaaagccgcgcagccgaaattgttcgactacttcttcactatgcgccacaaacgaaagctgacagaactgattgatattgtgaaccaaactccgctgatgcatgtttctggcatgcttgggcgtgagcgtcactacactagctggattgtgcctattgcttggcatccaaccaatcaaaatgcggtgattgtggtggatttgggtaaagaccctcagccgctgctggagctcgatgccgaaacgctgcaagcgcgtctctatacgcggtatgaagacctagcgccggatgagctaccagtacccgtgaaattggtgcatctcaataaatgccctattctcgctccggccaaaaccttgaccgcagaaaatgcacaaaagattggtattgaccgcgaacagtgtctcgcgcacttgaatgtgattcgtcaacaccccgagattcgtgaaaagctggtgacggtatttagccaagagcgcgaatttaaccaagagagtgatgtggatagccaactctatgccggctttttctccccagccgatcgcgcggcgatggagatcatccgcaccactgcaccggagaatctgggcagcttagcgatccgggtggccgataagcgcattgaaccgctgctgtttcgttatcgtgcgcgccattatccccacaccttaaccgataccgagcaacgccgctgggcagcgcattgtcgtgactatttcgagcgcaatctagaaggttatatgttgaatttggaaaatctggtgcatgaacatcaagctgatccaaagaaaatggcgattttaaaatccgtctaccattacgtggaaaaactcgcttgctaacatcgtttatttttacttgctgattttattgatgataaaaaaaatagctcaatactgtgtctccatgggactgatttttctctgtctgttggcgggcatcaacttacaaacttggttaggcattgctattcccggcagcattattgggttactgatcctatttggcctgatggccagcggtttagtgcctgtcgaatgggtcaaacccagtgccaccctgtttattcgttacatgattttgctgttcgtcccgatcagtgtcggcttgatggtgcacttcgatacgctactggcaaacctcgccccgatcctcgctagcgctatcggcggtaccttaattgtcatggtgacactgggactgatactggatcgaatgctcaagaaggggaaaaagtcatgtggctgatcatcacacttggggtatttttcgtcgcccgttgggtggctcaaaaatgcactaccccactggccaatccgcttctgatcagtattggcatacttattccactgctgacttacctcaaagtaccttttgagacttactacgctgataatcagtggttgagttatctactccagccagcggttgttgctttggcttatccactttacgagcagttgccacaaattcgtgccaactggcgaattatcgctttggcttgtggcgtgggtagtgtgatgtcgatgatcaccgccagtttgatagccgtaagcatgggggcagatatagaactgattgccgccttgatgggaaaatcagtgacaacgccgatcgcgatggaagtggcacgccagttgggcggcgagcccgcgattgctgcgattttggtgctactcgtcgggctatttggtgccattcttgcctacccgatttacaaactgctcaatattacgcatcccatcgccaaagggctgaccatgggtacggtatcccatgccctcggcacagccacttgcgctgagaaagatcctcgcgacgccgcgttcagctcactagcccttgtcgtgtgtggtgttatcacgtctgtattagcgccaagtctgtttgctttcgcactctggcttcaataatttcatttcgagtggcgtcacatctcatacacttgcaatcgttatcatgtgtgacgtcactctaataatgaaacataaaaataaattacataacttaacgtgacactgatcaccttataaaatctcgcattacctaaaataggattccatgcaatgaaaaggaatcactatgagaaaccgtattgaacaagcattacaacaaatgcctgcttcttttgccccatatttacgtgaattggtgttggccaaggatttcgatgccactttctctgccgagcagtatcagcagcttttgaccctttcgggtctggaagatgccgatttgcgcgtcgcgctgttacctatcgctgccgcttactcgtatgcccccatctctgaattttatgttggtgcaattgtacgtggcatctccggccgcctctatctgggtgccaatatggaatttactggtgcgcagcttgggcaaaccgtacatgctgagcagtgcgccattagccatgcgtggatgaaaggggaaaaaggggtggcagacatcaccatcaattttagcccttgcggccattgccgccagtttatgaatgaactgaccaccgcgtcttcgctgaaaattcaactgcccaagcgtgctgccaaaactttgcaagagtacctccctgagtcgtttggccctgccgatctcggcattgattctggcctgatgagcccggtcaatcatggtaaaaccagtgacgatgatgaagagctgatccagcaagccctgcgcgcgatgaacatcagccactcgccttatacccaaaacttcagtggggttgcactgaaaatgcgcagtggcgcgatttaccttggcgcgtatgctgaaaatgctgcgtttaacccaagtttgccaccgctacaagttgccttagcacaagcgatgatgatgggtgaatcattcgaggatattgaagccgccgctctggtagagagtgcaaccggcaaaatcagccatcttgccgatactcaagcaacgctggaagtgatcaatcccgatattccactttcttatctctcactgtaaaccgaatgaagaggccattggcctcttcactttttgctactagctctcttagtccacctcttgctaaagatgtcgcgcgcacacttttccatcacccaccatgacgttctgaataaagcctgataacttgcgctttttacacgtatctctcgcaagctatgtttgaacaaatcattgccattctctttcctgtgatgagcttagtcttgattggctatttgattggtctctggctcaaacccgattttcgcccgatcaatcgcatcaatatggaggcctttgtgcctgcgttggtgttttcttcactggtcaacatgccactggatacgcagcaaacacctctgttgcttgccgctcttgtcgcggtattgctgcccggtattttaatgctcctgatatgtcgtttgggtcgttggtcatttaaaacatgggctccactgcacatgtttcgcaacagcggtaatttagcgatccccctgtttacttatgcgtttggcgaaaccgcgctcccctctgccgtgttgctgtttgtggtttctatgtgtctgcacattagcttaggggtggccatgctgagcaaaggtagcgtattgaaaaccgtgctcagcgctccggtctttttagcatcctcactggctttactgctcaatctaagcggagtctctatctggtcccccttgtacaacgccaccgctttacttgggcaagccgccgttcctgtgatgctgctttccctcggctcacaaatgatcaacctgcgcttagccggactcaaagttggccttgtttcaacggcacaatctctgctcaccggagcctgcgcgtttacggtgatttactttttcattccactgcctcccttacaactgcaaatgatggtgctgtttaccatgttgccccccgcagtgatgaattatctgttcgccgagcgttatcacatcgagcctactcaggttgcggctatggtgttgtttggtaatttcttcagcttattaagcctgcccatattgctgtttatcgctctttcactctgatcctgttcgccataaaactgtcataaacttgaccagaatacggggtaatctgactggctacagcgggaagcaaacgttttcttttgtgctttgttccagtatcatggccgctgttttttgctaatgttgactgaatgactataaggattgtctatgtttgggaccgcgactcgggataacgcaacgcgagtacttttgcttggctctggtgaacttggtaaggaagtcgcgattgagtgtcagcgccttggcctcgaagtcatcgcctgtgatcgttacgccgatgcgcctgccatgcaggtcgcccatcgcagccacgtgtttgatatgctcgatgccgatgcactacaacaagtgattgatttagaaaagccacatttcgtggttccagaaattgaagcgattgctaccagcaagttagtggagttagaagcgcaaggcttaaacgttgtgcctaccgccaatgcaactcgcctcaccatgaaccgtgaaggcattcgccgtttagccgctgaagagttagggttgcccacttccgcgtatcaattcgcagacagctatgagagctttgccgcggcagtagaaaccatcggtttaccttgtgtctgtaagcctgtcatgagttcatcgggcaaaggccaaagtgttattcgcacaccagagcagatcgaagcggcttggcaatacgcacaacaaggtggacgcagtggcgctggccgagtgattgtggaaggcttcgtggattttgattacgaaatcacactgctgaccgtacgcgctgtggatggcgtccatttctgcgctccaattggccatcgccaagaagatggcgattaccgcgagtcatggcaaccacaagtgatgtcagaaaatgccattaaagcggctgaatatgtggcagaacaggtggttaacgcgcttggtggttatggcttgtttggagttgaactgtttgtgaaaggtgacaaggtcatcttcaacgaagtttcccctcgcccacacgataccggaatggtgacgctcatttctcaagagctctctgaattcgctttgcatgtgcgcgcgtttactggtctaccgattggtcaaatcgtgcaatatggcccatcagcctctgcggcgatcctcggccaaggccagtcacagaacatccagttcaatggacttgatgacgccttaagcattcctcacacccaagtacgtttatttggcaagccagacatcgcgggtcgtcgtcgcttaggtgttgccctgagccgaggaaaaacgacgcaagaagccactgatcgcgcgattgagtgtgcgaaagctgtgaagattcattactaattcagctctttatcttcatcagcactatcagaaagcgcgctctttcagcgcgcttttttcatttctacttagtggcgttcaaagagtcagagtcactcgcttttctcaatcacccaaacttcttcggcaaagcggcttaagcccgcttgtgtgcgcttattcagatgcggatctatgctcgtatcttggtaaactctgcgcacctcacatcccataaacaaggtgcgaatttccgcttcaggaaccgaaaatggcggccctgacaactcagtttgcacataatccatactgaccagcaaaatgcgcccacccggtttaagcagttgcaacacgcgctgcgcgtactctgcgcgcatctcttccggcaatgccactagcgctgcacgatcataaactaagtccaccgattcaacaggagctgtgaagaaatcgccggtaaaaagcgtaagctcatcaaactgatacagctcatgttgcgcattgagtcgggtcactgtcggggtatagaaatgctcggcaaagaaagaacgtaccgcgatttgactcagttcaaccccttgaacactgtcatgctgattcgccagccaaatcagatcttcactcttaccacacaaagggacgagcactttttcactgcgtttaggggcaagatcagaccaaaagcggatcaatagcgggttcacgtcttcaaggtgaaaaccaatctggttcgccgcccatttgttatgccaaaactcaggatctcgcatcttctactccttttcacttgctgccgccaagagtagcggatcttctgctcccgcggtagcacgaatttgtccctccccatctgttcgacggttacatttctttacctaaggctttggaactccatcgaaaactcgaagtctgaatggatgcctatgttctttccaaacgatttgaagttgcagaacctgaaatggcagataggcgcagatgagtgaattccaataaatacagacagactatgcgattggtgtgcgcgaatatcgcctttgcagcttcaaataggaagaagatatgtgatggataacaaattcttacaactgaaaatccagattgaattggaaaaggaacaacaaggcccaattgatcatagtgagcagaaaggaacactaaacccactttgattgcactgtcagaaaacgccttctaggtctactttttgactgaacagcgcaagctaaggagagtgaatgagtctattgctacgtaccacagccttaatgttattgctgctgagccgtgctcctgccatggcggctgtgccattaaccaccaattcaacggaagataaccgcgaagagtcacaacaaaacgaagtcagctctaagctgtttcgtcatagcttaagtggtttgtacggtatcgctaaccaaaattaccctattgtccagccttatcaagattttgatgttctgtacagcaaagcacatcaagcgcaaatcgagctagaaactctgtgcaaaagcaccgcactcttgacccatactcaagcctactttgctggcacaaaatctcgtcagcgtgctttagaaaaggttgagctagagttagatggtcaggccgagcgtattaccgatttagcccgagccaccatagtggcgcatgatgtggcgagtctcgtcaccgcttatgagacattaagtcgagaagcgacggtcgtgaaagtgaaaaaccgcttcaagaatccggcagaatctggttatcgcgatcttaacgttttagttcagttacctaaaacagggattattgctgaggttcagttgcatttagcggcgattgcgcaagtaaaaagtggtgcagagcatgagctgtatgagcagatccaaaccattgagcgcaccgcgcgccaagagcaacgtgagttaaccgaatgggaaaatgcgcaaattgccaagatgcgatcagcctcacgcgatctctatcaacaagcgtggcagccttacatcacaacgcacattcaagcggcataaatacccgacccaagccgcttcggacagcacaaataaagcacgcagcctagacatctcggttgcgttttttattgaaatggggataaagcaaaaagaccacgctcatcggcgtggtctattgctcggtcttatttttcgactttgatgttctcgacacgggctttcaatttttgccctgggcggaacgttacgacacgtcgagcggtaataggaatatcttcaccggttttagggtttcgacccggacgttcatttttatctcgtaggtcaaaattaccaaaaccggagagttttacctgttcgccactttcgagtgctttacgaatttcttcaaaaaacacctcaaccgtatccttggcatcccgcttgctcatgccgagctgttcgaacagggcttcagccaattcggcctttgtgagcgccataaaacttccctcaaagctaagttaaaccttgctgctggttggcagcgccaaagcaatttttattcggccaatcaataacctaactgccgaacagtgaaagtgtatgccaaccttctgattttcgccaacttttttattactcagtaagcgattcaaaacgttacgatttacatctctttcaaaaaatcactgactctctcttggatgacaagaggaaaaaaatctgagtttttagttatttacatcattgtcactaaaatgattttcagaccctcatcactatttagcgtagataatttttttcgatacgccaaaaattttttcttagtttcatctaaaaatcagagagttgttggctcagttccagattatcacgataaaaaaacaggctccgaagagcctgttttcatctgatttaaagcgaagatagacctaagcttagtcgcgcagagccgcgccgaattgggcagatacggcttgcacaatcgcctctaccgctgctgcgatatccgcttcttcaagtgtgcgttcaaccgattgcaacgtcagcgcaatcgccaagctcttcttgccttcttccacgcctttaccgacataaacgtcaaacagttttgcgtctttcagtagctcaccacccgccacacggcaagcttcaacgatgtcgccagaagcgatgttgccatcgaccaccaacgcgatatcacgacggttggctgggaacttagaaatcgcagcggcttctgggatcacgcgtgtgttgatcgcattccactcgatctcgaacacaatagtgcgaccattgaggccaaacttacgctcaagttctgggtgaaccgtaccaataacaccgatcgctttgccatccaccataatcgctgcagcttgacctggatgcagcgctgggtgcttagtcgcggcgaagctataggctttgcctttcgcggtcagttcaagaactgcttccagatcgcccttcatatcgaagaaatcaacggttgccgtttccatattccagtgctcttcaccacgagcgccagagatcacacccgccagcataggctcttggcgcatgccattttctgccgccgcatcaggaatgaagcgcaaaccgtattcaaacaaacgaacacgaggttgctgacgtttctggttgtgaaccacagtgttcagcagaccttggatcaagctcaaacgcatcgctgacatttcagcagaaattgggtttggcaggatcagcgcatcaacacccggtacaaccagtttctgttgctcaggctcaacgaagctataggtgatcgcttcttggtaaccacggtcaaccagcagatcgcgtacacgcttcagcggtaatttcgcttcgttgtgcaggttcatgttcaacgcggccactggcgcttgattaggaatgttgttgtaaccatagatacggccaacttcttccaccagatcttgctcgatagcaatatcaaaacgccatgttggcgcggtcgcttgccagccttctgcggtggtctcgacctgcatgcctagacgctctagaatctccacgacgtccgcatccggaatcgcatgacccagcagtttgtcgagcttgctacgacgcagcgcaacttggtttggttttggtaaatcggccgcagattctgcagctaccactggcgcaacgtcaccaccacagatctcaaccagcagttgcgttgcacgctccatcgcggcgtgttgcaaagcataatccacaccacgttcaaaacgcattgaagaatcggtgtgtaggccgtagctacgtgcacgaccacgaatgtggtctggtgcgaagaacgcacactcaagtaatacatctttggtgtcagtgctgacgccagaatgctcgccaccgaatacaccagcaatcgccagcgctttttgttggtcagcaatcactagcgtatctgcgtttaatttggcttctgagccatcaagcagcgtcagtttttcatcttgctcagccagacgaaccacgattccgccttcaatcttcgccagatcaaacgcgtgcattggttggccttgctccagcatcacgaagttagtgatatcaaccaccggatcgatagagcggataccacaacgacgcagtttttcttgcatccagagtggcgtttgcgcttgaacattcacgttcttcacgatacgaccaaggtaacgcggacacgccgctggcgctttcacgtcaattgaaatcgtatcattgatggttgctacaatcgcattcaccgcaggagcagtcacgtccgcacggttcaatacgcccacttcacgagccagaccacggatgctgaaacagtccgcgcggttagacgtcaaatccacatcgatagtcacatcgttcagtgacagaaaatcgcggaaatccataccaatcggtgcgttttcagccagttccatgatgccgttcgattcaacatcgatacccagctcagagaaagaacacagcatgccgtgtgacggttggccacgcagtttagcttttttaatcttgaaatcgcctggcagcgtcgcgcctacggttgcaaccgcaactttcagaccttgacgacagttggctgcaccacacacgatgtccagaagctcttcttcgcctacatcgactttggtgacgcgcagtttgtcagcatctggatgttgagcacactcaaccacgtgacccacttttacgccgtcgaacacaccagctacggccagtacgtcatccacttccagacccgccattgtaatttggtgagttaattcgtcagtggtaattgccgggttaacccactcacgaagccatgattcgctgaatttcattgtatatacctcttgggaaccctgaattatttgaactgttttaggaaacgcagatcgttttcgaagaatgcacgcaggtcattcacgccatagcggagcatggttaaacgctcaacgcccataccaaacgcgaagcctgagtatttctcagggtcgatgcctacgctgcgcagtacatttgggtgcaccatgccgcagcctagcacttctagccatttgccgtttttgcctttgacatccacttccgctgaaggctcagtgaacgggaagtaagacggacggaaacgcacttccaaatcttcttcaaagaagttgcacaagaagtcatgcaggatgcctttcagctgtgcaaagttaacgttttcatcaaccaacataccttccacttggtggaacattggggtatgcgtttggtcgtagtcgttacggtaaacacggcccggcgcgatgaaacgcagtggcggctgacgctcttccagagtacggatttgcacgccagaggtgtgagtacgcaacatcaacttcggattgaagaagaaagtatcgtgatcagtacgcgctgggtgatccgcggcaatgttcagagcatcgaagttatggaaatcatcttcgatttcagggccagactctacagtaaagccaagctcaccaaagaagctttcaatacgttcgatagtacgagtcactgggtgcaaaccaccattttcgatacggcgaccgggcagtgtcacatcgatggtttcagccgctaacttggcttccagctctgcgctttgcagcgcatctttacgctcagccagcgctttttgcaccgcttctttcgcaacgttaatttcttggccagcagtacggcgctcttccggcggtagtttacctaggctttgcagttgaaccgtcagttcgccttttttgcccagatactgaacacgcacttcatccagtgcgacgagcgactctgcagcgttaatcgctgaggtcgcattagcaataatctcttgtagatgttgcatcgtttcctcgtctgctaatcagcagtttcctttaggagcccgagtaggtttctttgggagtcgcaagaccgccaatagtgttaccgtaagggattcttggggttttcaaatagctgtacatagtaccgaaagccaagattaaagccaaattgaaatctatcctgtatgcattattggggcattattcatgcacttgaaaagtcttacatcaatacccactaattagaagtacgcggtgacatgctaaaaaacccacatcatcgcatttttcatccagaaaaggactatcaatgagagtagaaatcgtaccgattcgacctgagtttgacgctgagatttgccaaattattcaaagcgtcggcgctgaatttggcgcgattggtgaagggtttggcccatcggatgccgaagtgcttgccatgagccagtactatcgagagcaagaccgtagcgcgtattttgttgcgttattggaggggaaggtagtcggcggtggtggcattgcaccttttgctggccatacggatttgtgtgagctgaagaagttgtttctgctccccacaagccgcggccatggcgtaggccgggcgctcagcgaacattgtttgaattttgcgaaacagcaaggctataccaaatgttatttagataccctttctagcatgactcaagcgatcaagctctaccaacagcttggttttgagcacttaacgcagcccatggcggggacagagcataatggctgcgacgtgtggatgctgaaatcactcaactagctcggcgcaccaaaagcgcaaacacgattttttccgctgtttttggcaaggtaaaccgcttgatccgccgcgcgcagcagctcatggtgatctttcatgtttgaggcaaacgcggcaacccccatactgacactgccttgccaacgaatattgttttcaagcgagatcacctgctgttgaatcgcacggcaaacctgctctgcaatatagacaccaccagcagtgttggtttcaggacagatcactagaaactcgtcgccacctaagcgacataccagatcatcactacgaaagtgatctcttagcatgttcgctatcgtggttaacactttgtcgcctacatcgtgcccgtgatgatcattaaccgctttaaacccatcaatatcgatcatgacacacacgaaaggctgctggttgtcttgcgcaagattccaatgcaacacaagctgacgcatggctttacggcggtttggtaagcccgtcaaactgtcggtcatggatagcgcttcgagctgacgattgacttggtaaagctgctgagtgcgctcaatcactttttcttccagtgattgattgagtttgacgagttctcgattacgttcagagacttgatcaaataacgcattaagggcattgagtaatggctccgtcgcggcatttttctctcgttcctctttagcgtaggcctcttcggcactcatgcctgagcgaatcgcaatcacttgtcgcgccatattctgatcgatacctaagatgtggtacgccaaccaatggatcaaaaactccaataactgaacggccgagcggtcatccacatcatggatgaaagcttgcatgctaaacacttcagacataaacgtgcgatgaacctgaatgtgctcttcaagatgaagtgctgaaatgccgacctcacgcatgagcttctcttcttctttgaagtggtactcagagtaacgagaaagctcaaacagagcgagacggatctcatctagtgacacatgattttcggccaaaagagagctgtagcggttgacgatattgacgagagattgatgctgctcatcaacctcctccaatcctgtttcgaagtattgatcccatttgaatgattgcatgctcggcgctcaactctttagcctataccgctaactcacgattattccttaataaatctagggcaattgtaacgagaagcgaatcactcgacgtgactttaatcataaaaaccggaaaacgttagcaagtgctaaataaatcaacgagaaatatcacagcgcagcatgttgaaatagtgcaaaagtaccagaatagaaaaagcatcaagaaagcaaaagcccgctcaatgagcgggctttctgatttggagcgacacacgaggttcgaactcgtgacctcaaccttggcaaggttgcgctctaccaactgagctagtgtcgcgaaatggagatggtgccccgggccggacttgaaccggcacgactcgaaagtcgagggattttaaatcccttgtgtctaccgatttcaccaccagggcacgcaaaatctttgcgatggaagacaccatcttgtgataccgcttaacgccatatcatttaatttggagcgacacacgaggttcgaactcgtgacctcaaccttggcaaggttgcgctctaccaactgagctagtgtcgcaatggaggcgcgtcccggagtcgaaccgaggtccacggatttgcaatccgctgcatggccactctgccaacgcgcctctgtaatttcagactttcacttgtttcggtggctgcctgactacgggaatgcattctacgcattcgagttattgagtcaacacaattttttggcctttctaatcgtttgactatttaacgtgcaaaaacgcgatatttgctcactttattagcaaaaaacaccgtatatttatagagataactggatcccaagcttcacttttttgttttactcgcctatcgcgcaacgataaaaaaacgggctttcgcccgttttctagtgatgttcttcattcagtaagtcgtctttggccgccgccaaatattgcaccattgaccaataggtcagcacagtcgccacatagatagaaatgtagccaagccaaatcatccagtcgtcataacgccagatcagtacccacagcgcaaacatttgagtcagagtttttactttgccaacccatgacactgcgacactggctcgtttgccaatttctgccatccactcacgcagtgctgaaatgatgatttcgcgagcgatcatggtcaccgcaggaatggtgatccagatactgtggtaatgttcggtgatcaaaatcagcgccgtggcaaccagtactttatccgctactgggtcaataaatgcaccaaaacgcgaggtttggcctaattttcgcgccaacattccatctaaccaatcagtgaatccagccacccaaaacaccatagcggcgacaaagggagcccattcaaaagggagataaaaggtcaccacaaacacggggatcagaaataatctgagcaaggagagaaggttaggaatgttgaaacgcataatgtataggctcttttcgatggcgcgttaatgttgctgtatttttcttattgtttcaatgcttgataaatgttttctgccaatgcgtggctgatgcccggcactttggcgatttcttcaacagaagcgcgttttaactcctgcataccacccagatatttcagcaaggcttgacgccgtttcggcccgacgccttcgataccctcaagtgtactggtacggcgagtttttccgcgctgcgcgcggtgtcctgcaatcgcgtggttatggctttcatcccgaatgtgttgaattaagtgcaacgcaggcgcatcactcggcagatgaaactcatcaccatcaatagtgatcagcgtttctaaaccaggtttacgtgtcacccctttggcgatgccgatgatcttcgggtacttcggccaatcctgccaacatgaggagataatttcgtacgcacgattaagctgccctttcccaccatcaataaaaataatgtcgggaattttgctgctatcaagctgcttactgtaacggcgctccaacacttgcgccatcgccgcgtaatcatccccaccagtgatgcccgtgatgttgtaacgccgatactcttgctttagcggcccttcttggttaaacaccacacaagaggccatcgtgctttcgcccatggtatgcgagatatcaaaacactccatgcgggtaatcgcatccattccgagctcttcttgcagggctttgaagcgctgactgatggtcatcttgtgattcatcttagtcgtgatcgccgtcagcgcgttggtattggcgagtttcagataacgacctcgcgtgccggtgggattgacatggaaagtgactttgcgccctgcaagttcactgatcgcgatttgtagcgcctcggtttcttcggtcaatcctcgatttaaaatgatccgtgccggaatactgcgagcttcactgtgacttaaataatattggcttaaaaagctctcaaacacttcgacctgcgaggtgtcacttggaattttcggaaaatggctacgactgccgagcactttgccttggcggatcatcaaaatatggatgcaagcaatgccattttcttgtgcaaaaccgagcacatccaagtcttccaaactgtcgtccgacacaaactgctgctcttgtacgcggcgaatggcttgaatttggtcacgcgctttagcggcatcttcaaaacgcagttcacggctcgcctgctccattttctcaaccagaatcgacagtacttggttgtctttgccttgcaggaaaagacgtaggtaatggacgatctcttgatagccttggtcagaaatcagtcctttcacacaaggtccggcacagcgcccaatctgatacatcaagcaaggtcgagtacggttgctgtacaccgtatcttcacactgacggacgggaaagattttctggatcaaatgcagagtttcacgcactgcccccgaatccggataaggcccgaaatattcaccacggcgttttttggcaccacgatgtgaggacagtcgcgggtgtttgtgcgcgcttaagaaaatatagggataagacttatcatcacgcagcagcacgttgtacttaggcagatactgcttgatgtaattgtgctcaaggatcaatgcttccgtttcggtgtgggtgaccgtcacgtcaatcttggcgatgttgctgacgagagctttggttttttcgctgtcgagattcttgcgaaaatagctggttagacgctttttgaggtctttggctttgccgacataaatcacttcagcctcagcgttatacattcggtatacgccgggctggttggtgactgtcttaagaaaaggggcagaatcaaactgtgtcgacactataacttctcagtatctaagatcccgtgtcggatagctaagtgggttaattccacatcaccgttgatattcagcttggcgaacaaacggtagcggtagctgttgacggttttcgggctcaaactgagctgttcggaaatgtccgtcaccttctggcctttggtgatcattaacatgatctgcaattcacgctcggagagatcagcaaaaggattttcagaggcgggcgaaaactgactcaacgccatttgctgcgcaatttctggagaaatgtaacgctgaccgctgtgaacgatacggatcgcattgaccatttcatccggtgccgcgcccttcgtgagataacctgcggcacccgcttgcatcactttggttgggaacggattttcggtatgtaccgtcaatacgataattttaatgtccggattaacacgcaacagcttcttggttgcttccaagccaccaatacccggcatgttcatatccattaaaatgacatccgcatggttagtacggcaccattttactgcttcttcaccgctgtcagcttcccctgctactttcattccacggacgtcttcaataatacgtcgtatccctgtgcgaaccagctcgtgatcatctacaaggaaaacactaatcaaacttgtatctccacacttatctattggctctgcacccaccgagacagtggattacagcgaagctaccccaaaccaacgcgggcaacttttctcccgtgaatatgatctgaaacctacactttagcaagcacttatttttcaaagtgtcgaatcgcacatgtggcacataaaaatcaataagttaataaaaatcatattcgcctaattgaaaggtttggtgaatataaaccgtgatttttggcctacttttgcgtcgcaatcacctaggtgctcgcccactcctgcttgtgatgccacaatgcgatgtaatcagcttcactatcagtataatgtgccagcgcaaaaatgtatgagtgttgaaaaaggtgggccagattgaagattgaacaagggtttgtattaacgcgtcacgctcgtgatgtggctggacaaacccaaattgaactttggctcgcgacaccttcaggcccaacgcaacttaccatacgcggtgagcgtccggttttttttattgaacaatcggctagccaagaagtgatgcgaattgccgcagaattatcaataacgccctcattagcgcctctgtcattacgtagctttgcaggccaacccctcgccgcttgttactgcaatacgattcgcgatagccaaatcttagccgagaaactcgctcaagcggacatgttgatcttagaggcggatattcgtttggctgaccgttttctgatggaacgctttatccaaggcagcatcgaatttactggtcagatcaccgatttcggccattatcgccaagttcagcaagccaaatgtcgccaaggtgattacctaccgacgctgaatatggtgtcgctagacatcgaatgctccgaaaaagggctactctactcgattggtttggatagcccgatggacagccgagtgattatgataggtcaaccagaacccgcggaaacgccgattcaatgggtcgaggatgaataccagttactcaaagcgctcattgcatggtttgagcagtttgatcctgatgtgattattggttggagtgtagtggatttcgatttccggctgctgcacaaacgcgcggagttccacaaactgaaactcaccattggccgagctcagcaaccgagctttttccgtacggcgagccaaacgcagcagggttttatcagtattcctgggcgtgtggtgctcgatggtatcgatacgttaaaaaccgcgacttatcattttcgttcatggtctttggagtcggtctcgcaagagctgctcggcgaagggaaagcgattcataacgtgcatgatcggatggatgaaattaaccagatgtttcgccacgataagccctcactcgctcgttacaacctgcaagactgcgtattagtgaataagatttttgcggccactcatctgctcgatttcgccattcagcgttcacgtttaacgggtgtcgagttagatcgcattggtggctccgtggccgcattcaccaatctctatctaccacaactgcaccgcgcagggtatgtcgctcccaatttgcagccagaaaactgggttgccagcccgggcggttatgtgatggattcgattccagggctgtatgactcggtactcgtgctcgactttaaaagcctctacccttcgattattcgctcgtttttgattgatccacttgggctgattgaaggattaaaactgccaataggcaaacaggccgatcacgcggttccgggctttcgcggcggtcaatttcatcgcaccaaacactttttacctgagatgatcgaaaaactatgggcagcgcgcgatgaagccaaacgcaaccaagaaaaggctttttcacaagcaatcaaaatcatcatgaactcattttatggtgtgctcggctcatcaggctgccgctttttcgatgcgcgattggcatcgagcattaccatgcgcggccatgaaatcatgatccaaacaaaacggttgattgaagcgcgcggttatcaagtgatctatggcgatacggattcaacgtttgtcgcactcggtgggcaatactctcagcaagaagcggataacattggtcacgctttggtccgagaaatcaaccaatggtggacagagcatttaaagcaagaatatgcccttacttcgattcttgaactcgagtacgaaacccactatcgccgttttttaatgccgaccattcgcggttcggaaacgggctccaaaaaacgctatgcgggtttaaaaggggatggtgacaatgagcaactgatttttaaaggtttggaaagcgcacgcaccgactggactccactcgcgcaacggtttcaacatcagctgtatcaattgattttccacggtcaagacccagaatcctatattcgcactatcgtagaacagacattggcaggtcaattggatgatcaattggtatatcaaaagcgtttacgccgacggttacatgagtaccaaaagaatgtgccgccgcaagtacgcgcagccagaatggcggatgacattaacgccaaacttgggcgaccgttacaataccaataccgcggaacgattgaatatgtgattacagtcaatggtcctgagccgaaagagtattccaaaagccctatcgattatcagcactacatcgataaacagcttaaaccggtcgcagatgcgattttgccttttattggcaaacaatttgatgagcttattgcgcctcaactgggactgttttagaagcgtttcgacgctgtacaaactcgacgaaatcaccacgattcagagatttactgtaaaaccaaccttgtacagagaatgggtattcatctcccatcgcgtctaactgctcttgggtttcgactccttcgatgatcgtttccagctcaagggaatgagccacgagctgtaaattggcaaagactttgcgccctttttcagagaccaaagccagcacaaaagagcgatcaatcttgatgccatcgacatcaaaacggtgcagatagctgagagaagagtaaccggtaccaaaatcatcaatgtaaattttgacgcctaattgatgaagttggttaaacacccaagtcaaacgctgttcatccgccagtaaactctcttccgtcagttcaatatgaattaatcctgccactgaacgaatgatctcttcaatctgagccattacggtcaaatccatcaaggtttctgccgtcagattaatactgacaggcacataaactccgacattcgtgagtttacgaacatcactcgtagcctgtttcactacccataaatccatctccttcatcaacccagctttggcaagggagggtaaaaaggttgccggtgatagaatgttatcttgttgatctttggctcgaattaatgcctcacaaccaatcacttgtcctgttcggtggcaaacttgcggttgatactctaaacaaaactctttgctgctcatcatctgtagttgctgttcaactttaagctgctcacgctcccgtttctgcgccaacgcaatgggatcatcttgcagatgagccgcctcttcttgacggcgagtatacatagtatccaacgaaggaattcgaatcgtttgctggccatattgttcattaagacgcagtacagagggcaaatataagagacaaccgagaacaatattgaccaattgcaagagtaatccattccagtcaccgctagtcgcaatccaagcattgagaaaaatcgggctattgaacggcactgaaacactcgggtacgcgacccaaccagactctaccgcccagagtgataccaccacattcaccataggtgcgaggagaaaggggaagaataaacgcggattgaggatcagaggcaaaccaaataggaaaatctcattcacattaatcagcccgatcggaagactggcaatcgcgagcaagcgaatgtttttctgctttccgaacaataggatagctaaagctaaagaaaaggttgcaccgctgcctccgataaacacaaacgtgcccataaaagataaattcattggataaggggcggtttcaccgatcaaaaaataggactcggacagcctactcgcttcttgcaataattccactaaaggtaataaagcgtaataaccgtggatgccgaaaaaccaaagcagcgagtttaggctggcgaatgttaagccgaaggaataagggtcattggcataatcaaaatgcatcaagcttgcaaagatctgacgagtgatcgggccaaataaaattaaatttatgcccaccacaaccatggccgtcagtgccgcaggcaacacaagattgagtgactcacgtactatgctgccagcactgtttgagcgggttaagtgtaagaccggataacgcatcaaccaagctatcagcggaatagcataaatcggtgtgatcagtgctgtgatgatttgaaacgttggcaaattattctcggcactcaccgaagctgatgagaccaccaaataaatgatgctcaatagcgcaatcgggggacgtggcaaatgccaatgcatggccagcagatatgagatggtggccgtcatcaaataaggaaaggtttcggcgatcacttggttcgcgcgatacaaaatcaaaacccattcaggacggccaccgctaaacagctcgcccatgctggcaataaacaggacaaaggaagagatcattaagcacgggatcagccacaccatcccttcacgaattgaatgcatcgctgaaacaaggtattgagaaaccttggttaactcattttttctcaccgtgggtaagtacttattaaaactcagcatgctaaagaggctcaagtgacgcgtattaaaaacttagcacactaatttctttatcaataaatgattcagcggttaaaacttatacttactgcttattctcaaaaaagactaaccaattcgaaactcggttttttgatattgagacaccagccaagggccaaaactatcgagtaaaccaaccaccgagcgtttgggaattgcacggggttttagtagcaagccaaggcggtcaatttcaagctgcttctctgggtgatagcgtaggaaatgggtaccgcattcgatcgggtcatcaaaccactgcttgtcgcggtacataatcagcgaatagctggcacgcagtagctttttggccaccatctgctgagccatgatctgttcttgctcggttgcggctttggcaattttatctcggtaataggcaagccaatcccccacatccatattccaatgcttagcaatttcccagcttggctcgtaatggccaaaacattcggccagattatcgccatacacacaaacacagcagtggcgcagcatgaaaccccaagaaaaaatcgcctctaaggtcgccacttcctcaacggctgcgatcttaaaggagacatcggtgatccacgggtagcttttttgaaaacgccaacggatggtgttgattaaggtcgcgcggttttcttcaaaagagccataggtcactaccacgacatcgaggttggagcgattcggcttggccgtttttcgcgccacactgccgtagaggtaaatgctgtgtaatgcctgccctgcccctgcgcgccaaaagcgcaccaaatcggcaatcgcattttgatattcaggttgaaaaggttgcttggggtcaatcaccggcagagtcataccgctccatactcgtttaatttgcacaggccttatgttctatgatgcgtgaccatcaatcaatagtagacttaccccactggcgagcaatcaaccagtcaaaccttaattcttagccacggtgcacgcaccacgtcacgtagcagggggagagatattccttttctccccttcctttagttataatgctgccactttttacacgaaggatatatttcatgccaaaggcaagtgaactcaaaaaaggttttgccatcatttctaacggtaagactctgctgatcaaagatatcgaagtgaccactcctggtggccgcggcggttctaaaatctacaaactacgttgtactgacctaaacacaggcgcacgcgtagatgagcgttacaaatctgatgacgttctggataccgtagaaatgaacaaacgtccgatctctttctcttacattgatggcgatgagtatgtcttcatgaacaatgacgactacaccccatacaacttcaagaaagatgaaatcgaagacgaactgctgttcatcactgaagaaattcaaggcatgagcgtagtattggttgacggtgaagcggttgcgattgaactgccatcttctgttgaaatggtgattgaagagacggatccatcaatcaaaggtgcttcggcctcttctcgtactaaaccagcgcgtatgccaactggattagtggttcaagttccagagtacattgcaacgggcgatcgtatcgttatcaatactgctgaacgcaaattcatgaaccgagcgtaatcttatggctgagcttatttctatcgacgacaccattgataccgcatacgacattttcttggaaatggcgccagataacctcgaacctgctgacgtgattctgttcacggcgcagtttgatgatcgcggcgcggctgagctggtcgatgtcggcgatgactgggatgaccaagtgggtttcgaagtcgataaagaaatctatgccgaagtacgcattggtctggtgaacgaagaaaatgatgtgctggacgatgtgttcgcccgtatgttgatcagtcgtgacccagatcagaagttttgccatatgctgtggaagcgtgactaaacttctcaacgccagctttcgagctggcgttgctctttattgacattccaagatgttagattgagacataaacccaagccttatcacaaaaaattccgctaaacttaactcaagtgcaatcaaactgtgagttagacgatgcgattcatcccattgcttagccttatttgtactctggtggcttttcctagtctggctaacgaataccgttacgggccattcatcaattacgcccaagcgcctctcgccagccattcccttactccacagctacgcgacggattttcactcccgctggatagccaagagctgtttggtggattttctgctgccagtatctggagtgatagtccgggttatgagggagatttctaccaaaaccagttcaccttaggtcttaaatggcagtttgcaccccgttggcaggcggagctgagctatcggtttagtcaggcgtgggataaccagttggattcgctgaccatgggctttcatgacctgtttggtctggatcaaaatgggcgtgatagtgttgataaacaccgttttcatattgccgttccagagcacaagattgcgtgggatgacttttctggctccactctcagcagcgcgttttctgtttacactcagtaccaaatccacacttcagagcagcatggtctttcactcggtgctacgctctattacaaccaaaatggcttattacgcttaaaccgttttgagcaagcactgcaactgaactacacctatcagcaggacgcgcatcgaatttatggcctgcttggcgtagttcatcacaatagtgcgacaggcacgctaccaacgaaaaaatcgaccctcactgtggcagcgggttatgagtaccaactcaataccaagcaccacttgtttagctcttttcatttttatcaaggcacagtggaaagccccaaggagcttgagaaacccgcaacagaatatgtgctgggttatcgctacgtaatgccatccagcgccttggagcttgcgttaactgaaaacgtcttcagcaccgataacagcacggatattgcgctgcacatcagttatcgctatcgcttgtaggcgttatcactcagtaaaatctgcgcaatgtggcaacttacacacaaaaagttgcaaaacttcgatttcaaagaaatgatttgtctatgcaaatgattttttgaaagagttgaaacttgtctccacgctatctgcaaatcaaacaatttatgctcgataacatcgagtcgggtcgttggccagtcggttatcgtacccccactgaattggagttaaccgagcaatttggtgtcagccgcatgacggtcaacaaagcgctgcgcgatctggtcagtgaagggaaattacagcgccgcccacgtttaggcacctttgtttgtgcggcagaagagaaagccgaatcgcctttgctggatattcgcaacatcgccgatgaaatcctcagtcgcggtaagcagtatcacaataaagtggttgaacagcgtgcgctaagcgccgatgaagctgtcgccatcaagctcggtgtaatggtgggaagcccagtgttttacagtgaaatcattcactacgctaacgacatcccgatgcaactggaagtgcgttgggtgaatagccgttcggtgccacactatttggatcaagattttacccaaattacgcccaaccaatatttgtcgcaaaactgtccactgagcgcgattgaacatactgtagaagccattgtggccgatgcgcatgtcaaacaagcccttgcacttgcggctaatgaaccttgcttgctactcaatcgccgtacttggagtggtgacaagctggtgagctcagccctgctctatcatccgggttcgcgctataaactcagctcgaaaattctgttcagccaatagccccacatgatcacattttcgcaacattcaagttgcgaactttcacgctttccactatttatttgtatatacatttgaaatatcgatatctggatggaaagcgatgaattgtgtgttgaccgaagcgcgtttagtaaccatgcaaccgggcgtgcaaggttatcagataaccgagccgcaaaccctcatcattgagcaggggcgcattcaacacattggccaacatattgaccttcccagcgatgcgcatcctatctcgtrtgccggcaaattagtcacaccgggattgattgattgccacacccatttggtttatgccggcagccgcgccaacgaattcgagctgcgtttacaaggtgtgccctaccaaaccatcgccgctcaaggtggcggcattctttctaccgtgaatgccactcgtaaggccagtgaagaagcgttgatcgaactcgcgctaccgcgtttggatggcctgctgcgtagcggtgtcacttccgttgaagtgaaatctggctacggtttaacgctcaaggatgagctgaaaatgctgcgcgccgccaaagcgcttgagcagcatcgccgcgtcaaaatcaccaccacattacttgccgcgcacgcactacctcctgaatttcaaggccgtagtgatgactatatcgcgcatatttgccaagagatcattcctcgggttgccgaagagcaactggccaccagcgtagatgtgttttgtgagtcgattggctttagcgtggcgcaaactgaacgcgtgtttcatgctgcgcaagcgcatggcttgcaaatcaaaggtcataccgagcagctttccaacttaggcggcagcgcactcaccgctcgcatgggtgggctctccgttgaccatatcgaatatcttgatgaagcgggcgtgaaagcattggcgcaatcgagcacggttgccaccttacttcccggtgcattctactttttgcgcgaaacccaaaagccgccgattgaatggctgcgccaatatcgcgtacccatggccatctctaccgatttaaaccccggcacctcaccatttgccgatttgtccctgatgatgaatatgggctgtaccttgtttgacctaacgccagaagagactctacgcgcagtgacatgccatgcagcgcaagccttgggttaccccgcaaaccgtggacaaatcgcagaaggctacgatgctgatttggcgatttggaatatcgaacatcctgccgagctgagctatcaagtcggcgtttctcgcctgcatgctcgcatagttaatggagagctgagctatgaatcctaatttcaccactgagcacacttggcaaggccgccatgatcccgaagatggtcaagccgggcgtcgtgtgcaccatatcgcttgtcccattcaagtgggcgagctagcgaaccaagagccgggtgtggcgttgatcggttttgagtgtgatgcgggtgtggaacgcaacaaaggtcgcaccggagccaagcacgcgcccagccttattaagcaagcgctagccaatctcgcgtggcaccatcccatccccatttacgatttgggcaacattcgttgtgagggtgatgaattagagcaagctcagcaagaatgcgcgcaagtgattcaacaggctttgcctcacgcgcgggccatcgtgctcggcggcggacacgagattgcttgggcaacctttcagggtttagcacaacattttctagcaacaggcgtaaagcaaccacggatcggcatcatcaattttgatgcgcattttgacttacgaacatttgaatcagaattagcaccagtgcgcccaagctcaggcacgccgtttaatcaaatccaccatttttgccagcagcaaggttgggattttcattacgcctgcttgggagtgagccgcgccagcaacacgcccgcactgtttgaacgcgcagataagctaggggtttggtatgttgaagataaagccttttcgcctttgtcactcaaggatcacctgactcaattacaacactttattgatgattgtgattacctctatctcaccattgatctggacgtgtttccggcggccagtgcgcccggcgtcagtgcgcctgccgcgcgcggtgtgagcctagaagcgcttgccccctatttcgaccgaattcttcattacaaaaacaaactgatgattgccgatatcgccgaatacaacccaagtttcgatattgatcagcacaccgcgcgcttagccgctcgtttgtgttgggacattgctaacgccatggccgaacaagtgcaatccatccgtcacccgtgaatcaaaaggagtctcaacatgacacagtcatctgcacaaggaacaagactggacactcagcgcaccattcgcgcccctcgtggcacacagctgcgcgccaaatcttggctcactgaagccccacttcgcatgctgatgaataacctcgaccccgatgtggccgaacaccctcatgcactggtggtgtatggtggcattggccgcgcggcgcgtaactgggagtgctttgacaaaatcgtcgaagtgctggagcgcctcgaagatgaccagactttactggtgcaatcgggtaaaccggtgggggttttccccacccacaaaaatgcgccacgcgtgttgattgccaactccaacttagtaccacactgggcaaactgggagcatttcaacgagctcgataaacaaggcttgatgatgtacggccagatgacggcgggatcttggatttacattggctcacaaggcatagtgcaaggcacttacgaaacctttgtcgcggttgcgaaaaagcatttcaatggcgatgccaaaggccgttgggttttgactggcggattgggcggcatgggcggcgcgcaacctttagcggcgacgatggcaggattctcgatgattgcggtggaatgtgatgaatcgcgcatcgactatcgtctgcgcaccggttatgtcgacaaaaaagccaacacgcttgatgaagcgctggcgatgatcgccgataccgatcgcccaatttctgtcggcttactgggtaatgccgctgacatcttccccgaattagtcaaacgcaacatcacccctgatgtggtgacagatcaaacgtcggcacacgatccactcaatggctatttgccactcggctggagcatggaaaaagctgcacagatgcgtcaacaaaatgaagctgaagtcgtcaaagctgccaaagcttcgatggcgatccaagtgcgcgccatgcttgatttgcaaactcgcggcgctgcgacgctggactatggcaataacattcgccaaatggcgctggaagaaggtgttgccaatgcgttcgacttccccggttttgtgccggcctatattcgtccactcttctgtgaagggataggtcccttccgttgggcggcactctctggcgatccggaagacatttacaaaaccgatcaaaaagtcaaagagctgatccctgacaacccacatctgcataactggctggatatggcgcgtgagcgaatccacttccaaggtttacctgcccgtatttgctgggtcggtttaaaagatcgcgctcgcttaggcttagcttttaacgaaatggtgaaaaatggcgagctcaaagcgccaatcgtgattggtcgtgatcacctcgattcaggctcagtcgccagcccgaaccgcgaaaccgaaggcatgttggatggttcagatgcagtctctgattggccactgctcaatgccctactcaacaccgcaggcggagccacttgggtttctctgcaccacggtggtggcgttggtatggggttctcacagcattccggtatggtgatttgctgcgatggcagtgatgatgccgccgaacgtatcgctcgtgtactgcacaatgacccagccacaggcgtaatgcgccacgctgatgcgggctatgagattgccaaacgctgcgcgcagcaacaaaaactcgacttacctatgctcaacgctgagctggccaaactcaagtgaggaaagaaaccatgttgcacctgatgatcaaacccggccaactcagcttaaaacagttgcgtcaagtgagccgctcacccgtggtgttatccctcgatccagaagcgattccggcgattgccgaaagcgcccaagtcgtcgaacaagtgatcagcgaaggacgtaccgtgtacggcatcaatactggttttggtttgctcgccaacaccaaaattgccccgcaagatctggaaacgctgcaaaagagcatcgtgctttctcatgctgcgggcatcggtgagctgatgtcggatgaaaccgttcgtttgatgatgctacttaaaatcaacagcttggcgcgtggctattctggtatccgtcttgaagtcatccaagctttgatcgagctcgtcaataaccagatttatccttgcgtaccgaaaaaaggctcggttggcgcatcgggtgatcttgcgccgctggcgcacatgagcacagtgttgctcggcgaaggccaagcccgttacaacggcaaaatcatttccggtctggaagcgatgaaaattgcgggactagagccaattaccctcgcccctaaagaagggctcgcgctactcaatggcactcaagcctcgaccgcatttgcgctcgaaggattgtttgtggctgaagatctgtttgcatccgccactgtgtgcggtgcgatgtcggtcgaagccgctctgggaagccgtcgccccttcgatccgcgtatccaccgcgtgcgtgggcaccgaacccaaatggatgctgcaacggcgtatcgtcacctgctcgatgtcagcagcgaaattggccaatcccacagcaattgtgaaaaagtgcaagatccttactctctgcgctgccaaccacaagtgatgggcgcttgcttgcagcaaattcgaagtgcagctgaggtgttggaagtcgaagccaactctgtttctgataacccactcgtgtttgccgaggatggcgacatcatctcaggcggcaacttccatgctgaacctgtcgccatggctgcggataatttggcgctggcgattgctgaaatcggcagcctctccgagcgccgcatggcactgctgattgacagtgcgctgagcaaactaccgccctttttggtcgacaatggtggggtgaactccggctttatgattgcgcaagtcacggcagctgccttagccagtgagaacaaaaccctcgcgcatcctgcatcagtcgacagtttacccacttcagccaaccaagaagatcacgtttccatggcgacgtttgccgcacgcagactgcgtgacatgggcgaaaatactcgtggtattttggcggtggaataccttgcagcagcacaaggattggattttcgtgcaccattgaagtcctcaccacgcattgaggaagcaaggcagatactgcgtgaaaaagtaccgttttacgataaagaccgctattttgcgccggatatcgaaaaagccaatgctctgctgcaacttgccgtacacaaccgtttaatgcccgatcagctgctaccaagccagcactaagtgactgacaaatcaacatttcaagagccctatggggctcttatacttaaatcacttgaagtggtaaaagaacatctccactggatagaccaatgattgtaagattctgtcctataatgcgcgcagtttagttgagatagcgataaccatgttcctgactgcataccattcaaatcaacagcaccaatttcaatttactcgccaacaggctagccactttgccaaattggtcgcgggtgatttcaaccccatccatgacgaagatagtaaacgtttctgcgtaccgggcgatctgctgtttgctgtattgctgcaaaaagaaggcattagccaaaagatgcgttttgatttctctggcatggtgagtgatggcgttgctctgcacattgaaaataagtgtcagcgtgaaagcgcagtcgtggatgccagcggcaaagagtatctgcacatgtcacgtgaaggtgaagtcaaccgcaaccctgcttttattgagcatgtggtgaccagctatgtgcagttttctggcatgaacttcccgcacatcatggtgccgttgatggaagagcagcagatgatgatcaactgccagcgtccactggtgatttatgaatcgatggaagtggaatttacccgccttgatctcccccatccagaagtagagtttgcgggcgcgacctttgatgtggatggcaaacgcggcttagtgacactcaacttcgtgtttaaagatgaaggacaagtggtcggtaaaggcctaaaacgtatggttgccagcggtttaaaaccttacgaccaagcggaaatcgatgatctcgtcaaccgtttcaatgagcgcaaagaagccttccttagccagattgagcaagcggcataattcgtagagcatctaaatctaatgcaaaaaaataacccgcggatagcgggttattttttatctcggataggtaatcaagcggttttccgtctcatccacaatggagccaaaagcagcaaaccaaaccagccgatggaaccgccagaagaggcacttggggcaaaaggcgaagtatccagttgaatacgagacgttgcacgtttagaacctcccgcatagctaaagatcaactcaaagtcatactgatattgacggtagtgttgcgcatcaacagccacttctacactacaactttcacctgtggctaacgtcactttagtactgcacccatcggatagcacactaaaatcagcgggcagacttgagaatgtgtttcctgtataggtcagcgcattagcatcaaggttggtatatgtaaatgattgactcactttacctaatggacgaataccgagattggcgacttgatcatagctaagctggttagtgtgctttgtgatccaatcacgaaaataactgacgttggtatacacaccataagtgcctgttttagcgcattgttcatccccccaactcacaatacccagctgctctcgacccgttttaactacaattgggccaccagaatctccctgacatgaatctttcgtaagacgagcggcacaaaagttggtcgaattaggatcagaggaaattccatgctgcatgactatttggcaaagcgattgcgaaaccaggtcaacatccacttcttgtagtatcggagtaaattgtggcggttttgattgcacggtaatcccccatccagccactgttaaaggggttaatgctggtaaagacgtgcgtgttgcaggacccgctaaagtgatggcaggcaaactactggtttgtgctaactcgacaatcgcaatgtcattcaataagttactgggactataactcaaatgacggtaaattttttgcgcggcaatcctttctccttgagaagagttattcagatcataagcaccaataatcacatccacactagcagcactacgactatcaaaacagtgagcagcggttaagacatatcgtccacctaaaaaactaccgccacaaaattgcccttgataagcatctgcaccgcgtttaaccagagccacaatcgatggccattcggcagagtttgcattcgaaccattaataatacgagatgaaatatctgctgtggattccgcatagagcagtgtagagaaaagagaaaaaccgataaaacacgacagcaatttagaaacctgatgcacaactcaatcctttcattaatcagaaattatcatttgatagctcgttatatcccaacgacttggaacgataggtaggcgacaagtcattgacaagtttgttgggaacaaattgcgccgcacgccagccactaccactgcaacgtcaagtaggaaggttatcctacgcacaaatctataaaccccagaaatgtttcaaactctttttcacaaatatgtgaattttagctaaaaatgctaagtaatcggacattacaaccagcgtctcactcgctttttgtaatgtagataagcttcgccaaacttggcttctagaatccgctcttcaggctcgatttggtattgattcatgtacagcaaaaaaccgccaactatcaccaagctaagagcgttctcttgccagtaagcaagcccaaacagcaggagcagtaagccgagatacataggattgcggctgagtgcaaaaacgccgctgtctaccacagtggccgcgagatccggagccatggggttcaccgtcgttttaaaacgacgaaactccaacaaaccagcaatcccccagaaacctgagctgcaaaaacagagcgccatgactaggcttggccacggtagtgtaatggttaatgttggaaagaggatggaagagagatggatgagcgccaaggccaccagaaaaaccgcgactggaggaacctttaattctaagtttttcataatcacctcaattcaactgaatgaaaaagcccagtggagtcactgggcattctgtttatagcaagtgtaacagagcctgcaacggatgcttaggtttgatttgctcaaaccgtttcacttggctacgacacgagtaaccggtgaccaaacagcgctctttcggtagcgacgctaatgcgggttgccaactcaaatcgtaaatatcgcgagacatggttaatttatccacctcatgaccaaaggtacccgccataccacagcaccctaccgccaccgcattgagctgcgtaccaaagtggcggaagatttccacccactctttttccgcattcggcagcttagttttctccgtacagtgcgccaataagtaccaaggctgtgcatcggttacttgaggcgtaaactgcgacaggcgtggtttgagccattcatgaaccgtcagaaccgaaaactcaccgcgctctttgcctaatatttcaacatactcatcgcgatagcaaagcaccaaagcaggatctacacccacgagcggaatattgagatccgccacttgagtcagaaatgccgcggtattcgctgccgtcgaacgaaattggcgtagaaagcccttaatatgttgcgctttgccattgggtttaaacggcaacaatactggttttttgcctaatttaagcagcagggcgacaaaatcttcgaccacatccgcatcgtaataactggtaaacggatcttgcacgatcaacacatgttgctcgcgctcttcttgcgataaccccgccaaacgctgcatatcaaacaggacgacgggatgacggcgtaaacgctgtgcgagtgttggtaccgacaagagaggcgcatcaacataacccaccgttttagcggttaatttttgcaccgaagattgtgctaacacactattcaccagttgcggagccttcgccatcacaggtaataaggtttcgatattcgcgactaaataatctttgactgggcgcggataacggctgtgatagatattcagaaaacgcgaacggaaactgggcacatccaccttaatcggacactggcttgcacaggccttacaggccaagcaaccattcatcgcttcgtacacttcatgcgaaaagtcgtactctttatctttgctaaaagcatgacgaacccgatctagcatagatttaattgttggcgaggattcgagcgtggctttttcaagatcgaggatatcaataccctgctccgtcagttgacgtaaccattctcgcactaatcctgcgcgccctttcggcgagtggcgacgatccgccgtcaccttcattgaaggacacatcggggagctagtttcgtagttaaagcacaaaccgttaccgttacactccatcgcttgcttaaagctgtcgcgcactttgacgtcgatttggcgatcgtaaaaaccacgtttagtgtcggagactttcaccagctcaaacggtgtatcaagtggggtacaaatcttgcccggattcatcttattgtgcgggtcaaacgccgctttcacacgacgcagttcagtgaacagctcctcaccaaaaaattcagggccatattccgaacgatagcctttgccatgctccccccacatcaaaccgccatatttagcgacgagcttaaccacttgatcggagatttcacgcatcaacaattcttgcttgggatcgcacaagtcaagcgcaggacgcacatgcaatacgcccgcatccacatgcccaaacatgccatacgccagatttttggaatcgagcagcgcgcgaaattcaacgataaaatcggctaagttctcaggcggcacacaggtatcttcggtaaaggcaaccggtttagcgcggcctttggctgcaccgagcaagcccaccgcttttttacgcatattgtaaatgcggttgatgctcgctaaatcactacagacttgatagccaataattcccgcttgttggttggccatcatctcatcaaggcgcgcggttaattgtgcgacttgctgattaatctgcgcgctgtcttggcctgcgtattcgaccatattgatgccttgcatctctttgccaggcacatcagtcagcaagtcttttacgctgtgccaaataatgtcttctttggcaagattgagcactttcgagtcaacggtttctaccgacaaagctttcgcttcaaccattaaaggcgcattacgcagtgcagaatcaaagctgtcgtatttcacattcactaacgtgcgtgctttggggataggcgttaaattgagtttagcttcggtaataaacgccagtgagccttctgcaccacacaacacccgcgtgatatcaaagcgatcttcggcttcatttagggcattttttaaatcgtatccagtcaaaaagcggttgagcggcggaaatttcgcgacaatttgcttacgtttggtgcggcaaacctgctccgtgacttgcatcgcttgcgcagcaaacgtattgggagcaggcaaaccttgcgagagatcggtttccagcaaagaaccatcggcaaataccgcttgcagcgagagtacgtgatccgacgttttgccatattgtagcgacccttgccctgaagcatcggtgttaaccatgccgccaagcgtcgcgcgattactggtcgaaagatccggagagaagaaaaaaccgtgtgggcgtaccgcatcattgagttgatctttaatgacccccgcctgcactcgtacccatccctcttgcgggttaatttctaggatacgattcatatgccgcgacaaatcaacgaccacccctttagtcagcgattgaccattcgtgcccgtaccgccaccacgaggtgaaaaagtcactctctcaaattctggttttgaactaatctttcctataagaacaacatcagcggtggatttaggatgtacgaccgcttgaggcaattgttggtagacgctgttatccgtcgctaccgcaagacggctggagtattgggtttcaatatcgccggtaaatcctgcggtttttaactcgtgtaaaaaagttaaaaccaccggatcaacgtcggattggtgatggagtcttggtaacatttgcttcctgcccctactacgctgatccaatcagctttgggttattgttagattttaaagagtaatctttgaattcggtcactttacaacatttaaaatggtgatcaaatcagaatctgagtgccagaatgcggtgaaacagaattttttcaactttgttatcaccgagccattctgttatttcgcttatttagaactgtatggaaaaaacgatgaaaaaaaatcaaatagtaacaacggaagatatcctactcatgctgtgccaatcggtttctacggttctcacgtccgcaacgaattcaccgatccactattccgcaatggtacaaaaaattaataaaacctcgctgaaaccagatttcggctgttttgtgttgtttgatggcggttttactggccttgttgtgatcaactttactgccaaagcggcgcttgaggtttacaccaattacatgcgtaacatgggcatgccagaagaagaactcgcggtattacacacctccgatgaagttggcgatgtattgggtgagctgatgaaccagcttgtcggtgacttcaccaacaaagtgcgtaaagagctgcaaaccaacattacccagaaccagcctaagatgctttcattgaacaaacaggtgcttttatctgtagataccaaccttgatcgtccacaggcgcgacgtgtgacattttcaacagccaataacaacatcttttatcttgaactggcgatggacaaaaccgagtttatccaactcgaagagttcgacgttcaggaagatgaaagccctgacgatattctggccgcaacacagaaacagcaaaaatcacattcagttgctaaccactccgaagaagacagtgcgtctgccgatttgttggatcagctcggcatctaaccccttctcaaaaatcgtttagcgtatcaggctatcttgtaagagatggcctcttcccttttccttagccgccaaaaacgctagaatgtcggacttttcttaagccgtaccgaatctattttgcttgctaatggataaacaaaaagcccttaaaaaaatcgccaaatgccttgagctaggtaattccgccaatattaatgaagccgcaaacgcgatcaaaatggcgcataacctcatgctcaagtatggtctcgacaaagacgatatcgagttcatcaaaatgggcaagacacagtcgacccatttgcttccggctgccatttcttctgggattttgcgagtgatccgaggcatcaatacccgattcggtgtggaagccgtattgctcaaccataaaggcttaaaacgcgttgaattcattggagaagcagatcgtgccatcttcgcggcttttgcttttgacattatctatcgcgaaatgaacgagcaaacaggccaattccgtaacagttttgctggaaccggaacctcttcactggaggtaacacgccgagttaactcgtttgtttctggctggattgaaggcgctttagaaaaattacccatcatcactccggacgaagactccatgaacaaaatcaatagctatattgataaggaatttgagaatatcgaccgtgaaaccttcaaacagcaattgcgtgaagcgatgaaaaatctgacggaagattatgagacgggactcaaaaaaggtcgccgcgtctcagtcaatcgcccgattcacggcgcgcaagccccaaaattactcaaataagcatttgtaagagattggtaaaatgcgccccccactgattgacggggaacgagaattctcgtctattgcgcgaaatatcattcaataaacggagagaatgtgttgaacaaaaccactttgctgttagccgcagtcgtcgctttgtctggctgtcaggctacccaacgccaaaatgcgacaaccggagaaacagaaaccaacgccaccactaaaggtgcattattaggcgtcctagccggtgcagccgttggtttagcgacaggtgacgatgccaaagagcgccgtaagcatgccttaattggtgcagctgggggcgctgcagtcggcggcggtatcggatactactttgatcagcaagaagcagagttacgcaaagcattactggattctggtgttcaagtggtacgcgtaggtgaaaatcaactgatgctacgcatggaaaacggtattggctttaccagcaactcttaccaactggatagctatatccataaaactttacgcggtgtcgcgcgtattctggtcgaatacccagataccagcttagtgattgaaggccataccgatagcacaggtagtgataccaccaaccaagtgctttctgagaagcgtgccgagtcagtgcgttcattcctgttatctcaaggggttgcagcggggcgtgcaattgctcgtggtaatggtgagcgtttccctctatgctcaaataacaccgcagaaggacgcgcttgtaaccgccgcgtcgagattcaaattctgccactcaaatagtgtttaaacgctcattagcttgaagttgcagccataacggctgcaacttcaactcaacagcgaattgaccgaacgtttcattttcagggaaagaaagatcatgcgtttgcggagtttatggctgtttttgctgttttcattgccactggcggccgctgatgatgtcacaagactcacccaacttgcccaagagcaaaatccgcaagctcaatatcaactcgctttgacttatcaaaccggaagtagcaccccacaaaacctgaatgaagcgttttactggtttttacaatccgctgaattgaaccatccacccgccatggcacaagtcgccaacgcatatctgacaggccaaggagtggaaaaagatccactgcaagcccaatattggcttatcaaactagctctggctggaaatcctcaagcgggtacgaccttagccaagtggtatgaacagcatcccaccgcgattgcggcgctcgatctggctgagatttggtatcgagtcaacgccaatcaggacccagaatctgagcaaggatacgcgcgtttactggaacaaaaattcaatcagcaacgcgaaaggcagctcaacagcataggtcaattggataacctgattgatcgggatcttgcccgccccgccagcgcactacccgttaataaagaagcgcaaaccatcaccagtgattggctattgccgactttggtggcgctcatcttattactcatcatcatcacgatccgcatgatatggcgcagacaacgcaaccatatcgtcgcggtaaaatacgttgactacgaagggaaatggaaagagcaacagttcattatcaaaaggcaaaaacagcagttagaccatctctatcaagagtgtaaacggctacaacagaaccaaaccagcgaccttaacggccaaaaagttgcgatggcctacgccttaatgggttttcaccaaaaccaacggcctgacgtcaaaatgatcaagctgcgctacaaacagttatcgaaaatttatcaccctgacctgcatggcagcgaagaagagatgaagcgcttaaatagcgcggtaaaaatcgtgatcgattcagttaataaatcgttacagaaacaagcataacatctgaaaattccgactcaaggcttgaaaaatcagcctatgcgcaatcgatctccttctcatccataattacaaatagttaactttttttatttagacgtgccataatccgcgcgaaatttacgcctgatttaggtgggagagaagacaatgtttagcgtagaaggcatctgtgattggtgtaaacagccaaaactactgacaagacatgaatatgtggatggtaaagcacatcattcttgtgaaaactgcaatgagtttgcccgaatggatgtaaggcaatttaatttagccgagatggcattccgagaaaaacaacaagcagctcgataaactgcatccccttcaacttgaaaaagcgccttctggcgctttttctgttttctccgcacatacctgtataagccgccgcacggcttccgtggcattgctcacaaaaaccgcatgtccctactttttttccacctttatcaacaagaaataaaattaatacaaatcaaatagataaaaaaatcatcgtgtagcaacgtgaatttctgtgctttttttatccaaaaaccagttgcaaaaacaaccaaccaataatactgtatttacatacagcatgtatggagagacagtattatgctacacactgaattcaaacattttggcttacataactcgcccacactcagcgcattatgtgcaaagaatgatctgggcgagacaaacctgatgctgcgactggtcagtttgtcagagcgctcacaatggattctctataccgctcaatgtcaacgtccaaaccgtcaatcactccatgagcatcagatcgattgtggcaaggttatccatctcaaagcatcaacatgccactctgaagcagagattgtcgcaaaggcgattgcctgccgaaccgccagtgcgattgtggcatccaatgcgatagatagcgtgactcaaaagcagttgatgcactttgccaagcagcatggctgtgagctgttttttattaagcaaaccacgcattcactgcactgatccataaacaacctttacttaaacaatctggcagggataaatttaagcaaacgtttgctttttgtctggcagcataaattagttctggtatcatgcgctcagcccgcggtttttcactcagcgaaatcgctaaaacgatgtttgaattcagataggaatgtctcaatgagccttgcagatcaagtccttgccgtcaatgacgacctccccattcgtacccatcagccagtacatagcggtaaagttcgctcggtttactggctgactgagcaagacagccgacgcctaattaaagaaaaaggttatccggttgcagaagatgccccgctggccattatggtcatcagtgatcgtatttcagccttcgattgcatttggcacgcggaaggcggtgtccatggtgtaccgggtaaaggtgcggcgctcaatgctatctcgaatcattggttcaaactgttcaagcaacatggtttggcggaaagtcatattctcgacattcctcacccttttgtgtggattgtacaaaaagcccgtcctatcaaaattgaagccatctgccgtcaatacattactggctcaatgtggcgtgcttacgccaaaggtgagcgcgagttttgtggtattaccctaccagaaggtttagagaaggacagtcaactgccagagctactgatgaccccgtcaaccaaaggtattctgcgcggcatccccggcgtgccagaagccgatgacgtgaatatctcgcgccaagatattgaagccaattacgcagcattcaacttcaatcaaccacaagatattgaccattacgaaactctgctcaagcaaggttttgctgtgatcagcgaagcgttaaaaagcgtgggacaactctttgtcgataccaaatttgaatttggctacgtagcagatcagcaaggacagcaaaaactgatctatatggatgaagtaggcacccctgactcatcacgcatttgggatgcgcagcaatatcagcaaggcaagattgtcgaaaattccaaagagggattccgccaatttttgctgaactacttcccagacccagacattttactcaacaaagatcgcatgcctgaacgtgaagcgctcgcgcgtgacaatgctttaccgctggaagcattaatggatatctcgcggacctatttgggtattgctgaaaagatcacggggcaacctatccatctgagtcatcagccaaaacaggaaatcatcgcaatcctagataaagaatatgggctgattgaaagataaactccatctgcggcttttgttatgcctcgctgctttgaatcataagccagcggcaagcacgagccagcaacggatgaaaaactaaggggcttatttgcttgaaccacttggcattgcaggtacacggcaagtagcaagggtatagccccttaattacacttctattgagtgttcttctactcaccgcaacagagaagttctttaaagcttgatcaaaaactcttcttgattagtagattcaatatgcgctgcacttttgctttgaatcgtagttaactgctgctcatccaaggcgtaaggcatgactaaggttaattcatcaatgccttcttgtttggctaatttcactaaagtgatcacattcgattcatcactcgaacgggtggaaagctctttgagggcgacatcccacaggcgttcttgtggactctgtcccgttttgatcgcatcaaaccagacaattccaaacactggagcaaaagagctgatggcttccgagaaagtccactttttcgcacaggatgcccccaaaaaggtggtgtaatcgaacactgcgctaatccttgctttttccattttgtcccccgacgccattggcaacacagtgctgcaactattgaccaagccttgctatatagcaatacgatataaaaaaacggtctgttatgatgcgtaatcggtttcaaaggctatataaaaaccaatttagtaacactgtacctacatttttaaaatgatatgtgccttgttgattaatattttcctattcaaacaaaatcgtgctgccgaacaatgattccttcttattcgatgaagcgctagacgctgttcctcccttgcttaactcgttgcacataaatcccccaccctaaaccgataaacctgttttaaacactgtgcttgcgcacagaagcaggataatcaacagaggcaagccgtttgtctatttacaatccaaccagcaagtcggtatcattttcgcgtttcacttctaccctaccaatcaataggccgaacatgaataacgataaacgtccgctgtatatttcctacgcaggcccagctcttctcagtactcctctgctcaacaaaggtagtgcctttagtgcggaagaacgtgcttcttttaacctagaaggtttactgcccgaagcgacggaaaccattcaagaacaagtggtacgcgcataccaacagtaccgtggttttgaaagcgacatggataagcatatttatctgcgcaacattcaagacaccaacgagaccctattctaccgcttggtgcagaaccatatttccgagatgatgccaatcatctataccccgacagtgggtgcggcgtgtgagaacttctccaacatttatcgccgtggccgtggcttgtttatctcttacgctaaccgtgatcgtattgatgacttgttgaacaatgccgccaaccacaacgtcaaagtgattgtggtgaccgatggcgagcgtattctcggccttggcgaccaaggtatcggcggtatggggattcctatcggtaaactgtcactttacaccgcttgtggtggcattagcccagcgtatacgcttcctgtggttctggatgtgggtacgaataacccgcaacgtcttgctgaccctatgtacatgggctggcgtcatccacgtatcactggacctgactacgacaactttgttgaagagtttatgcaagccgtgcaacgtcgctggccagatgcattgatccagtttgaagactttgcccaaaagaacgccatgccactgcttgagcgttacaaaaatcgcgtgtgctgttttaacgacgacattcagggcacagcggcggtcactgtcggctcactgcttgctgcctgtaaagcggcgggtagccagctttcacaacaacgtattaccttcttgggcgcgggctctgcaggctgcggtatcgcggaagcgatcattgcgcaaatggtgtctgaaggcatcagcgatgagcaagcgcgctcacaagtttacatggtggatcgctggggcctgctcgaagaaggcatgccaaatttgctcgacttccaacagcgcctagtgcagaaaaaagccaacacgcaacattggacaacggaaaacaacggctactcgctgcatgatgtgatccgcaatgccaaaccgactgtactggttggtgtgtctggtgcgcccggtctgtttagtgaagagatcatcaaagagatgcatcagcactgtccacgccctattgtcttcccgctatcgaacccaacaagccgtgttgaagctctgccgagcgatattatccgttggactaacggtgaggctttggttgcaacaggtagcccgtttgatcctgtgctgcatgaaggcaaaacttacccaattgtgcaatgtaacaacagctacattttcccgggtatcggtttaggagttttggcagcaaacgcacgccgcgttaccgacgaaatgctgatggagtcgagccgtgcactggcaagttgctcaccgcttgccatcaatggtcatggaccattattgccgcctctggaatctatccactctgtttcgaagaagattgctttcgcagtagcgaaaaaagcgattgaacagggtgtggctccagaagtcaccgatgaagcgctggaagcctcaattgaacaacatttctggcaaccagtttaccgccgttataagcgcactgcgttttaatttatgcggagaagcccctgcaatcaggggctttctaatctcatgcaactatttacttatcttgctcctgcaggtcaggctctactcccctacctgagcgaaatctcgattgcactggtcgcatgcactttggtcatgctcggtggtgagatcaatgcctttttgcgtagagcattacggaatcaacattttctggtgcgcacgttagcgtttatctttattaacgcgtttggatacggtttaatcatcgtcaaggccagcccttacgttgctcggacactcgcgcaactggaatccggcatgatgctgacccttatcgtaagctgctttgttgtgataggcctatgggcacaaagaaaccatcaaatctaactctgcgcgccgtcgttttctctgcgctggctcacctgcgaagattaccttggcgtaaactaagccaaactttgctgtggctgactattggggttgtcgcaggcttactcgcgatcgatcgctgggtcagttggcaaacacaaaataacattattaatgatgcgcaaaacactccgccttttcaggttgcagtggtattgggcaccagtaaatacataggcaagactctcaacgagtactacaccaaccggattgatgcagcgatagcgctttatcaacaaggaaaagtccgcaattttctgctcagtggtgataacgcccaccgttcgtacaatgagccgtggacgatgaaacgcgatttgctacgcgcaggcattccagcagagaatatttcgttagattatgcggggtttcgtactctcgattcgattgtgcgcgcgaaggaaatcttcgataccgataatttcttgatcatcactcagcgctttcattgtgagcgcgcgctgtttattgcccgctaccaagatattcaagcgtcatgcctagcagtaccggggccaagcaaccactctggttttaaagtgcggttacgagaagtgtttgcgcgcgcttatgcggtctttgatctgttcgtgttggatactcagcctaagtttctcggtcccaaagagccgatcatcgttgagagtgacaccgagtcaacgtcaaatgacacctcatcgaatagcgctgaataaatccgtctcgataagctaatccctgaatgttgtcgcgtaccctgcggcaacattcttcgtgattgaatttaggctagatagacacgacttggtgccgtactcaccctttttctccatcactgcttttggccattaatccatagtgaacttcgattcgattgcggccaagccgtttggctcggtacaacgcttcgtcggcgcgtgaaacggtttccgtaatccgctcgtcgcccatttgggcaataccgatactgcacgtgatcgcacctccgtgtatccaactgtggtcggcgattttagctcgaagccgctctgcaagctcaatcgcttgctcaagggttgtctgcgcgcaaaacaccacaaactcttccccccccaacgcactaatttgtcactttctcggatttcacggctgatgaccaaagcaaactcacgcagcagatcatcccctagactgtgtccgtacacatcgttgacttgtttgaagtaatcaatatcgatgaacagtacgctaacgtgattgagttgccagcgcactaagcgcgcttgatcttgcaaccaatcacgaatgccatgccgattaatggctcccgtcaatgcatcacgatgcgccatttcgacgaactttatattttgctcatgcaatgagtgattcaaacgctgtaagtgctcttggcgcatacgagcacgtaaaacctcacggcgattacgacgaatttcgagcgcagagagccatgctcctgccaccgcccacatgatcaacatggcgagaaacagcttctctccagccacataatccccaatcaattccacttgatgtaaggtcaattgatattgccctagtggactggctgaaccggtcgcaaattcaattttattgacgttggaaaactcaggagcggagtgttcaatggcaatacgattatcaaccaaccaccacgtcattacttgcaagctgcgaatgggaatatcaatcacacctttcccaacgcccggcacaaactctaatccgttgtatttatgggtatattcatcatcaagctgagagtagatcggattgaaattacgtaaatacagacgcattgccgcaggctctgcagcggggccttgcaagtccacgttaagacgtatggtatggatatcactcaaatcgaggccacgttgagggtcgggattaaggtgaatagagatgccacaatatggccacgcgtagcgactggcattcaattcacagtccactttggcagtattgccattgagggataaggcgctggtcgatgtgccgccagcggtttgatcgttggtggtgaaataggcatagtgttgaggttcaatcaacactcgtttcgcagaaccaaactgccagtacagcaatacggtcacaatcgtgaccgcgactaatcctagtaacactcttggcagcactttcacaacctactccagcgtcaagccacatcattaacacgctctctcttaatacaagatacccaataaagagagattgcttccaaaaaatagcggttagatgcggttttgtcatcgactagagtatttcaaggtttctttttcagaggcatttcaccttttgctaaagcttcaagtaggaagggtatacccttcccactgagtcaatatcagtagaaaaggcatatcgctagaagtgaaagatgtctagaagggcttacgacttatgcaagctgtggtaaaccatcgcgtagaagagcaaatagatggtcaatttcttctgtggtgttgtagtgcatcagaccgatgcgtagtactccaccgcttgactcaagccctaattgacgaaccagcccaagtgcatagaaatgcccattccatacgcacacattctgttcgccgagcattttcgccatagactgcggtgtacagtctgtacacgtcagcgcaaatgtcggtgttcgcttcgcggcatctgctagctgcaaaccatgcagtttcagcgctggcatatcactgagcttttgcaagaaatactcactgaggcgctgttcatgctgctgatattgctgatagctctcaaccaaacgttcacgtaatcgagaattcgggtcaccccactgcgccaaatattgcaccacagcaataacgccagccagcccttcaaaactgagcgttccggtttcaaaacgtcccggcccttgattggttgcgggctcaactttataaggcagaatcgtgttttgccactgcggcgctacatacacaatcccgacgtgagggccaaaaaatttataggccgaacaggccagaaaatcacagcccagcgcctgcacatccggcaggtgatgcggcagatagtgcaccgcatcgacatacaccatcgccccgacctgatgcgccgcctcaataatagcttcaagttcaaccaatgatcccgtggtattggaagcaaaagtcaccgccactaaacgggtgcgtggattaatcaacgaaagcagatgcgcttgatctaaggtgcagtccgccgtattgacgcgagcctgatgcactattgcgcctttgtcttgagccgcttgttgccagctagaaacattcgaatagtgatccaatgcggtgacaatcacctcatcgcctactcgccaatcacggctgatcgcacggctaaactggaaagtcagcgacgtcatgtttgccccaaagacaatcgactctggggtggaggcattgagcagcgcttgcacatgctcacgagcactttgcactaactccacggttttcttgctcgaaaagtagtgcccaccaagattggcattgtaacgacctaagtaagccaccatggcatccagcaccgactgtggcacttgtgaaccacctggcccatcgaaaaacaccacaggcttatcattgacgatttgcgccagcgcaggaaactgctgacgcactgactcaggagtgaagcgcatggcgaccatccttcgcagtcaaaacaaaaacatccatatgcccttcttgttgatgatccaccgtgcggatcgggcaagcgttgtgccacagttggctatcggccaacatcgcaacttcgccattttccaatactttacggaaaaatggcgcttcatgactactgagatagagcatgatttcgccacccacaatgttgtagcgatcaatgccaacaatcgcaatatgatcaaacccatcttggtgcaccccttccggcgcgactaaggtttcatcgaataccgcagcgatccgcatctgatggatctcaatttcctgcccatcgggaagtgtgttggcttccataaacagcgcgcacaactcacgcataccgtcactttttaaagtagtactgagtaacggttcgaaacgtcgcaccacattgccttgaaaatggttaatttgatcggtctgcataaagtcatgcttgtccaactcaaccacttgcccatcaataaagcggatcacggagtaacgacgtagccgatactgcccgtccgcatgattggtatgcggtaactgcgcaaaagagggagcgagttgatgaatcgctgaatgactcagtttagtgatatgtagggtattggggtgagaacgtaacatcatcgactccttaatgggttagtcataccaccataaatttcacattttatttacaattaagactaatcgattattttgcaaaaacaatattttttgactcaatcaaccatcaggattgaaattttgtttttatattctttataaattgaaaatagcagtgtctacatccaaaagcgcaacctgaagacaggcaaaaccagaggctttcactaccttatggaaaataaggaagattgaaggcctattagcataaaaccatgcatcatggatcccgctctaacatgagaatcaagtggaaccgacacgagctagcttcacgtcgtaagagcataaacaattacgatttatgctcagcgaaccacttttattcgccatccatattccctacaatcgagtccaattattttcattggcttgcgtcttagttccgaattcaagccatgagttaactccctttcgtccttatcggagtacttcatgagtaacgtgaaacacagcaaacttcttatccttggctccggccctgcgggttacacagccgcggtttacgctgcgcgcgccaacctaaaacccgtgctggtcactggtatgcagcaaggtggtcagctcaccacgacgacagaagtcgagaactggccaggcgatgccgaaggcttaactggcccagcactgatggagcgcatgaaagagcacgctgagcgtttcgatactgaaattgtttttgatcacattaactcagttgatctctcttctcgcccatttcgtttgacaggcgacagccaagagtacacctgtgatgccctcatcatctctactggtgcctctgctaaatacctcggtttagaatcagaagaagcgttcaaaggtcgcggtgtatccgcttgtgcgacctgtgatggtttcttctatcgcaaccagaaagtggcagtagtcggtggtggtaatactgcggttgaagaggctctttacctatcgaatatcgcctcagaagtgcatctggtccaccgccgtgacagcttccgcagtgaaaaaattctgatcgatcgtctgatggataaagtggcgaatggcaatatcgttctgcacacgcaccgcactttggatgaagtactgggcgatgagatgggcgtgacaggcgtgcgtttgaaagatacccagtcagatatgacggaaaacttggatgtgatgggggtattcattgccattggtcatcagccaaactcgcaaattttcgaaggtcagcttgaaatgaaaaacggctacatagtcgtcaaatctggccttgaaggtaatgcaacccagaccagcattgagggtgtgtttgccgcgggtgatgtgatggatcataactaccgtcaagcgattacctctgccggaaccgggtgtatggcagcactcgatgctgaacgttacctagatagccagggtaaataacttacgcttcgcgtaacgccagtttttatttttgccaagcccgacgggtataaccgccgggcttttctttgtatactggcggcctattacaattattattctcattaagccttttcaaaatggacaagaaaaaacagcgtagcttgaatctctggctcaagcagcaaagcaaactggctaagcgctggctcgcaatagctgttgggttgggtgtgttatcaagcctatttctggtggcgcaagccgcactccttgcatcaattctgcatcagctgattattgaacaggtcgataaacatctgctcattccacacttctttggcttggctgcactcatcgcagtgcgggcgctgtgctcttggggacgcgaaatcgctggttttcgttgtggagaagagatacgccgttatattcgacagctaatcctagacaagttacgcgacttagggccagcctatatcaaaggcaaaccggccggctcatgggcagccttaatgcttgagcaagtcgaaaacatgcacgacttctttgctcgctatctccctcagatgtctctttcggttttggtaccgtttgtgatccttgcggtcgtcttcccagtgaactgggcggcaggactgatttttttgctcacggcgccattggtgccactctttatggcgttagtcggcattaaagccgccgatgccagccggaaaaactttaaagctctgcagcgtttatccgggcatttttatgatcgcttgcaagccctgaccaccattcgtctattcgatcgcaccacagcagaaaccgagcacatgcgcggcgcttcagaagtgtttcgccatcgcactatggatgtactgcggatcgcgttcctctcttctgcagtattagagtttttcacctcgatctccattgcactgaccgccgtgtactttggctttagctacattggtgaactcaacttcggttattacggcgcgagtgtcactctgtttgctgggttatttgtgttaatccttgctccggagttttatcagccgctgcgcgatctcggaacctattaccacgccaaacaactcgcggtgggcgcagccgaatcgatcgtcgattttctgcaaaccgaagtggataccttacacagtggcgagcgtcatctcagcgataatgacgatattgaaattatcgccaatgatctggtcgttcttagtccacaaggcaaacgcttagcaggcccgctctcatttacgttgcaaagcggcaaaaccaccgctctcgtcggaccaagtggcgcaggcaaaaccagcttaatcaataccatattaggctttatgccctaccaaggcagcttaaccattaacggcattgaactgcgcgagttagatcatgcgcagtggcgacaaaccatcagttgggttgggcaaaatcctctactgctatatggcaccattcgcgacaacgtgacgctaggcaaacacaatatcgccgatgagcaagtcacacagactctgcaagcggcttatgcccaagagtttgttgagcagcagggtttggattacccgatcagcgatcgctctgcggggctttccgtaggtcaagcccaacgcctcgccctcgctcgcgctattttgcaaaatggccgcttttggttactcgatgagcccacggcaagcttagatgcgcgcagtgagcaatatgtgatgcgtggactgaccgaaagcattcagcaacgcactgcgttatttgtcactcaccagttgcaaccgctgcaatcggtcgagcagatcttagtgatggaaaatggcttgctagtacaagcaggacattttgaagacttaagccagcaatctggtttatttgccactatgttagccgctaaccaagcgctacaagctgccaacaaaggggatctcgatgcgtgacctgctgccttacctaaaactgtataaaaaacactggttcggtcttacccttggcatgctgctggcgctgctgaccgttctcgcttcgattggactgctgacgttatccggctggtttttgtctgcggcggcagtggccggactcagtattgcccgagaaacctttaactacatgctacccggcgcctttgtgcgcggttttgccatgggacgcactgcaggtcgttggggcgagcgtgtcgttactcacaacgccaccttcaagctgctcactgatttgcgagtgtttttctttgagaaactgacaccgcttatcccgggacgtctgagcgcggtgcgcgatgccgatatgctcaaccgcatcgtggctgatgtggatgccatggaccatgtatatttacgtttaatcaacccagtcacggtcggtgtgctgggtattgcggctctcaccacactgattgcttggtttgatccgcagcttggcatgaccttaggtgccatcttgctactggttctgctggtgtggcccacgcttttttaccgcttggggaaaaagaatggtcaacacttaacgcagaataaagcggaattgcgcgttcgcacgctagattggttacaaggttacagtgaactaaccattttcggcgcagaacaaacctatcgtcaggcaatcttaacggcgcaagacaaactgcttcgtaaccaatacgttaacgcacaagtctcaggactggctcaatcgttactgttgcttgccaatggttggacactggtactgatgatctggctggccgccgatggcgtgggtgggcaaactccggatccgctgattgcactggtggcttttgcaaccatggccagcgtcgagttattgatgcctattgccggcgcattccagcatttggggcagactctcacctcggctcgccgcttaaatgagatcattctagccaaacctgaggtcgagtttaccgcgcaaccaaccgcgcataatggccaatacaacattgaattcaacggcgtccactttgcttaccaagcgaataaacccaaggccattgatgactttactttgactctcgctcaaggtcagaaagtggcgattgtcggccaaactggctcagggaaatcgaccttaattcaactcctttgccgttattgggatgtacagcagggtcagatcacgattggtggaacagacattcgagaatggcgagagagcgatcttcgtgccgccatcagcgtggtgagtcaacgggtggatattctcaatggcacgctgcgcgataacctgaaactggcgaaaccggacgcaaccgatgaagcgctcagtgatattctgcaacaagtcggtctagagaaattgctacaagatgccgcgctcaatacttggcttggcgaaggtggccgtcagttatccggtggagaaaaacgtaggctcggcattgcgcgagccctactgcataacgctccaatcctactgcttgatgaaccgaccgaagggttggacaagcaaaccgagcagcagatcatgcaactgttgcattgtcatttcggtcacaaaaccgtgctgtttatcactcatcgtctggtcaaccttgaacagatggatgcgattgcgctgattgaacagggccagttggtagaatatggtcatcaccatactctcctcgcccagcacggtcgttatcacaagctgacacaaaagctgtaacgcttcccgcctctcttcactgaggggcgtaagcacgcagcgcagagcaccatgtcaaacaataaacagcttcaaacaataaacagcttcaaacaataaacagcaaaaagccagtcaacatgactggctttttttataagcgacatcgctcgaagaaaggcgggcacttatccgcgcggcttacgcgagctttgttgctggttagccactttattgcgcgtgctcgattcaccacccggcttacggcgcgcaggggcttttccactacgacccggagtagctgaaattcgctcttcgtgacgacgtactgcacgacgaattttctggctacgggtacgctcacgcttacgcgttgcggcatcaggcgccatgttcagcaccgtttctttctctggacgcagttctactaactcacgcaggtagttcacttgcttgagatcaagctccatccaaccgccgcgaggcagttttttgtcgaggaaaatatcaccgtaacgtacgcgcttcagacggcttactgtcgtaccttgtgattcccacagacgacgcacttcacggttacgaccttcattgattaccacgtagaaagtatggttgatgccttcgccaccggcgtacatcacatcttcaaaacgcgccataccatcttctagctgcacaccacgtacgagattgcgaactttttcttccgtcacgtcaccaaagacgcgaaccagatattcacgttctacctgacggcttgggtgcattaaacggttagccagttcaccatcggtggtaaacagcagcaaacctgacgtgttggcgtccaaacggccaacagaaatccagcgtgaaccacgaattttcggcagacggtcaaataccgtacggcgaccttctggatcatgacgggtacacagctcgccttctggtttgtaataagccagaactcggcagatcacctcttcttgcgctttcacagacacaacatgtccatcgatgcgcacgacagcgttatcatcttctaggcgttcgcccagtacagctaccttgccattaacacttacacgcccagctcggatcagagcttcaagctcacgacgagaaccatgaccagcacgtgctaaaactttttgtaacttttcgctcatttatctacctatgtgtcgtcttctcagacgtcgaatgacgggttgcgatgttaaaatcgcggccgcgtagtatcgcaaattttgtggataaaagcacccgttttgtcagcgattcgcggccacctcattcaactactgaaacggggtcggatcaccggctccgacacgcgccactaccacttcatcgtcgctaaaatcaatcactgtcgtgggttgctgacctaaatagccaccattgaggatcacatccaccgcgtgctctaagcgatcgcgaatttcctcgggatcagactcagtaaaatcgttgcctggcaggatcagcgatgtcgacatgagtggctcgccgagcgcttccagtagatccaaggcaattttgttattcggtacccggatacctatggtctttcgcttctcattcatcagacggcgcggaacctctttggttcctttgaatatgaaggtgtaaggtcccggtgtattgtttttcaacaaacgaaacgccgtgttatccacacgcgcatacagcgaaagctcagacaaatcgcggcacaacagcgtaaaattgtgcttatcgtcgagacggcgaatttgacaaatgcgttccatcccgtgcttattttcaagctggcagcccagtgcgtaaccagaatcggttgggtaaaccactaccccaccattgcgaataatcgcgaccgcttggttgatcaggcgggtttgagggttctcaggatgaacataaaaaaactggctcatggttattcctcttcatcgagtctctcgactctattgcttggggataagccccaatctttccatacaggttctactccggcaggtaaccaaaggtttcggcccaactccatccaaggagaaggatagtgaaagtcactgccttgggaggcgagtagttggtattccattgcgtaatcacccaaggttcgtttttcctgtggtgattgctgcggctgggccacttccatagcatcgccacccgcttcaacaaacgcggtcattaagcgcttaagccatttcgccgtcaagtcatatcgtcccggatgcgctaatacggcttgtccacctgcggcgtgaatcgcgctcactgcttcactcattgaacaccagttaggcggtacataacccggattatcacgagtgaggtatttcttaaatacttgctgcatgttggttgcgtaaccattatccaccaaccatttggcaaaatgggcacgcgtgatcggcgcaccatcggcaatatgttgaacctcttctaacactccctcacgcgtcgctttttgtaaacgatgggcgatcagttcagcacgctcaactcgacgttgctgctgccgcgcaatcagctgccccaatgcctcactgtttgggtcgatgtttaaaccgacaatatgaatgtctttattttgccaaaccgttgaaatctcaatgccgttcactaattgtagcggatattgctgctgtgcaatgtaagcacgggcatccgccaatgcagccacggtatcgtggtctgtgatcgccaaaacatcaatctcaaagctgacggcgcgatcgatcaattgttgataagtaaaccgtccatcagaagcggtggtatgactatgcaggtcaattctcatattttttatttgcctgatttttaggcttgactttttatcgccgcactagttaactagtacgcaaatgcaagactctctgttagggctcactatgttacaagaatttaacccaaaccataaacccaatttcagtccagcggatgctgaactggcttggtggcgcacttggacaagttcttggtgggctcacgtgtatttctaagtttagatactcacacacctagcccgccaacttgagcgggctttttattggttttttccacctatcactgctgtttcgctactttctcaacgcggtgatcagtgcacaatcgaatcatggttaaggaggtcttatgaataaggccatcaacataaagaaaaccgcgccgcttgaggtgctacacagtgaattgccttatacgcaagatcctacggctttatttcatgctctttgcgctgggcgcagcgactgcctactactggaatctgcagaaatcgactccaagcaaaatttgaagagccttctgttagtggatgctgccgtgcgcattgtgtgtgaaggccatcaagtgacctatcatgcgctcagtgcaaacggccaagcgctgctcaacatcattcatagcaacctcactgatcggattccttgcaaagtagagaaagcgaaacttaccctcaccttctctacaccctgtgatacgttggatgaagactcacgattgcgcgaagcgtcttctttcgatgcgctacgtttagtgcagcacagttttgatctcactgaccacggtaaatttgcgctgtttttaggtggcttatttgcctacgatttagtggctaactttgaaccgctcggtgaagcacctgccgacaatcaatgccctgattacgtattttatgtagcagaaactctgatggtgattgatcatcagcgtgaaacttgccaactgcaagccacccaattccaaccgggcgatgcgctgcacagccaactcaaaagccggatgcgtgaaattcgtgcgcaagtgaatcaaaaattgcctttgccgagtgcgcaatctttatctgatgtggaagtgaccaccaatattagcgatgcagcattttgcgatatcgtgcgtgacctcaagcagtacgtggtcaaaggcgatgtgttccaagttgtgccttcgcgccgttttcgcttaccttgcccttcaccactcgcagcttatcaacggctgaaacagagtaacccaagcccttacatgttctacatgcaagatgaacgctttaccctgtttggcgcatcccccgaaagcgcactcaagtatgaaatgcacaccaaccaagtggaaatctacccgattgcagggactcgccgccgcggtaagcgcgccgatggcagcatcgattttgacctcgatagccgcattgagcttgaactgcgcaccgataaaaaagagaacgccgaacacatgatgctggttgacttagcacgcaacgatgtcgcgcgcattagccaagccggtactcgccatgtcgctgacttgctgcaagtagatcgctacagccatgtgatgcacttggtgtcgcgcgtggtgggtcagttacgtgaagatctggatgcgctgcatgcttatcaagcttgcatgaacatgggcacgctgactggcgcaccgaaaattcgcgcgatgcagttaatccgcgatgtggaacaagcgcgtcgcggcagctacggcggcgcggtgggttatctcacgggtgaaggcgatttggatacctgtatcgtgatccgttctgcttatgtggaaaacggcatcgcccaagtccaagctggcgcgggtgtcgtttacgactccgacccacaagccgaagccgatgaaacgcgcggcaaggcgcaagcggtaatctccgctattttatatgctcatcaagggaaggaatgatcatggccaatattctgtttatcgataactttgactccttcacttataacttggtggatcagtttcgctcactcggtcacgtggtcacgatttatcgcaataacctttctgcggatgctatcgagcaagcgctgctgcaactggataatcctgtggtcgtgttatcccccgggccaggtgcgccgtctgaaacgggctgcatgccagagctgctgcaacgcctgaaaggcaaagtgccaatgattggtatctgcttagggcatcaagccatcgtggaagcctacggcggtgtggttgctggcgcgggtgaaatcatccacggtaaagtatcgatgatggagcaccaaaaccacgcgatttatcgcggtctcccttcaccgttggcgatcgcacgttaccactcactggtcgccacgcaagttccatcagcactgaccgtgacggcagaagtgaacggactcgtgatgtcggtggttaatgaggctgacaaagtctgcggctttcaatttcacccagaatcgatcatgaccacccacggcgctaccttgctggccaatgccattgattgggcattgtcttcaacgccagcgcagactcaattcgcgtaaccgcacagggagagaatgttatgcaaaccattattaataaactctatgaacagcaagggctcacgcaagccgagagccaacagcttttcgaccaaattattcgcggtgaaatggatcctgtattgatggcggcggtactgactgcactgaaaatcaaaggcgaaacgccagatgaaatcgcgggtgcggctaaagccctgctcgccaacgccaatccatttccgcgtcctgattacgactttgccgatatcgtcggtaccggtggcgatggctcaaacaccatcaacatctcaaccaccgccgcatttgtcgccgcagcgtgtggcgtgaaagtcgccaaacacggcaaccgtggggtatcgagcaaatccggctcttccgatctgctcagctcatttgggatcaaccttgccatgagcgcgcaagattcgcgccaagccttggatgatctcggtgtcgctttcttgtttgcccctcagtatcacggcggtgtgcgccatgcgatgccggtgcgtcaaaccatgaaaactcgcaccattttcaacatcttaggccccctgattaaccctgctcgtcccaatattgaattgatgggggtttacagcaaggatttggttcgtcctattgcgcaaaccatgttacaaatgggtctgaaacgcgcagcggtggtgcatggttcaggtcttgatgaagtcgcgattcatggcgaaacgcaagtagcagaaattcgccaaggcgaattgattgaatacacgctcactccggaagattttggtgttagccgttacccactggatgcgatccgtggtggagagccagaagagaatcgcgccatcatcacccagatcctaacgggcaatggcacagcagcacaaatggcggcagtggcagtcaacgttgcacttctgctgcgtctatttggtcaagaagatctgaaagccaacacccaacaagcgatcgccgtgatgaaatcgggccaagcctatggattggttcagcagttagcacaacgaggttaagcagaatgtccgagcagttgtctgagcatatttccgtacaaaccgcgcaaatggcgcaagtgctggtcaaaatcgtcaacgataaataccaatggattgaagagcgcaaagccaagcaacctcttgctagctttcatccattactgactcgctcagagcgcgatttctatcaagccttgagcggcgataacaccgtattcattctcgaatgcaaaaaagcctcaccttcaaaaggattgatccgcgaagagtttgatctcgattacatcgcctctgtgtatggcgagtacgccagtgccatttcggtactgactgacgagaaatatttccaaggtcgttttgagtttttgccgcaagtgcgcgctcaagtggctcagcctgtcttgtgcaaagattttatggtcgacccgtatcaggtttatctggcgcgtcattatcaagcggatgcgattttgctgatgctgtctgtgctcaatgatgatcaatatcgtgaactggctgctgtggcgcacgaccttggtatgggcgtactcaccgaagtcagcaacgaacaagaattgaaacgtgcagttgatctgcaagcgaaagtcatcggcatcaataaccgcaatctgcgtgatttgaccaccgacctaaatcgcaccaagcagttggcgccgctcattccacaaggcaccatcattatttccgaatccggtatttatacccatcagcaggtgcgtgatttggctgaatttgccaatggtttcttgattggtagctcgctgatggcgcaaagcaatcttgaactggcggtgcgaaaaattgtgctaggtgaacataaggtgtgcggtttgactcatcctgatgatgcggtgaaagcctaccaagccggttccgtttttggtggattgatttttgttgagaagtccaaacgctttgtcgatgtagaacaagctcgcctgaccatgagcggcgcgccgctacagtatgtcggcgtgtttcaaaatcacccagcagcacaagtcgccgatattgcaaccaaacttggcttatttgcggtgcaactgcacggtgaggaagactctgcgtatgtaagcgaactgcgcgcttcccttccagaatccattgaaatttggaaagcgtatggcgtgagtgatgctttacctgagctactaccagagcacatcgataggcatctgctcgatgccaaagtcggcgaacagagtggcggcacaggacgcagttttgattggcgcttgctgccaaaacatagcgacctgatgctcgccggcggcttgagcgccgagaatgtcgcccaagcggcgcaacttggctgccgcggactcgatttcaactctggcgtggaaagcgctccgggtaaaaaagacgccaaccagttacaacaggttttccaacagttacggaattattagattatcagcatggcaacatgcataagaaaggaatgtaagcatggctaaattaaacgcctattttggcgaattcggtgggcagtttgtgccacaaattttggttccggcactcgatcaactggaacaagcttttattgatgcccagcaggatgatgcttttcgcgctgaatttatgagcctactgcaagagtacgcgggtcgccccactgcgctgacactcacgcaaaacatcaccaaaggcaccaaaaccaaactctatttgaagcgtgaagatctactgcacggcggcgcgcacaaaaccaaccaagttttgggccaagccctgctcgccaaacgtatgggcaaacatgaaattatcgccgagacaggcgcaggtcaacacggtgtcgcaaccgcattagcctgtgcactgcttggcctaaaatgccgcgtgtacatgggtgcaaaagacgttgagcgccaaagcccaaacgtgttccgtatgcgcttaatgggtgccaccgtgatccctgttcattcaggttcagcaacgctaaaagatgcctgtaacgaagcgctgcgtgactggtcagccagctatgaaactgcgcattatctgctcggtactgcggcaggccctcacccattcccaaccatagtgcgtgaattccaacgcattattggtgaagaaaccaaaaaccaaatccttgctcgtgaaggtcgtttgcccgatgcggtgatcgcttgtgtcggtggcggctcaaacgcgattggtatgtttgccgatttcatcgaagaagaatccgtacgtttgatcggtattgagccagcaggtaaaggcattcatacccatcaacatggtgcaccactcaaacacggtaaaactggtatcttcttcggcatgaaagcaccgttgatgcaagatgaacatggtcaagtggaagagtcttactctgtctctgcggggctggatttcccatcggtgggtccacaacatgcttacctcaacgccattggtcgtgcggaatatgaaagcattaccgatgatgaagcactcgatgcgttccaagcgttggcacgtaacgaaggcatcattccagcgctggagtcttcacacgctctcgcgcatgcaatcaaaatggcgtatgccgaaccagacaaagagcagttgctcgtggttaacctttcgggccgaggtgataaggatattttcaccgtacacaaattacttgaagacaaaggagcgttgtaatgaaccgttatcaagccctatttcaacgcctgagcgccgctcagcaaggcgctttcgttcctttcgtgaccattggtgacccaaaccccgagcagtcactcgccatcatgcaaaccctgattgatgcaggagcggatgcgcttgagcttggcatgccgttttcagatcctctggccgatggtccgacgattcaaggcgcgaacttacgtgcattagcggcgaaaaccacgccagatatctgttttgagctgatcgcgcagatccgtgcgcgtaaccctgagactccgattggcttactgatgtatgccaacttggtttacgcacgcggcatcgacgatttttatcaacgctgccaaaaagctggcgtggattcggtactgattgccgatgtacccaccaacgaaagccagccttttgtggcggccgcagagaaatttggcattcaaccaatctttattgcgccaccaacggccagtgatgaaaccttacgagcagttgctcaactcggtaaaggctacacttatttgctttcgcgcgctggggtgactggggctgaaaccaaagccaacatgcctgtgcatgccctgcttgaacgtctgcaacaatttgatgcgccaccagcactgctaggttttggtatttcagagcccgctcaagttaaacaagcgattgaagctggcgcagcgggagccatttccggatcggcggtggtaaaaatcatcgaaacgcatttggataatccagctaagcagctgactgagctggcaaacttcactcaagccatgaaaaaagcaacaaaaatttaacttacattaccttaaatcagcggcgcatcctttggtgtgccgcatcatttcatcaacaactccacttaaacaaaagacatttcaatcaaaaatcaattcaagacttcatataaccaaaatcaatagcaaacgttttctttgcagataaaaacgccaaattactctcgttttactccgctattgagaaaacgctcgatgtgcttattgctaaatgtaaacattccgtgtaaaaagcaggagcaaaatttttgcccatttagtgatatgacactagtggctaacactaggaatttacaatttattagcacagaggttatggaagtgttaaagacaaagggtttactaaacaacatcggcgtgcaagtggtgatcgccatgctcgcgggtaccgcagtcggtgcagcaatgggtcacgatgcgacactatttgctccactgggtgcgatttttattaatctgatcaaaatgctggtgattcctctggtggctgtggcactgatttctggtgcagcaggtctgggtgatagccattctgctggcaaggtcggtgcagtgacgttaagttactttgctattacctctgccgccgccgtagctctggcattgatcatgggtgaactgttccaaccgggtgtcggagtcgatgtttctggtgtagagagcatgttctcttctgaatacgctgcgcaaggtgagctccccactttctgggcaaccatcattggtatgatcccaaccaacgttttccagtcactgaacgaagcgaacattctacagatcttggttttctgtctgtttttaggcattgcgatttctaagcaagccaaagaaaaacgtgacccagtgatcaacgcggtgaacaccattgttgatgccatggtgtggatgatcaataaagtgatgctgattgcgccgattggtgtatttggcttaatggctgatgccgtgggtacttttggtttcagcgcgctgatggtggtgtttaagctgttcgtcgtttacgtagcggcgattgcgatttttggctttgtggcttacccagtcatgatccaactgttcagcaaaacatcggcgaaaaagttcattcaagcaatgaaaaagccacaagcggttgcactgtctacggcctcttctatggcgacactgcctgtcactatggatacggtgaaaaacgatctgggtgtgcgcaactcaacggcttctttcgtactgcctttgggcgcgaccatcaatatgtcaggtaacgcgatctactacggtctggtggctatcttctttgctcagctgtttaatattgacctgagcatgggcgcttacattgcgatcatcgtgacggcgactttaggtgcggttggtcaagcgggtgttccggggccttcattccttgtggtggcggttctgctctctgccggtattcctattgaaggtctaccactgctgtttgcactggatcgtatctttgacatgatccgtactgcgctcaacattaccggcgatgcggcttgtgcagtgattgtggattcgatgatcactgaggaagcggcggctgagctggaaaaacgtgaagcttaatcgctgatcattatcattcataaaaaaagccagacattaactgtctggctttttctttattgagtcacgggcaaattatcccgcgaaggagatgggttcgcttagcgtcccaacgcctctttatagtgctggcgacagactgaaacatacttatcattaccgccaatcgccacctgatccccttcgctgatggcgttgccatgctcatcggtacggatcaccatgttggctttgcgtccacagtggcaaatggttttcagctcaatcagtttatccgcccatgagagtagatatttactgccttcaaacagctcaccgagaaaatcggtacgcaagccgtaacacagcacagggatatccagtttatccactacttcggtcagttggtaaacctgctctttagagagaaactgacactcatccatcaaaatacagtgacgaggttcagcctcatgcaatgttgcgatcacgtgcaacagatcggtatcggcatggaaaaggtgcgcttcggcctcaagcccaatccgagaactcactttgccaacaccaaaccgatcgtcgatcgcggcggtaaaaatcagtgggttcatgccgcgttcttggtagttaaacgccgattgcaataaggtggtcgacttacccgcattcattgccgagtaataaaagtacatctgagccaaagaagaaatcctgtttgtatcattttactgtctgcgctctcgtgccgcgcaggttaaaaaaagggtggctaatgccaccctttgcaaggcgttgattacgctttatctttcgttgcaagcttgaccgcaatcgccaactcttcgagggcggcagggtttgccaaacttggtgcatcggtcattagacacgcggcggctgtcgttttcgggaaggcaatgacatcacggatgttttccgtaccgcacagcagcatcaccagacgatccagaccaaatgccagacctgcgtgtggtggcgtaccaaacttcagcgcatcgagcaggaaaccaaacttgagacgttgctcttctggcgtgatacccagaatgtcaaatacggctgattgcatttctgcgttgtgaatacggactgaaccaccaccgacttcgtagccgttcaataccatatcgtaagcgtttgacagcgcctcttctgggttggctttcaactgctcaggagagaggttcagaggggatgtgaatgggtggtgcatcgctgccacgttaccttcatcatcgctttcgaacattgggaaatccacgacccacaatggagcccacgccgattcattagtaatacccaactctttacccgctttcagacgcagtgcgcccagcgcttcagcaaccactttggcagaatcggcaccgaacagaatgatatcgccagtttgcgcttgagtacgctcgataatcgcttgaatgatctcttcagtgaggaatttcgctacaggcgattgaataccttccatgcccgcagccaaatcgttgactttcagccatgccaagccttttgcgccgtaaatagccacaaatgcggtgtactcatcaatttgtttacgagtcagtgctgcgccacctgggatgcacagtgcagcaacgcggccttttggatcgttcgctggaccagagaacactttgaaatcgacgtctttcagcagatccgccacatccaccaactccattgggttacgcagatctggcttgtctgagccgaaacgacgcatcgcttcgctgtaaggcatgattggaaaatcgcccagatccacattcagcagttcaagccacatttcacgaatcatcttctcagtcactgcgcgtacttgttctgcggtcatgaaagaggtttcaatatcgatctgggtgaattctggttgacggtcagcgcgcaaatcttcgtcacggaaacattttacgatttggtaataacgatcaaagccagacatcatcagtagctgtttaaacagctgtggtgattgtggcagcgcgtagaaactgcctttgtgtacacggcttggtactaggtagtcacgcgcaccttctggtgtcgctttggtcaacactggggtttcgatatcaaggaaaccgtgtgtatccaagaaacggcgtacaaagcttgaggctttcgcacgcagtttaatgcggtcactcatctctgggcgacgcagatccaaataacggtacttgaggcgttgctcttctgagttcttttggttgaaatcgagcggcagaacatctgaacggttaatgatctcaaggctacgtgccaacagttctacttcaccggttgccatctctttattgacttggctttctggacgcgcacgcacttcaccggtcaatttgatacagaattcgctacgcagttggttagccacggcgaatacatccgccatatccggatccactactacctgaacaataccttcacgatctcgcatatcaatgaagatcagaccgcctaaatcacgacggcgattaacccagccgcacagctctacagtttgtcctaccaaggacttgttcaggtgaccacaataatggctacgcatagtgaatttcccaatctcaattagtcatcaaatttaacgctgaaaggtcgtggagtactcgacagactgcctattcagcaaagttccatttatacgccgaaagagatttaagatcgaccttcccacgtacaatttgttgtcttttcttaccccttgctgctttttaacgcaataatcccgtcaaccggagattaaaggctaaccagaagggaaaaataggcgctgattatagcgctaaaatctcgtattcttcaaaactctcgtgatgatgatttaaggagctcgagcagagtgacgtcctctcttcccttgcgactcggtttaaccctgtggtctcaccctgcatggcagagtgagttttatggcagcggcacgcaagcttctgaacgccttgcgaaatacgccagcgtttttcacaccgtggaggggaataccaccttttacgcgtcgccctcgcccagtactgtgctcaactggcgcgccgcgactcatgatgactttcgcttcacctttaagctgcccaaaagcattacccaccagcatttactgcgcgactgtaaagaagagctgctgagttttttgcgtttaatgcagcccttgcacgaccgaattggcatgtggacgattcagctgcccgccgcttttgggcctgaacatctggcgcaattgaaaaactttcgagactggtttccagccgattttccactgggcgtggaggtgcgtcatttggccttttttggcaaaggcgaagcggaaaaagcgctcaatcaatggctgattgagcaaaacattgatcgcatcattatggacagtcgccccgttttttcggcgctgccgaataccgaagcggtaattgatgcgcagcagaaaaaaccgaaagtgccggtgcatgcgattgccaccgccaagcatccgatgatccgttttatcggccatcctgagattgaggccaacctaccctttttcggtgcttggctacataaactgcccgagtggattgcccaaggtaagcagccttatctaatgattcatacaccggataatgatttcgcgcctcagctggcggtgcaactttaccaacaattacaacaggctatcgcgctgcctgacttagccccttttcccgtcacaccagaacaaccacaactgagcatgttttgaactcacaatccggtacggctgatttaccctaaaggcgatgtgtttaatgacagacgctgcgatttttcataaaatacgcgccttttattgagccagcgccacaaaagctggcacaagacgctgccatgaggtctgctatgaacccaaaagatactctcttttccgcacccatcgataaaatcggtgatttcacctttgacgagcgcgtggctgaagtttttccagacatgatccaacgttcggtaccgggttacagcaacatcatatctgcgattggcatgctggctgagcgctttgtaaagcctcattccaagatttacgacttaggctgctcactgggtgcggcaaccctttctatgcgccgccatatcaaacaagaaggctgccaaatcattgctgtcgataactcagcggccatggtggaacgctgcaagctgcacctcaacgcttatcgctcggacacaccagtgcaggtgatcgaagcggatattcgcgatatcgcgattgaaaatgcctccgtcgtagtgctcaactttaccttgcagtttctcgcgccggatgatcgctacgcgctgctagaaaaaatctacgccggattacgcccgggtggcattttgatcttgtcggaaaaatttgtgttttcggatcaagaagcccacgagctgctgatcgatttgcaccacgatttcaaacgtgccaacggatacagcgagctggagatcagccaaaaacgcagcgcgattgaaaatgtgatgcgcccagattccatccagacccacaaacagcgttttgccactctcggcttttctagctttgaagtctggttccagtgctttaactttggctctatgttcgccattaagtaaatcgcttattttgttaactatttttgtcatttatcttcatgttagcgactctctgcgccacgtatgatcctgaagtcatgtgcagagagcatagtttaggtatttagccccatgttcaactttgccaacgtttaccaacagatcgctcaacatccgcagttacagttgtggctcaacaccctgcctcagcaattgacggattggcaagctaagcagcacggagatctcgatcgctggatgcgtaacctcaagaaaattccggtcggtcaaccggaggtgattgatctgaaaaatgcggtagcggcacacaatcatcagccactcgcgcaaggtgaacagaagaaattggaagcggtgctcaaaacctttcacccttggcgtaaaggtccttaccatctgcacggcattcatattgataccgaatggcgatccgattggaaatgggatcgcttactgccacacatctcgccactgaaaaaccgtttggtacttgatgtgggttgtggcaacggctatcacatgtggcgcatgctgggtgaaggggcgcagcaagtgttcggcattgacccttccgagctgtttctgatccagtttgaagcggtacgtaaactgctgggcgatgaccaacgcgttcatctcttgccactcggtattgaacagatgccggagctcaacgcctttgatactgtgttcagcatgggcgtgctttaccaccgtcgctcaccactcgatcacctgctgcaactgaaaaatcagttggttgctggcggtgaattgatcctggaaaccttagtcgtagaaggggatgaacatacggtactggtgccgtttgatcgctacgcccaaatgcgcaacgtctatttcttcccttctgcactggctcttaaagtgtggttagaaaagacagggtttgtcgatgtgcgtattgtcgatgaaaatatcacttcactcggtgagcagcgtaccacagagtggatgacacacaattcactgcccgattacgttgacccacaagacccaagcaagaccattgaaggctatccggcgccgcgacgtgccattctgattgccaaaaagccataattgacacagttttaactcgcttattcgggtatcacgttacccttggtaaaggatgcgctaagcatcctttgctataacttatctatacaatcactcattagaaaataataaggtcgcaaatgtttaagcgaattgcaccctttgccgcattgagtttgctttcgggctgcgcactcaccaatggcgatgaataccatcaagcgacgctctccgcgattcaaagctctgaagccaatatgacccaaaaaatgacgaacttagaatcacaaatgggtctgcagaatgattatattgaaagccttgaaaaacaaattactgagctaaaaactcaagttagccaaattaaactgccccccccccctgccccgaaacgagtctccactgcgaaaccgtctaatgatcagaacaccgctatcagcaagcctcgccatgatgtggtgctgggcgaaattgagagcgtcaccattgatgcgattaagcaaacctttgatgctcgtatcgatacgggtgccgccacctcatcactgaacgccgtcgatattgaagaattcgaacgcaatggcaaaaactgggtgcgtttccacctcgctgatgagaaaaaccctaaaacagaggctaactggattgaagcgcccgtcttgcgttatgtgcgtattcgtcaatccaccaacgacaataccgagcgccgcgccgttgtcgagctttgggtaaaactgggctctattcatgagaaagcgcagtttaccctcgccgaccgttcgcaaatgacacatcccgtgctgcttggccgcgagtttatccgtgatatcgccctggtcgatgtcagtcgcaaatacattcagaccgaacaaaaataggcgagacgatgacttcgaaaattcctttttatatttctgtctttctgctctttgctacaggtatcacattgagtgttttgcgccaccaagattatggtgtgccatggacccccggcgaaactcgtcaagtctgggatattgaagcgaggatcgagtttgcagcgcaagggaaggaggccaaagtttcccttgccgcaccgctcacgcaagaaggctataccctgatcaacgaaaccgcgtcctccccgggctacggcatttcttacctgaataccgaatcaggtcgccgtattgagtggtcgattcgtcaggcgagcggcccgcaaaccatctactacaaagcgcaatttctggtcgacccacaagccaaagcagtacaaattccgccaacacaaccgatcacaaaacccgcctttgatggccccgaagagtcagcggctatcgccttgatcgacagtgcttcgcagcgctcagcagatcacgttacctttgctcgcgagctgattaaaggactcaacgatagcgagagccaaaacgcctctttgctgctgaataaaatgagtaaagtcgatgccacgcaaaaactgctctcttacgcactcgtacccaataaagtggtcggagtgatccagttagaagatggtcgccgccgtcagtcgattcagcatatgaatgaagtgtggaatggcagcgcttggatcctgtttaatccagaaacaggcacccaaccaacacatccgaatcttctggtgtgggatgaatccaacgtctctctactcgatgtggtcggtgggcaaaatagccaagtcatgttcagtatgatttcgcaaaaagtctcgcctcaacaagccaccgacagcaaagttgaggcagacggtttactcaatctctcaatccatagcttgccgcttgaagagcaagccatgttcaagaccatcatgttgatcccgattggtgccttgatcgtggtgtttttgcgcgtgattgtcggactcaaaacctcggggactttcatgcccgtcttgatcgcggtggcctttgtacaaacccagctcaccacgggtattgtcggctttctgctgattgtaggcactggcttaatcattcgtagttacctctccaagctcaatctcttactggttgcacggatttcagccgtgatcatcaccgtgattttgattatttcggtgtttactgtggtggcgtttaaagtcggtttaaccgaaggcttaaccatcactttcttcccgatgattattctgtcgtggaccattgagcggatgtccattctgtgggaagaagaaggcgctaaagaggtgctactgcaaggcggtggctcactgtttaccgctattttgatctatctggcgatgaccaacacgtatgtacaacacttaacctttaatttcattgggttacagttggttgttctcgcggcaatcctactgttgggaacttacaccggttatcgaatttctgagctacgtcgcttcaagcctttggtggaggagaagtaatggggttctccttttcgttctcggattacacctccccttttaagctacgccgcaaaggtatcatggggatgaataagcgtaaccacgcttatatcggacgttacaacgatcgttccaagtaccctttagtggatgacaagctcaaaaccaagctgatcgctcaacgggctgggtgtacggttccaaagctcatcggcgtgatcagcaatcaagccgaagtgaaacacatccatgaaatggtcaaagactggccgggctttgtgattaagcctgcgcgcggcagcggtgggaaaggcattttagtcgtcacctcccatcaagccggtgtgtataccaaaccctcaggttcgaacatgaataaagaggatgtggaacgccacatcagcaatgccctcgccggacttttctctcttggcggcaaaaacgatgtagccgtggtcgaaaacttaattcagtttgatgactgttttgaggggttcagctatgaaggcgtacccgatgtgcggattatcgtgttcaaaggttatccggtcatggcgatgatgcgcctctccacttccgcttcggatggaaaagccaacttgcaccaaggtgcggtcggcgtgggaattgatattgccaccggtaaagcggtgcgtgccgtgcaatttaataaacccgttactcatcaccccgatacagacaaagagctggccaccttagttgtaccccactgggaaagactgctgacattagcagccagcgcttgggagatgactggattaggctatctcggaaccgatatggtactggataaagaagaaggccccatggtgttagaactcaacgcgcgtcccggactcgcgattcagattgctaatggcgcaggactcttgcctcgtttgcagcacattgaaagtttaggttcttcactgatctacccaacacccgccgagcgtgtagcgtatgcagtgcgtaagtttggggttcactcaccgatagcgcagtaatcctgattttatttaccgcgccaacatgacaaaaggcttccgaatggaagcctttttcttgatctatcaaccacatgccattaagcgtattgcgcttcaaactctttcataaaatcgaccagcgcttgcacaccctctagcggcatcgcgttatagatagaggcacgcatcccccccacaacacggtgccctttcaatgacaccaagccacgcgcttcagccagttccaagaaggtatcgtccaactcgggtttcgccagttggaatgggacgttcatcagcgaacggttgtctggatggatctcgttacggtagaaatcggatgaatcaatatagccataaagcagcgccgcttttgcacggttcacttcttcaatcgctttgacgccaccttgtgctttcaaccattggaaaacaaggccggagagataccaagcaaaggtaggcggggtattaaacatcgactcttgctcagcaagaattttgtagttaagtactcccggtaacagatcgctagccaaatccagcaaatcatcgcgcacgatggcgatacagatccccgcaggtccaatattcttctgcgcgccagcgtaaatcacgccgtatttcgatacatcaatttcacgagataaaatggtcgaagacatatcggcaacaatcggtttgtctgtgacaggcaaatcgttgatttcaataccatcaatcgtttcattcgggcagaagtgcacataggcagcattgttcgcaatgcgccattcgctcgcaggtaatacggcaattttgccttctttttcaattttggcgtcaaaaacatcgacggtgcagtatttcttcgcttctttcactgcgctcatcgcccagtaaccggcatcaatgtaggttgccgtctctgcatccccgagcaagttaagtggtacagccgcaaactgtgcacgcgctccgccttggcaaaacagtactttgtaattatctgggatattcagaagatcgcgcagatcgcgctcagcatgctcggccacttgaatgaatggctgactacggtggctaatttccatcaccgaagtgccaagatgattccagtttacaaactccgcttgtgcttgcagcatcacagccttaggcaaggcggcgggacccgcactaaagttataaaccgtatcggtgttgtgctccatgtgttcattgctcctgctaacgaaaagtgttgtgattaataccactttttacgccagataaaaagcgagaaaagaggccttaacgcctctttccccaagcaacgaacgaccgcgcgagtttttagccttgtgacatcatcagcggcattaacaacatgacgagtggcatggtttttccgttcgggaataccacattaccctctttgatttccgcttgtagggtgtagcctttatcatcttgagtcatcatttccatcatcatgagctggtcaatcccttgtgcaataaatgggaaagccgtcaccaactggttggaaatatacgttttagtctgcccggtcagcgctgggatcaccgccatcggatcttgcagtagattttccgtcccttcaggcacattcagtcgccaattcgatgcaaaatcaccaccagaaatattggccgagaagttatccactgaaacgaagaaccctttactgaacagtgcttccacttgtggcaagatctgctcaacatcctgctcggtcatctctggcgcaccttgataaagtttagacagcgctttggtggccgtggtatccaagtcccccaacgtgaaatctaaagcgaactctttaaactcgccgccgctgtatttggcatcggcaatcttcattttgtgagccgtggtaaaacgagtctgtgtggtatccaaccctgaagtgaaatggtaagtaaaaccacccatatcaaactccgtttgtccctcttggttgacactcagtttatccagcttgaaattctgtgcgcctagccacaaaccatcactctctttaccttgaccgtcaccggtgatctggctgagtaccatctgcgcttggttttcaaaatccaaaatgatctttggtacgttcagttggaacgtcatttcacccaatgtcgttaaagaaccgctcatttgcgccggttcaatggtcactgcaacaggctcttcaccttggaatacgtagttccactgttccagcttcaccgtgtaatcggtgttaccgtttaacttggtattcgaaagaatctgcagtggaaactcagggaattgcggcaatgttgataccgctgacacccccatcaggccatgagtcagtgtactgtcgactaaaatttcggtcggaataccttctgcttctaactgcgccacaatcgtcgggtctgtgattttgtaacgcgtctgcatttgtgatgacagataaccgcgctgatagttaaccagttcagccttggttgatgagctttcaaaattgttgaggccatctttgatcgcagattcaccgatttggcccaccgcgagtggccaacacaaacctagcgcaacagccccacccactgcaccgatcatttttattgatttcatagtcgaatatttccttgggattgagtttccttagtttaggtgacgaaactcgtacaagatacaaataattgtcaacatttgtgcaaacaacgggaaaagtatgaatcaaatcagagtattgaattgcaacagtcttgattggaaattctccaactctgctcccacttcatcagcgccatccctgctaaagtaacggcgtgaacccttgccagagaaaaggttgtgaatcgctacgccctgctcattttagataacaatccgttcagtattgaacaatggcgtcaagaactgtctggttttgccagtaaattcgacctatgcagcgctgaatctattgatgaagctcagcagtggcttgaatttattgaacaacgtgaacagatcgccgcgttagttatcgccagtcatcacgaagcgctcaatggtgcggattttttgattcgattagataaagtggcgcacaccaaacacgctcgcaaagttctggtgagtggtggacaagatatccaagccattctgagcgcggtcaacgaaggtcgcttagactactgcttgactaaaccactgcaagataacgtgctacgcaaaacggctttacaagaactgacctcctttgtacttgaacacgataaagacaatatcttgagctacagcacggtgttggatcagcagcgtctgttacgcgcgcacatcgataataaaatgcgcagctaccgtgaaggattcatcacggattatcaccgcttatccgatagtgaattagccgaaaaagtgattggtgcgctgtaccagttttttgatgagaaagacgagactcaagcgtgccgaacctattccgcgcagcatttactgaccgaagagggcgagcctaaccgtttcttatggtttatcaccgaaggcgaagtggctttatataagcgagacgatcttggccaacagcgtgaagtggtacgccataaaaaaggcaatattatcggcggtatgtcatttgtgactggcgaaccctctttttcgactgcgatcaccctaacccagactgaagtgataaaacttgatcgtgacgtgttcgccaaagtcatgcacaacgacaccagtctactgcctctgtttaccaacttacttctgcgccattttaatcgtcgattgcaacgcagtattaccacgaaacttgaactgcaaaaaacgttggagtctttagagtctgcccatcaacaattgatggagcgtgaaaaaatggcgatgttaggacaactggtggcaggcgttgcccacgagttgaataatccggtcgctgccattttgcgcggtactgaaaccttatccagccatattggacatttgattgagggtgaagagcgagcgccaaccgagcaattaggtgcgcaactattgcaaaaagccatgcaggctaagccgatctccacttccgaagagcgtcacaaagccaaacagttagaagagcttatccatcaccgtttaatcgccaagaaaatggtcaaattaggcttggatgacgatgaggccatgatccaactcgccaaaagccgaccggaaatagcgcaaaaacaacttgaacagctggaaagctatcacctcaccggcagtactctgcgttcaatccaagtctgtgcacagcggattgctgacatggtgaaaagccttaaaggctatgcacgtcctgacgatgaaacttatcgactctccgatattcatgaagggatagaagataccttggtcatttttgaaaatcgcctaaaacggcatagtgtcgaaaaagagtacgcacaattaccattaatctattgtttgccaattgcgctacagcaagtgtggactaatctcatctcaaatgcgattgacgcttttcctgaacatggcgtattgcgtattgaaaccgagcagcaacgtcgtcaagatatcgactacgccgtgattcgcttcaccgacaatggttgtggcattccacaagcgttacagcagaagatttttgccctcaactacactaccaaacgagaaggtaactttggtcttgggattggcctatctgtctgtcaacagatcattatgcaacatcaaggttggattgatgtcgactcccaacctaaccactacaccaccatgacggtgtggctgcctttaatggtatccgcacccaccttggcaaggagcaagccatgaacaaatttttgattttatgtgtggatgacgaacgagaagtgctcgacagtgtggtgcaagatctcgactgttttgaagagcatttcattattgaagcggccgaatcggttgcggaagcgaaatccgtgattgaggattatcgccaagaagcgatccccctcgccctgatcctgtgtgatcacatcatgccggagcagactggcattcaatttcttattgagctcaaccaagaagccgataccacccgcacacgcaagatgttactcacaggccaagcggggctggaagataccgtacaagccgttaaccatgccagtttacacttttacatcgctaagccttggcatggagaacaactgcgccaagccgtaaaagagcaattgactcattacgtgattgagaacgaagaggacttaatgccttggattcaaattctcgatgcagaaaaaattctaaatgcgatcgccgctaaaagaatgagctttggcgaatagggaatttggcactctaattgcttaaatttcatatgaacgacaaaactctgacattttttgatagtagcttgatacatcaatgctttatgatgtcaaaccatgaacccggagtcgattttaaggcttcagtcactgcaactttcaggtagtggccttggaattaatcagaagataaaggtttatcttaattatgcgtaaaacaatcgttgcaactgcactacttctcgtcgctggctcggcactggctgaaggtgagcgtgatagccgtaccgtaatgagcaactttagctatgactatgtagaagcgcgcatcggcgccagccctatgacttttggtgctgcgatgagccgctctgttcaccctaatgctcatgtgattggtcgaatcgactcagaatttgaaagtgactacgatgtcgcggccggatttggattccacgcgccggtcaataactgggcagatcttaccggtgaaatgctgtttcgtttagtcgatgatcgcaaacgctctagcgccgataccggcatggaactgaacattggtattcgtcagtggttagggcctcagcttgaggtgggcggtaaagcaggttacgtctctatcgacaacaatgatgattggctaggctcagtatacgcacgcttccacgcaaccgagctgttctctctcggtgcagaagctcgcataaacgacttttacgacgatcagttgatgttcacagctcgctttaacttctgatccgttagggttcgtcgcgatacagtaaaaaagccataagccagaaaatctggcttatggcttttttatgattgagaacgtggctaacgctttaacttaacgctgctgacaactttctaacagttggcgcttacgcggctcttgcagcagtttccagtgaatgccttcaatcgcacccgcaaacttccacagtagttttacatcgacatcacttccataagcttgacgcaccttattaaacacttctggcgcaccgaggctcataaaagtttccacatcgtcaatgcccgctttttttaccatacgctccaaagtcagttgcatattgggtaaatcccgtagacgacgactggctgctgagcgttgaaattcccgctgattcacagaaaactgaatcgagcgttcaataatcgagtctagctcagggtgatgttgctcatacagttcagtgatgtcgtaatagtttacggttgccgttgtctgttttttaacatggcgatatttctcgcaccctaaggccaagagctcagggtcgagctcttctccaccacgcacaaaaatgcggtcttcactgaccaacacatacatagcgtcgtgttgaaacaagccaataccaccaaacatcgagcgtttttggtaggcgccaaacttagttacgtagtcgaaaaactgttgctcattcatatccattgatcctttaatcacgttccccgattaaggaagatcaccagatagcagcaataaagcgaaaataatgaaattgtttagcaagtctattcaatcgttcgtatgagcttgcttgttttatgaagctaatgatagtttacgaagagaaataagtctggacttatctcacatcgatgcaatacttttgcgccagattatgagaccagtatcacagcgtcaattttttgttgctcctctatacttaaacctcatctattaaatcgctcaatagttcaacgaaaaaaccagcgtaatcggtaaaatgcatggaaccgtttgcttatttagtttagcgatagttaaaatgctaccaactttgcttgatcgtgtattttatgagtcacctatctttttactggttacccgaaaccaaacataaactcatccaaggattggaaagtgaatttgcgcaattggtcgagctttctatcagtaccgggaaaatttcgcttcccccaattccagatgtcgttttaaaaattcagcgcctgtgcttagcggaatcgacatccatatccgatgtcgcggactgcttaattgaagatcctgggctctctgcgattgtgattcgcgtggcgaactcagttgtgtttaatcgtcgaaacattacgtgcaccgatattgtcacggccgtttcacgtcttggcattttgcgcgttcgtgatattgtgacggcgcaagctattgaacagttgaagtactccgtcaacctcagtaaagagtgcaatcgcatcttacttaaaagtgcgaccatttctcgcgaaatgggggccaccatgttactggtgacccagacatttaagtgtgtggatgcgaagaaataccagtaccttgagctagaaaaggcactactagtcggtttgttggcggatatcggtatcttctgtctggtcaatgagtaccatttatatctacaaaatggtaattatctggatcccactattgcactgaagattttccaatctcagtgctcaccaatcagtcaattggtgttacgtcactggggatttgatcatgactttttggaagtcgcttgcaacactgagctggtaaccgagcgacaagaagtcacttacctcgatattgctcgtattgctcatcacttactgatgttcagaaagaaagatgatgcgattgacgatcacaatgtcgagatcaactctgaaggcgctgaagtgctctaccagctcagcaacttaagtgaaatggaatttaacaacaagctaagtgatgtgatcagtgccagtggcatctgaagtaccactgtgaggatgttatgctgtcagggatgatctttgtttttgcaccactcgtggtgggttacctattcattattcgtaacccatctcatctccatcgtttgagtcgagcaacctcgcatctcgtttacgtcatcttatttttgatgggtctcagtctcgcgggcttagataacctacaaagtaacttacaaaccattgtcaaatacacggccgtttttttcgtggtgctagggacatgcaacctcttagtcttacctttagttgatcgctatctgccacttagtaccgatatcactcataaaaaagtcccgctctcaagcatgatgttggagtctgcgaagcttattttggtggtcggtgcaggcctggtggcgggtgtgttactgaatcaagacttacattgggtcgaatccgcgagcggctggatcctcttccttttgctgttttttattggtattcaactgcgcaacagtggtttatcgctcaaacagatcttgctaaataagcacggaatggttattgcggcagtgatcatcctaaccagttggctaggtggcgtgattgctgcgtggctactcgacatgccaatttaccaagcactggcgatggcctcaggttttggctggtactcattagccggtatcttagtcggcgatgcttttgggccggtactcggcggagcctcttttatgattgagctactgcgcgagctagtcgcgctggtgttaattcccatgctgatccggcgcaaaccctgtaccgcgattggttatgcaggagcgacagccatggattttaccctgcccgtcattcaaaccactggcggtgtaaaatgtgttccggtggcgattgttagcggctttattctgagtctattggtgccggttttgatcctgttctttgtttctcttgcaagctagatcgcaggatttccctctgagctcgtttacaatgtttcgccttgagatttacaatttagtaaacaatattttaacctaacgcccctaaatgattgggtagaacaattctcttcgggttaggggttaaggtttatctcaatgaagtcccatcaagaacgactaaaaataacaattcaaaaggaaagattatgaaacgcctgagcactgttttactgatgtcggtcgtctccgcttcagcctatgcggataacacctgcttcagccaaaaatacgatgcctacatcgatgcttcattgaactggtatgccgatctcaccaaactgaccagtgaacgtaacccagatttagccgaagtgagtcaatggtttttagaaggaaggcagcaccactttgccttgaatcgcgcggctgttcattactacttacaacatgacccaagtaaagtcgcaaccacccaacatgttgaatcatggttaaaactagaacagccagaaatcaaacaattggcgacacgcagcgatgagcttggcaagttagccagcgtaacctttgccgaccgacaagccacacctcacccgaaaaattatgaactgcgctccgcgttggcagacctgctcagtcaccctaagcagatcgaatcggcgctgaatcgctataatcaggcgattgaaaaagtcgaagcgatgaagtgccaataatcacacaccaatgcaatcaaggctttccgaattaagacgggacattgttcccgttttgaattagattgtcccgcttgaagcccatcaatcagaataataacgacgctgtatggtatcagaacacaaatccgcgcaagtcaacttcgattctctgctcaagatcttcaccgtaccggaaggtccagactcaacattaactaaaatcgatgaagagctttctcgcaatttaaaccacttcttgcgcaaacacattgtggcagaagaaaagccgctcaaagagattgagaaagatttttccaacgcgcacattcccgaacagcctcaattcgtttccgatcatacccaatatttactggatactctggtgtcacactcagtgcacaccgcatcgcccagttttattggccacatgacatcggcactgccctacttcctgatgccgctgtcaaaaattatgatcgctctcaaccagaatctggtcaaaattgaaacctcgaaggcattcacgccgctagagcgtcaagtgctaggcatgatccatcgcttgatttatggcgagacggatcacttctatcaacagtggatgcacagtgctgagcactcactcggcgctttctgctcaggcggaaccatagccaacattacggcactttgggttgctcgtaataatgcgcttaaagcagaaggcgatttccccggcgttgaaaaagctgggctcttcaaagccatgcgccactacggtcatgaaggtttagccattttggtttccgaacgaggccactactcgttgaaaaaagcggccgatgtgctgggtataggccaagaaggcttggtcgcggtcaaaaccgatgcgcataaccgtatctgcccacacgatctagagcagaaaatcaccgagttaaaagccaataagatcaaagtgtttgccgttgtcggagtcgccggcaccacagaaaccggcaatattgacccactgcgcaccattgctcagatttgtcagcgtgaacagatccacttccatatcgatgcggcttggggcggcgcgacgttaatgtcaaaccgttatcgaggactgcttgatggtgtcgagttggccgattcagtgaccattgatgctcataagcagctctacatccctatgggtgcgggtatggtcttgtttaaagacccgaatgcgatgcgctcaattgagcatcatgcccagtacattttgcgtcaaggctctaaagatttgggtagccataccctagaaggatcacgctcaggcatggcgatgttggtttacgccagcatgcacatcattagccgcccaggctatcagctacttatcgatcaaagtattgaaaaagcgcgatattttgccgacctgattgatgcgcaaactgactttgagttggtttcgcaaccggaactctgcttgttgacttatcgctatctacccgagcatgtccgcatggcgctagaaaaatcgcaaggggtacagcgtgcgcagttgaatgagctactgaacgaactcactaagtttattcagaagaaacaaagggaaacgggtaaatcctttgtgtcacgtacccaactcaatccacaccaatgggataaattggcaaccatagtcttccgagtggtattggccaacccgctgacgaccaaagaaattttgcataacgtgctggatgaacaacgagaaatcgcgcaacaagcgccaaagttgatgcgtcaaatcgaacatctaacccaatgcattctgaaccaataatccttcgctaagagttacagcaaacagaaataaaatttcagtttgctgtaactcttgcgtcaatcatgggctagaagcaccagatatgggcaacaccacacctcaaaagtgtagtttttataaaatttaattgaggcttgtcatattctcacggtctttctgagagtttcgtttctggatccatcacgcttaggtttatactcggtttattggcgttggtgggtttagcatttggaagccattgatttctcccctattgtttccaaagcccagaccaacgagttgttctctagcctgcgtgaacactatgaatacattagaaaaaattcaaaaaaacctggaaaactttagcaagtctgagcgtaaggttgccgaagtgattatggcatcaccacaaaccgctattcattccagcattgctacactggcgaaaatggcggacgtgagtgaacctacggtgaaccgtttctgtcgccgccttgataccaaaggttttccggactttaaactgcatttagctcaaagccttgcaaacggcacgccttacgttaaccgtaacgtagaagaggatgatggcccagatgcttacacccacaagattttcgaatcgactatggcgtgtctggatgtggcgaaaaacagtttggatcccgtgcaaatcaaccgtgctgttgacctgctcactcaagcaaaacgtatttcgttttttggcttaggcgcgtcctctgcggtcgcacgcgatgcacagaataaatttatccgcttcaatattccgatcagctgctttgaagatattgtgatgcagcgaatgagctgtatcaactgcaccgataatgatgtgattgtgctgatttctcatactggccgtaccaaaagtcaggttgaaatcgccaatcttgctcgtgaaaacggagcaacggtgatcgcgattaccgctaaagattcaccactggacaaagccagttcattatcgatctgcttagatgtgcctgaagacacagacgtgtatatgccaatggcaagtcgcgtagtgcaaatgaccgtgatcgatgtattggcaaccggctttacattgcgccgaggttcaggctttagagaaaatctcaagcgcgtgaaagaagtgctgaaagattctcgctacgacaaactgccgccttactaggccacacacaaagacagaataacggagcccagtggctccgttttcattttgagtcagaataatgatggtttccaataaggaggaataggctcaatgttgcccgctcaagcggcttccttcctcttttagcaaatggcgaatctccacctcaccttgtgatgctcgaggctctatcgccgcaagtggttgacaagagcagacttgatgcagaatgtgagtcaagcgctccatggtcaaagggatcgggttacctttaatcgctgttgatttcagtgcatctgcggccacgcgttcaaaagaggtcgcgcagacaccaaaatcggtcaaattaggaatcgataatttttctagcatcatattgacccataagatgccatcttccacaccggcatttttacggccagtcagaatgcgcgaaacgatcttatagcgctgtagaatatcactgcgcccagcctctttagccacatcaatattttctcgcatcacaatcggcgcaagtcgcgcggtaatcacactgtgtggcgcatccaatttgccgcccagtgcagaagccagtccatgggcggcccctaatttggcattggttgtcgccattccccccagcatggcagcgaaggagagatcactgcgtgcttttttatcatcgcgcaagcagcccgcgatcatcgctcggcttaaacgccgtaacccttcctcacaaatcatatcggttagaggattgggctctccacacacgtaagcttccataagatgggtaaacgcatccatggctcctcgaccagacgtcacaggatctgtaccgtaagtcaaagtgggatcaatgatcgcaacgtccgctaacatctcaggactgcgcaagctaattttgactctgtcctgcgccgatttcagcaccgcattacgcgtcacttcagaacccgagctagcagtagtcggaatcgcgataaatggcagtggtttggctttgagtggcacactgcgcccaaccacctcaacatagtcatacacgttgccttgattggggataatcgccgcgaccgctttccccatatccaacacactaccgccgcctatcgcaatcaccatgtcaggtttaaagcgacgaccaagcatcgcggcttcttcaaccatagtgatgttgggctcgccagaaactacaacatgttggtagcgcatgttctgctgttgtagataggccgttagaggagcatagcgctcagcgtttttccccgagaccagtagcacgctgtatccgtactggctgattatcgaaagggagctctctagcgacccctcaccaaagatgatccgtgtcgcggtcataaactggaacatgctccctccaaggcctttcacacatcagatagtgctaagcttgcatccaaatgggggaaatttgtttgacccagtgcaacttgccgaaattaaccacaaaaaatctgctagttcttgcacaacctcacatagaaattgaggattttcaatctcttccatgataactgcgagccaagaagagtggtgaaaaaaagcgaagcatagagtaaaaccattgtttttatctattaaatcaagaggaaaaatcacgctttatttccccctttgaatcgggcatagtacccgcaaacaaaatgaaggagaaagatatgtttgtggtcatttttggtcgtcctggctgtccttactgtgttcgtgccaaagagcatgctgaaacattgaaagcaaagcgtgatgattttaactatcgctatgttgatatccacgccgaaggcatcactaaagccgatctagaaaaaaccatcggcaagccagtcgaaaccgttccacagattttcatcgatgaacaacacatcggcggctgcacagacttcgaagcgtacgcaaaagagaatctaggtctatttgactaataaaatgataaatcgaaaaagcctgtgaatatcgcaggcttttttgttcgtacgagattctgcagacttaggattttttagctatttcgctccaaataatgcgcatccgcgcaaaaattcacttatctttttgcaatattcggatacaattcccaaaattttattatttcccctcttgtcacgcgtgaattgagttaaatcgtgaacatcgacgtcgttttgttgctagagcaaaatccaattttgctgatatttgttgtcctcgccatcggtctctctttcgggaaaattcgctttggcagcttccaattgggtaattcgattggagtgctcatcacctctctgatcatggggcatcttggtttttcctttacaccggaagcattaaccatcggctttatgctctttatttattgtgtcggcattgaagcgggtcctaacttctttggtattttcttccgcgatggtaaacactacttaattctaagcttagtggtcttgatcactgcgacttggattgcctactttggtggttactatcttaatctggattatggcttagccgccgggatgatggcgggcgcattaacctcaacacccgtactggttggtgctcaggatgcgctcaattctgggcttgccgcggtaccaagacatatggatttatcactgattttagataatgtctcggtcggttatgcgatggcctacttgatcggccttatcagcatgatcatgtttgctaaattactccctaagttgcaaaagcaaaacctgtccgattcggctcaacaaatcgcgcaagaacgagggttaggcagtcagcgtaaagtctatctgccgatcatccgtgcctatcgagtcggacctgaactgattaactggatcgacggtcgtaatctgcgcgagctgggtatctaccgtcaaacaggctgttatattgagcgtatccgccgacatggcattttggcccatcctgatggtgatgccattttgcaagaaggggatgaaattgctctcgtaggtttcccagatagtcacgctcgtcttgacccgagctttcgcaatggcaaagaagtgtttgaccgtaacttactcgacctacgaatttcagaagaagagatcgtggtaaaaagtgacagcattgcgggaaaacgtctctccgatcttaatctttcggaatacggctgcttccttaaccgagtcgttcgtgcgcaaatcgaaatgccgatggatctggatatcgtgctcgccaaaggcgatgtcctgcaagtcagcggcgagaaaagcaaagtaaaggggctggcagataaaatcggttttatctctgtacacagccaaatggctgatctgcttgctttctgtagcttttttattcttggcattctgtttggtttggtcaccatgacctttggccaagtgtcgtttagcttaggtaatgcggtggggttactgctctctggtatcactttgggctttttgcgagccaaccacccgactttcggttatgttccgcaaggcgcactcaatatggtcaaagaccttggtctagccatcttcatggtcggtattgggctcaatgcaggtagcaaaatgttccagcatctctccgaagtaggtgtgcaagtgatcggtttagcctttttagtgagcgttgtacctgtcgtgttcgcttacttggttggcgcctacattctaaagatgaaccgcgctctattgtttggtgcgattattggcgcgcgcacctgtgctccggcgatggatgtggttaatgaatacgctaagtctaccattccagcactgggttatgcgggcacctacgcgattgccaatatcttaatgaccttaacgggtaccatctttatcttgctcagttaaattggagttatccaatactgtggatcaaaaaaggcaccttgcggtgccttttgcgtattgtgagatgtctagtggaccacctcttcgcgagtaccgaaatactcgaaagccagtctgtcatcactcagcgtcactttcactgtgccaccatcgactaacgagccaaacaacagctcattggcgagtggtttcttcagttgttcttggatcacacgtcccatcggacgagcgcccatctcacggtcataacctttcactgctaaccagtggcgggcatcttccgagacttccagagaaacgccacgcgcatccaactgagcttgcagttccacgataaatttatcgaccacttgatgaatcacacgctcatctaagctattgaaccagataatgtgatcaagacggttacggaattcgggagtgaacacctttttaatttccgacatcgcatcatgactattatcttgctggatcaaaccaatcgattttttcaccgtttcggccacacccgcgttggtggtcatcacaagaatcacgttacggaaatcggctttacggccgttgttatccgtcagcgtaccgttatccatcacttgtaggagcaagttaaaaatatcggggtgcgctttttcaatttcgtccaacaaaacaaccgagtgcgggtgcttaatcacagcgtccgtcaataacccaccttggtcataacccacataacctggaggtgcaccaatcaaacggcttaccgaatggcgctcaccgtattcagacatatcaaaacgtagcagttcgataccgagcagcttagaaagctgcagagtcacttctgttttaccaaccccagttggacctgcaaacaggaaagaaccgactggcttatgttctgcgcctaatccagcacgggtcagcttgatcgcctctgtcagcacatcaatcgccgcatcttgtccaaacaccaacattttcatcttctgatccagattcttcaggatgtctttatcagaagaggagacggatttttctgggatccgcgccattttggcgaccatggattcaatttccgccacaccgaccgttttcttacgacggcttgctggcatcaaacgtgcccgcgcacccgcttcatcaatcacatcaatcgctttatcaggcagatgacgctcattaatgtatttggctgaaagttcaaccgcagcacgcagcgctttattggtatagcgcacatcatggtgagcttcgtatttggttttcaatcccatcaaaatcttggtggtatcgtccaatgaaggctcaacaatatcaatcttttggaagcggcgagatagcgcacgctctttctcaaaaatgttgctgtactcttgataggtggttgagccgatacaacgcagtttaccgctactgagcagaggcttaattaggttcgccgcatcgacttgaccgccagaagcggcacccgcaccgatgatggtgtgaatttcatcgataaacaggatggcgtctttctctttctcaagctgtttcaaaatcgatttgaaacgtttttcgaaatcaccacgatatttggtgcccgctaacagcgaaccaatatccagtgaataaatcacactgcgctgaatcacttccggcacattgccttcaacaattcgccatgccaagccctccgcaatcgcagttttgccgacacccgcttctcccaccagcagtgggttgtttttacgacggcgacacagaacttgaatcgtacgttccaactctttgtcacggccaatcagtggatcgatctggccttgttttgctaactgattaaggttggtcgcaaaactttccaaacgctcgtcagcactcacctcttcagaagtatcactgctgccaaacgaatcggaagaagagtcttcactatggttagacgctttggtaatgccgtgcgaaataaagttaacaatgtccaagcggctgatgtcatttttcttcagcagataggccgcgtgcgactcttgctcactgaaaatcgccaccagcacgttggctcccgtcacttcgcttcgaccggaagattgcacgtggaacaccgcgcgttgcagtacgcgttggaaactcaacgtcggttgtgtctcgcgagtttcgtcatttttggggataagaggcgtggtctggtcgataaaagtatccagctcacggcgtaatacatcaatgtcggcttgacaggctaacagggcttcccgcgctgcatcgttttccaacaatgcaagtaggaggtgctcgacggtcataaattcatgtcttttgtctcgtgcccgagcgaacgcgccgtttagactcgactctaattctttgttaagcataaggcctccttaaggaacaaccacattgcccggcaagtttaagcttgctccatcgtgcacaaaagtgggtgctcattttcccttgagtacatcgttacttgagcgactttcgtctctgcaacttctgcagtaaacgtgccacatattgcttttccttcgtaatgcactttgagcatcacttgcgtcgctctctctatatccatagagaaaaagcgctcaagaatctcaattacaaagtccatcggtgtgtaatcatcgttgtttaacaccacgtgatacatagatggtggcttaaccgccgtcttttctttctccagcaaatcaaagtctggagagatccattcaaagtttttactcatgacacttcaatatttgagggcttcttacagagaattcaactataaagtgctgtaaaactagccgtttaaactcactgacggcatccgcactttaatgaatttcgcctcttacttagagactaatgcagcaattgtaacgctgcaaataaaacattgcgaatgacgatcacgaatagcgcgattgcttactttaccgacaccaatatgcaagcttgttaatgatttgcttcgcgatttgcaaatgacaaatttatataattgcaattgcaaaattgagtttgcatatcaaactgtgtgcttttatacgttcgtcctattgactgcgttcaatcatcgtctaaattggtcaattagtgactaacgttaagcataggctgaatcgctattcacttttgagaagtcaggaagtcctagggacaaattgacgtttctcttaaaacatcagttataaaatgcatgagggatgtatagcatggctacaggtacagtgaaatggtttaataatgccaaaggcttcggttttatttgcccggaaggtgaagacggagatattttcgctcattactcaaccattcagatggacggataccgtacactcaaagccggtcaacaggtttcttatcaggtggagcaaggtcctaagggataccacgcgagctgtgttgtgccaatcgagggacaatcagcaaaatagtggattgattgccacactagcgtgctttggcaatttgcaaagcacaaaaatagaaacccgcccaattgggcgggttttgttttggtgtctaaactagattaacggtcaatgatcgcgttgaaggtcgagctaggacgcataagcggagccaccttcgcaaactcaggtgcgtaatagccacccaaatcgccaggcttgccttgcgcgccattcagttctgcgacaatttgcgcttctttctcttcaagcgcttttgcaatcggagcaaactcagctgcgagatctgcatctgccgtttgttcagccagtgcttgcgcccagtaagtcgccaaatagaaatggctaccacggttgtcaatttcaccgacacggcgtgaaggcgatttgttcatatcgaggaacttacccgtcgctttatcaagcgcatccgccaacacttgtgctttgcgattgccagtgaccacactcaagtgctccagagatgcggctagcgctaaaaactcacccagtgaatcccaacgtaagtggttctctttttgtacttgttgtacgtgcttcggtgccgagccgcccgcgcccgtttcaaacaaaccaccaccgttcatcaacggaacgatagagagcattttcgccgaagtacccagttcaaggattgggaataagtcagtcaagtaatcacgtagcacgttacctgttacagaaatggtgtcttgtcccgccttcatacgcacaagtgaatattgcgtggcttcaatcggtgacaggatcttgatttctaaaccagaggtatcgtgattaggtaggtactgattcactttcttgatcaactcagcgtcatgagcgcgtgcaggatccagccagaaaacggctggcgtgttggaagcgcgagcacgagttaccgccaattttacccaatcttggattggcgcatcttttacctgacacatgcggaagatgtcgcccgcttccacgctttgttccagcagcactttgcccgcttcgtcaatcacacgcaccacaccttcagcatccagaataaaggtcttatcgtgtgagccgtactcttctgctttttgtgccatcagacccacgttgggcacactgcccatagtagttgggtcaaacgcgccgtgctgtttacagaaatcgatgacggtttggtaaacgcctgcgtagcagcgatcgggaatcgtcgctttggtgtctttctgcttaccatcagggccccacatttggcctgaagtacggatcattgctggcatagacgcatcaacaatcacatcgcttggtacatgcaggttggtgataccgcggtcagagtccaccatcgccagagcgggttgcgtcgcatataccgcttgaatcgccgcttcaatttctgcacgttgcgcttctggcagcgattgaattttagcgtagacatcacctaagccgttattaacgtccacacccagctgatcgaacagttgaccatacttatcaaaaaccgctttgtagtacaccttcaccgcatgaccgaagatcactggatccgagactttcatcatggtcgctttcatgtgcagtgagaacagcacgtcttgcgctttcgcatccgcgatttctttttcaaagaaggcaatcagcgcttttttgctcatcacgctggtatcgatgatctctttatcttgcagcgcaaaaggctttttcagcactttcactgcaccctctttacccacgaactcaatcgccactttagttgcgccgctcaccgtcatcgacttctcgctaccgaagaaatctttatcgctcatgcttgcaacatgtgattttgaatccttactccaagcgcccatggagtgcgggtttttcttggcgtagtttttcaccgaggctggagcacggcgatcggagttaccttcacgtaacactgggtttaccgcgctacccttgatcttgtcataagttgctttgatcgcttcttcttcgtagctactcggttcttctgggtaatttggcagtgcgtagcctttgtcttgcagctctttaatcgccgctttgagttgaggaacagaagcagaaatatttggcagtttaatgatgttcgcttcaggcgtttttgctagctcacccagttcagtcaacgcatcgctgatacgttgttcttcggtcaaatgctcagggaaattagccagaatacgaccagctaatgaaatatcgcgtgtttctacgttaatgcctgatgaagcagtaaatgattgaataatcggcagtaatgaatacgttgccagcgctggggcttcatcagtaatggtataaataattgtaggtttattggtaggcatgaactttccctatctgttctaacagcaccattggatgcaatgacactgtgtgactgtccgttctcaagtcggcgacatcccctcaacctgagtacgatcttctcactcttgcaaatcctgtgttcgaatgacgttgagccgccttcgagctcgtccttgagtgaaggtatttataattaaacaaattgaagacaatagtctattatcttgttcgttaaaccttttccagggcgcaaatgatagccgatctcgcctctacggaaaactttcaaacacagtttatttacatttttgcaaggtgcttaacatgtcatctcgcttgtccagcgatgccacctcctcttcttccgatcaacgaaagtcgcattttaaacaaagagccgcgaaaaacgctggccatccaccaacgagagcaaatcgaaagagtgttgctaacaagaaaaaaaatgccactcaaacggctttgtcacctaagcgccccctttctcctgctgagcgtaaagtgatcctgtttaataaaccttatgacactttaagccaatttaccgatggggatggaagaaaaaccttggccgactacatcccaattaaggatgtttacgccgcaggacgtttggatcgcgatagcgaaggactactgattttaaccaatgatggaattttgcaggccagattgactcagccgcagtccaaagcgccaaaaacttactgggtgcaagttgaaggttcgccacaagagagcgaccttgaggcattgcgccacggagtgaccttaaaagatggcccgactttaccggcgaaagtcgacatcatgcccgaacccacgctttggccacgcaatccgccggtgcgttttcgcgcagcaattccgaccacatggttagccattactttaatggaagggcgtaatcgccaagtacgacgcatgacggcgcacatcggtttcccgactctacgcttgattcgttactccatgggcgattggaacttgggagatttgcagcccggtgagtggcgggaagtgacgctttaatactctgattaatcaaaaatatatagccaaactacttggagttgcaggtaggcggcaaatgagtgaatccccatgagcatagatacactatgtgattggggtgaacgaatgcagccaacaccgctgcagcttcaagtaggaaggcaataacgccccaataatggggcgttattgtttggttggagaaactcgtctaccaattacttatggcgttctttcagcttattgatcacatcattcatggctaagccttgctcttgcagcaacaccaacaagtgatacatcaagtcggcggattcgcaaatcagctcctccttatcccctgccgtcgccgccaacgcgacttcaaccccttcttcacccactttctgcgcaatgcgtttggtgccacgcgcatacaaagaggccgtgtaagaagaactgggatcggcatttttgcgctctgccaacagttgttccaactgatgaagccaaaccatttgtgactcctcttgtgcatcaccatcccaacaggtcacggtgcctgtgtgacaggttgggccaatcgggttcactttcaccagtagcgtatcttggtcgcaatccagcgcgatatttttcagttgcaacacatgacctgaggtttctcccttagtccacaaacgctgtttgctgcgcgagaaaaaggtcacttgctgagtatcgagggttttttgcaacgcttcagggttcatataccccatcattaagacttggctggactgaaaatcttgcacaatggcgggcacaagtccatcgactttctgccaatcaatacggtcggttagcgtggcaaatgggcttgctggattcatcgtctcacctcaattccttgttgttttagatactgcttgagttcaccgatattgatgatctgcttgtgaaacaccgaagcggctaaagcaccatcgacgttcgcttgagtaaaagcttgcgcgaaatgttccatcgcccctgcaccaccggaggcgatcagcggaactcggcacaccgagcgcactaagttgagctgctcaagatcgtaaccattgcgcacaccatcttggttcatcatgttcagtacaatttccccagcgccgcgcttttgcacctcttgcacccaatcgcaagtttgccactgcgtggcacgggtgcggctttcgtcaccggtaaactgataaacctgatattgacctgtttctttatcaaaataagagtcgatgccaaccacgatacattgcacgccaaagcgatccgcaagatcggtgatcagttgtggattcgccagtgcaggcgagttaattgacactttatctgcaccgaactccaagattcgcgcagcatcttgcgccgacttgatcccgcccgcgacacagaaagggatgtcgatcacttccgcgactcgcgcgacccagcttttatcgacaacgcggccatcactggaagcggtaatatcgtaaaacaccagctcatccgcgccttcttcggcgtaacgtttggccagtggcacaatgtctccaatgatttcgtggttacgaaactgaacgcctttcactacctgtccatcacgtacatccagacaaggaattatccgttttgccaacatgcgaatgcctcctgcgcggtaaatttgccatccaatagcgcgcgaccgacaatcacacccgcaacgcctgtgcctttcaatgcctcaatatcggcaagtgaaccaatgccaccggacgattggaactgcacttgtggatattgacgacagagatcgcgatacagctcaacgttcgaaccggccaacgtgccatcgcgggaaatatcggtgcacagtacgtgctgtaaaccaaccgttaagtaatcatcaatcaaagcttcaatcgtcacgccggaatcttcctgccagccagaaatcgcgactttgcgcgtaccttgttcatcaatgttgatgtccaacgctaaaacaattttctcagcgccgtatttttctatccagcttttgaccaattgcggctgtttaaccgcggttgaacccaccaccacgcgctgcgcgccagcttcaagcagatccaccacgtcttgttcactgcgtactccaccaccaatttgaatattggcgggtgtgctcgcgagcaggcgagcaatcaaattcagttggcgtgctgcggtatttttcgcgccagttaagtccaccaagtgcaaccaacctgccccagcttggtggtacaaattaaactgctccgctgggtctactttatattcggtcacttgtccgtaatcaccttgatacagacgcacaacctgaccttcaatcaaatctaatgcgggaataatcattgtggttccttgtattgcgccagctttgaccagcgcttgtccctaaagctcaagaaagttttgaatcaagcgtgcgcccgcttttgaagagcgctcagggtgaaattgcaccccgtaatagttccctgcttgaatcgctgcgctaaacggctgaccatattcgcactgggcaatggtgtaatcgccaacgggcatggcaaagctgtgcacaaagtagaagtacgcatcaggttctataccgttaaacagtggatgcccctctttcacttgcaccgtgttccagcccatgtgtggcaacggcagatcgccggtttgcagcaaacggacttcgccatcgactaaccctaagcactgcacaatctcatcggctttctggcctttttcttccgacaatttgccaagcaattgcatgccaaggcagatgccaagcaatggtttctcaacccgtttcaccaactcgatcaaatcacgttcggtgaggtttttcatcgcttcgctcgcggtgccaactccgggcagaaacagtttatctgccgcgagtaccacttgcggatcgcgcgaaatcgtcaccgcataacctaatcgttcaatggcgaatttgaccgaggagatattggcgcagccagtatcaataatcaccacattctgagtcatcagagcacccctttactgctcggcagatcgttaccttgcaccgtgatggcttgacgcagcgtgcggccaaacgctttaaacaggctctcaatgatgtggtgatcgttatcgccactggaagagaggtgcagagtacacgccaaagtatcggtcaatgagcgaaagaagtgatacaccatctcagtcgacagatcgcccacttgcgggcggctaaagctcgcatcaaatttcagatacgggcggcccgagagatccaacgcgcactgtgccaaacactcatccatgggcaatgtgaaaccaaagcgtccaataccacgtttgtcacccagtgcttcacgcagtgcttgccctagtgccaaggcggtatcttccaccgtgtggtgatcatcaatgtgcagatcgcccaccactttcagttgcagttggaaaccgccgtgggtcgcgatttgatctagcatgtgatcaaaaaagcccaatccagtttcaatctgattaccgccagtttggtcaagattgactagaacctgaatatcggtctctttggttttacgcaccacttgggcaacacgtggcttggtggtgagatctttaacgatatccagccaccccatggtttgtgggtggtattgaataccgcgaatcgccatattttcagccagttgcagatcggtcatgcgatcgccaatcacggctgacgatttgaaatcgactttgccaccttgcagatactctttgaccaagccaagtttcggtttgcggcacgaacagttatcacgctcaaagtgcgggcaaatcagcacatcattaaacttcacgccttgcgattcaaaaatgtccatcatcatgttatgcggcgcatcgaaatccgcttgcgggtagcttgaagtgcctaaaccatcctgattggtcaccatcaccaaacgataacccgcctcttgtagcttgagcaggcttgggatcacataaggctcaagtttgagtttgtccaaacggtcaacttgaaaatccactggcggctcaacaattaaggtgccgtcgcggtcgataaaaagaattttttgttgtttgctcacaagaatgtccttttcatcagcagcccgcgcagcgagctgctgtaaacaaaattactggtagtagttgcgaataaacgcgacggttttttcacactcttcgcgattgccaacactgatacgcacacagttttcaatcggtgaattacgcaaaataatgccgtgctcccacgccgctttaaacagtgcatcaccatcagggaatttcactaatagatagttaccccaaccttcaaaaacctgcacacccggaaccatagagagccccacttgtaggtaagctcgattcgcgccgagatccaatacttggtatttggcgcgcgcgagacctgcaggtgataaggcttgcaccgcgatttcggcaaccggcactggcaccggataaggcgcgatcactttgagtaacacattgatgagttcagcattggcaagcgtgaagccacagcgtagtcccgccaaagcaaaagctttagagagtgtgcgtagaatcgccaagttcggatattgggcgagcaaatcaaccgtcgatgcctctgggcagaaatcgatgtaggcttcatccatcaccacaatcgcgcgatcttgggtcatctccagcagtttgatgatgtcagcacgtttgaccaagttgccagtcgggttattcgggctacacacaaacaccaatttaacgcgatccagattggcctcaatgctcggtaaatcgagttgccaatcagtagtcaacggcacttttttacgctcaacaccaaaggtttctgcactgatcgcgtacatgccataggttggagggcagaacagaatcacatcctgattgggttcgcaaaacgcacggatcaaaagctcaatcccttcatccgcgccgcgcgaagtcagcacttgctccggctgtactccagcgtaattagcgtaagcttggatcatcgccttaggttggcaatcactgtaacgattaaggcgcgcaaaatcggttttgtattcgttattgaaaggcgattcgttagcattgagccaaacatcaccactaccaccaatacgacgcgcagaaaggtatggggttaacgcctgaatttgttgacgagccagtttttccataatttattgagccttctgtaatttttctactcgaatcgtaaccgcacgtttgtgcgcgtctaacccttccgcttccgccatcgttactacggtgggcgcaagcaattgcaagccatcagcggtcagctcttgcactgtcatgcgtttactgaaatcggccaaacctaagctggaataggtgcgggtgtaaccgtaagtgggtagcacatggttggtaccagaagcgtaatcgcctaccgattctggcgaccaatcgccaaggaaaatggagcctgcgttatcgagcagtggaaccaactcacgcgggttgcgcgtctgcacaatcaagtgctcagggccgtagtagttagaaatcgacactgcttgggtgagtgattcagcaataatgatcagactggaagccaaggctttttcagcaatgctggcgcgcgaaagcactttaagctgcttttgcactgcgtccgtcacttgatcggccaacactggtgatggtgtgaccagaaccacctgtgaatctgggccgtgctctgcctgactgagtagatcggcggcgataaaattggcatccgccgtttcatcagcaatcaccaatacttctgaaggtcctgcaggcatatcaatcgctgcgccacggaaatcgttactcacttggcgttttgcttccgtcacataggcgttaccggggccaaagattttgtcaactttagtcaccgtttccgtaccgtaagccattgcggcgattgcctgaccgccgcctaggttgtacacctcatcgatgttacacagcttagcgacgtagagaatttcatcagcaattggcggaggtgagcagagcaccactttacgacaaccagcgatttgcgcaggcacaccgagcattagtacggttgatggtagcggtgcgctgccacccggaatatacagacccactttgttgatcggacgagtgacttgctcacacaccactccgggcatggtttccactttgattggttgcgctttttgcgccttgtggaatttgctgatgttgttgtatgcctgctccaacgcctgtttcattgtttccgacaaacgcgcggccgcggcatccatctcttcgcgagatacgcgcagtgaagcgggttttacacgatcaaatttttcagttaattcaaacagtgcggcatcaccctcactgcgcactttcgcaatcacctgcgcaactgcggcagtgatgtttgctccttcggtaatcgcaggacgttctaaaatcgattcttgctgagcttcactcaacgattgccaaaccacggttctcatcgccttactccatcattttttcaatcggtaacaccaaaattgagctagcaccgagggctttcagctgctccatggtttcccagaatagattttccgaactcaccatgtgtaccgcgactttggatttgtcggcagacaagggaagcactgttgggtcttccgctccgggcaacaaggttttgatttgcgccaacttctcaaccggagcgtgcagcatgatgtatttcgattctttggcttgttgcacgccgtgcatgcgagtgaggagtttatcgatcagtgcagctttatcggcagcaaaagcacctgggcgctgaataagcgtcgctttggattcaaaaatcacttccacttctttaagaccgttggcttctaaggtcgcgccagtggagaccagatccgcaatcgcatcggctaatcccgcgcgcggtgcaacttcaaccgaccccgtcaacatacaggtgctgaaatccacgccttggcgatccatataagctttgagcagttgtgggtaggtggtggcaatacgcttaccattcagatcttgcgggccacgatactcagcatctttttcaatcgcgatcgacagacggcaaccaccaaagtccatacgacgaagagtggtaaattcgttacgttggttgagtgctaggcgatctaaacgtgtttcttcaagcacgttttcaccaacaaaacccaaatccaccaccccatccatgatcagtcctggaatgtcatcgtcacgcaccaacaacaggtcaatcggcatattcagtgaatgaaccaccaagcgctcgcccatgatgttgaatttcacaccgcattttttcagcagttcttggcactcttggctcaggcggccttttttctgtatcgcgattcttagtcgttgtgtttgcatgtcattcttcctttgcaatttgttgaatttaataatttttccaaagcttaaaacgaaaaaccctcgggaggtttggtctcccgagggttagaatctttttatggctctgatttcaactccgggagattcctgtcccccgggtatgcgtacatctcccgaaagacaccttagggatgatgatggtgatgaatgttcattacgaaattacgcatacttagtggtttctgtctgtttgagaactgccttcacactaactaagctaagtttttttttcaaccacaaattgacacttttctggttatttttttatgacggctttaagagctcatcaccaccactcaaagctgcaattaaggttagcgataaaaaaagaggccgactggcctcttatctctatagcgatgcaaattaggcagacacctgtttgctcactttggcttttgatagtgctgcaaaaattaagcaaaccaccacaaaactcacggatgcggcagctaaagccagcccgagtgaagcaaaaattcccagcaccacgtaaccaatcgctgacactaacgcaaccgccaatgcgtaaggcagttgagtcgcaacatggtcaatatgatgacaacgtgctcccgtcgaagagagaatcgtggtatctgaaatcggcgaacagtgatcgccaaatacggaaccggcaagtaccgcaccgagcatcggcagcataagtgcaatatctgtagcgccagccatgtcacccgcaatcggcagcatgatgccaaaagtgccccatgatgtaccggtagaaaacgccatcgcaccagacagcacaaacagaatgaccggaagccaatgtgggtcaatattgccttgtacgagagaagagagataagcaccggtcttcatgtcaccgatgacagaacctatggtccacgcaaaaatcaggatcaaaattgcaccaaacatcgatttcgcaccaatccataaggtttttgcgatttcagccgtcggtagtttttggcgcaacacggtcacaaaagccatcgccagaccaactaatccaccatataccaatgaagtaccaacattggtattttcaaacgccccaaaaatatcaaacgactgaccactttccgctaatgcacttgcgccagtccaaatcatcgcaccaatggtcgcaacgactaaaaacacaatcggcaacacgagatcgagtactgtaccgcgttcactttcacgaatatcaagctcttcattgagttcgtgggcctcttgtgtatctgtactcgggtcttcatcaaaaccacgcccttgagaagcggcaatttcatgcttgcgcatctggccgatatccatttggaaccacaccaccgcaaataccatcagcaacgcaaagatcgcatagaagttcatcggcactaaacgcagataagcacctaatgcggaatactcctcgataccgtgcgaaactaaaatgccaccgataatggtcatgatatacgcaccccaacttgaggcgggcatgaccacacacataggcgcagcagtggaatccagaatgtaagcgagtttggcacgcgaaacgtaaaaacgatcggtcactgggcgagaaatagaaccgacagcgaggctattaaaatagtcgtcaacaaaaatgaatacgcctaaaaatgccgccagtaatttagagccacgtttacttttcacccggacttgtgcccactgagcaaaagcgcgagtgccgcccgacaacgtcagtagcgcagtcatcatacccagtaacagtaaaaagccgacaatactcatattccaagcattgatcgcgccctctttgacaaacacgctacccacttgtgtggcgatatattgcaacgactgaccaatagaataatcagccagcagtaaagcacctaaaaaaatccccacgccaagagaaaggagtacacggcgagtcacaatagccaaactcaatgccaccagcggtggtaaaacagagagtggcgaagaagcaaaatcgattaaattcatgatcttcctaaaccagtaaaaaatggttagagatctactgcagacaaatcaagcgacatcatgtcaacttaatttatgttgaactaagcgaaagggaagcgaacacttcacccaaccctacagtagcgctccatagtttaacaacaatatagactatggcagtgttacacctattgaatgtaaccccagccaactgcgttgatgggcaagttgacttcggcggcaacgcctttttccacaattcattggcatcaccccaactgtggatacttttcgtaaccgctcctctacggcgaaaacttcatcctaatctgccaattcatttggctcatttagtctgcttttcgcattaggtgagagacattttacttaacaaaaatatcaatgcaactaggttccagtgagaaaaacaagtgccacagctcacaaatcaatcatttcattgatacttatttcataaaaacaccgcaagacttgatatatagaactaatattatttacctgtatnataagttcctgcagctgcttttatatgcgtctgcagtattctaaatagtaaattcattaaataaacatcattttatatttttactttcttactattttgacttaatatttgcagcgaaaacttgtcagtataataagctaggtttagtattaactcgttatccaaattgtgaacaggaaatggtaatgtcggaaatcactaagactttattaaatattcgtagcctacgtgcttatgcacgcgaactgactattgagcaacttgaagaagcgttagataaattaacgaccgtcgttcaagagcgtaaagaagcagaagcagaagaaattgctgctcgtgcagagcaagaagcgaaattagccgcaattgctgaacaaattgctaaagatggtatcgacctcgaagcgcttatttctgcgctatcaggcgaaactaaaacgaaagcaaaaggcaaacgtgcacctcgccctgcaaaatacaagtatatcgacaccaacagtgaagaaaaaacttggacaggccaaggccgtactccttcagtgatccaaaaagcactggatgaaggtaaatctctggaagaattcgctctgtaattttgccagaaactaaaatgataaaggctcccgaaggagcctttttgttatctttcccaataagcctcttcaaggctatcttctcgctcaggaagaccacgtgaaagacgtggtgagtgctgcgccaatacttcataacttgcacggttagagtatttgcaaacttgagagaaagaagaataggttaaaaactcatgttgatgcttacttgagttagggacgttttctttatggtatttattagccgccatatcatgcagtagagcggataatgctgcgtctccagcaccattggtattttttatcttctctggaccgcccatatacggtgaaatatgtgaataaacacgaataggatttatacaactctctttacgggcagggcggctaaattcatagcggttaaattctgggaccgatcccggtaataacggtaatgacgtttcacgtttagcggaatcttcggtgtaacccgccataaataaaccgactgggcctgcagtacacagtactaaatcaacccaatctaacgctttatctgaggctgcgagcggatcgctttctcctgttaaagctaatgcttcatcttcattcattgccaccacagtgacatgatcacgtaaaaattcttgccagaatttcggatcatcttgaataacaaatttagtacctagggttaataccacaggcacatcatattttttggcatattcaatggcacgcattgttgcttccggcattggatcgccttctttacaacgaactaaataagccgtgatcactaatgcagaggcactagcaaatattttttcaggaatactgtctgggcgtaattggttcatttgaccttcgctgatcgcgaaagtacgttcaccatcttcggtaattaaggcaaagcagcggccaatcgcgccatctacaccttgcagatagttgagatccatgcggctagaagtgttacacagatagcgataaccgtaactgccaattttaatatcttggctcatcacacccagtagcgtggagcgatcatccgcaagcacggagtaattatgcagcgtattccctatggttccacctgcatattcattggtaatcaaacgctgctcttttaattcgttgtataacgcttctgcagcatgatcatcaatgaccaatgagtgtcctttacttaaaccataacgttcaatcaaatctgaatcgactttggcctcaatatccactagggtttgatcaataccgataatgtgggtgcgcgacatcttcttattttcttgcgcttgaatgaccagaggatcacgcgcgtgaaccggaaaataatgcttagatttgcgttggccaggaaatttcataaaggttacttgggttcaaggatgaaaggagcgccgattctaccgcgcaccttttagtgcagcaataaaggaaaaaaaagcaaacgtttgcacgctgaggattttatttcgcgctcttctcttagcgcttggagcacaagtgattcaataggttagcaacatagcgtttaggttcggggaagtgtgattagcgtctcggatctgtcctcgaaaaattctttctgttagaatccccgtccaagttcctcaagtggtagataagtgatgtctgtagagcacagcgcaaacagccaaaagaaagtgattgtcggtatgtctggaggggttgattcctctgtttcagcctatcttctcaagcaacagggttaccaagtggaaggcctgtttatgaaaaactgggaagaagacgataacgaagagtattgtactgcggcagaagatttagcagatgctcaggcggtgtgtgacaaactcggcatcccacttcataccattaacttcgcagcagaatactgggataacgtatttgaatacttcctcgcggaatataaggcgggacgtactcctaacccagatattttgtgtaataaagagatcaaatttaaagccttcttagaatttgctgatgaagtgctggatgcggactacattgctatggggcactatgtgcgtcgcaccttcccgcagaatggcgaaaaaccgcaaatgctgcgcggtttagacggtaataaagaccaaagctacttcctttatactctgagtcatgagcaagtggcgcgtaccctattcccagtaggtgaactagaaaaacctgaagtacgccgcattgccgaagaacaaggcttaattaccgcgaagaagaaagattcaaccggtatttgttttatcggtgaacgcaaatttaccgacttcttatctcgctatttgccagcccaaccgggtaaaattgaaaccccggaaggcaaagtgattggtgagcaccaaggcttgatgtaccacactctcggacagcgtaaaggtctgcacattggtggtatgaaagagagcagcgaacagccatggtatgtggcggataaagatctcaaacgcaacgtactcatcgcggtacaaggcgcggatcatcccctactcaaatcgcatggtttggtggcggctcagttacattgggttgatcgcacccccatcacagaacctgtacgttgcagcgtgaagacgcgttatcgtcaaagtgacatcgcttgtaccatcattcccctgagtgatgaccgcatcaaggtgatgtttgacgagccacaagtggccgtgactccgggacaatccgccgtcttttatcaaggtgaaatctgccttggtggcggcattattgaagagcgcatttaaagtcaatttttaggagatttacgtggctaacgcaatttacgaccgtaccatcgctttcgctggcatttgtcaggcagtggcacttgtgcagcaagtcgccaaaaatgggtactgtgattctgatgcgtttgaaacgtcgctcaaagcgattacttgtaccaatccaagtaacacgcttgaagttttcggtcacgaaagtcagctcaagctcggcttagagtgcttggtcaaagggattgacagcacgccatcaggtagcgaaatcacccgttacctgatcagcctaatggcgcttgagcgtaaattaagtggtcgccgcgatgccatgagccaactcggtgaccgcattcaaatgattgagcgtcagcttgaccattttgacttatttgatgatcaaatgatcagtaacctcgccagcatttaccttgatgtgattagcccaattggcccgcgcattcaagtgactggcactccagccgtattacagcaaaccgctaaccagcacaaagtgcgcgccctactcctgtcagggatccgctgcgccgtattgtggcgtcaggttggtggacgccgtcgtcacctgattttcggtcgtaaaaagatgatcgaacaagcgcagattttgttagcgcgaatctaagtgatgactacccactcgaattactcacacctttaactcaatattcaggagaagaacatggaactgtcagcattgactgctgtttcaccggtagatggccgctacggaagtaaaacgattgcgttacgcagtatcttcagtgagtttggtctcctaaagtaccgcactatcgttgaaattcgctggctacaaaagctagccgccactgctgagatcgcagaagtgcctgcattcagtgccgaagcgaatcaattccttgatgcgattgccgccaacttcaatgaggcggatgcactccgtatcaaagagattgaacgcaccaccaaccacgatgtaaaagccgtggaatacttcctgaaagagaaagtagcggccatgcctgagctgcatgccgtcaacgagttcattcactttgcttgtacttccgaagacatcaacaacacttcacatgcgttgatgctcaaagaagcgcgtgacacggtgatcctgcctgaaattcgcaacgtgattgacgcaattcgcaaactggccgaagagtaccgcgatattccgctgctttctcgtactcacggtcagccagcctctccatcgaccatgggtaaagagatggcgaacgtggcctaccgcatggagcgccaatacaagcagatcgctaacgtagaaatcctagccaaaatcaacggtgcggtgggtaactacaacgcgcacctttctgcttacccaacggtagattggcataaattcagcgaagagttcatcactgaatctttgggcgtagattggaacccgtacaccacgcaaatcgagccgcatgattacattgctgagctgtttgaagcggtggcacgttttaacaccatcttgatcgattttgatcgtgatgtttggggttacattgccctgggccacttcaaacaaagaaccatcgcgggtgaaattggttcttctaccatgccacacaaagtcaacccaatcgactttgaaaactcagaaggtaacttgggtctggcgaatgcggtatttacccatttagcgcaaaagctgcctatctctcgttggcaacgtgacctaacggattctaccgtgctgcgtaacctcggtgtgggtgtcggctatgccatcatcgcttatacctcaactttgaaaggcatcagcaagctggaagtgaaccgtgacgcactacttgcagaactggatcacaactgggaagttctggcagagccaatccaaactgtgatgcgccgctacggcattgaaaagccatatgagaagctcaaagaactgactcgtggtaagcgagtagatggcgaagcgatgcgtcaattcattgatggtttagcactgccagcggaagagaaaactcgcttgaaagccatgacaccagccagctatattggctacgcgattgagctgacggacaagctgtaatctcgacaagagagaccaaatgactaaggggagcaacggctccccttttacttatcgacgacttatcgacttggtttataccagaccgtttcactcctgcttttcaaaaaacagagtaatccgaccgacttcaagaccaaatttgcgaattttggttaaattaaatacccgcttgtcatcttgtcgatacagccagtcatcgaagtgtacttgcacatcgccgctgtcgagtttcaacacaaaatcgtattgccactgcagtgcattacccacttctttaccgcgagccgttccaacaatgtcatccgctcgtccttcgtacgcatcatcagccgttcggttaatcgtccagatccgttgatccttttccccatcatcaaacacgaagtcttcgactaaaatcagttggttattctcaatccgaccttcaattaccacctcaaaacggcgcgtctgcttctcggtatagtcttgcaccataccccacgcatgtgtcgttccgacaaagtaattgaagagatcaaacttaggcgtcgtcgcacgataatcatcaatctctgccgaacatccactaagccagatacagagcagtaatagccaacatttagccaatctcatggtcgattcattcctatcaattgattacgcaaggttaaatattccgtttgcggcgacagccaaatggagagaaaagcatcattaaacgcttcatcatcaatgcggcctaccgaacgttccgtctgttgttggcgactaaagaaaaactctccgcgctgcccatcagagacatacactaggcgatctcccgtcgcgacatccggcagtatttgctgcagttgcttcaaccacgcttgggtttgcggtgcggtgaatcccagttttcgccactgatcctcagtagcatccaccaactgtttactgctgatatcgcgcaaataacggatctcaagagcaacaggatgtggcgagacatcttgcgactcatgatacaggccatcaggcgctcgcaactgcgaggagtagatatccagccacagccatgaaagggtggcctgcccaacaactggccattctgcccatcgctggaaagttttatgctccgcttgcgccgcattagcgacggcggcgtaaccaagtccgctcgcgagcaaaacgaatagggttataagtccttttttcatgcctcattaccttcaacagtaaccaagtgatacctatccattccaaaaacagtgccaacatgacgataaaggtggggtattcccaaccaaccgcgcccattcggtaaccaaaccaataacttaaacttcccaaaacgcctccggcgagacacagaagagtatgggaatattggttaagctgcggcagtaagtggcctgcataccaagtaaacgcaaaccagagtgccaccaaccaaagtggaaattgatcgtcggcaaaggtgagtaacccaagcagcatattgctgctgtctatcatgatgccaaccaccgccatccaaaccattttttcaaacagcggatggcgctggattgccgttaagccataggtggcaaccaccagtaatgtggtgagccataaccaggtttgctgccccaagacagccagtgcccagagcaggtcaaaccataatgatatcgccactaacgccatgattaatctcgttcaaaagtcatgtgcacggtactgatgctacgggctaaaaagccaccttcgcagtaacaaaagtaataacgccacatacggatgaaacgttcgtcatacccaagatcacgtactttcggcaattgctgctcaaatcggtcacgccagtgttgcaacgtcagtgcgtaatctatgccgatgtcatgcaagttacgcaacaccaacccagttcgtttggtggctaattcggtcaacacactgatcgaaggcaaaaaaccgccggggaaaatgtatttctgaataaagtccacgttattgctgtagctttcataacgctgatcggcaatggtgattgcctgaatcgccattttgccgcgcggcttcagtaacgcataacattggctcaaaaacgtcggcaagtaggccttacccaccgcttcaatcatttcaatcgataccaacttgtcatactgaccgctcagcaaacggtaatcttgtttgagcagggtaatttggttatttagcccaagtgccgtaattttttgctgtgcgtaagcatactgctcttccgaaatggtggtggtggtgaccttacagccatagtgctgcgccatgtaaatcgccatcgcgccccaccccgtaccaatttctaacacgtgatcggtcggtttcagttgtagttgctcacacaaacgctgcattttggcttgctgcgcctgctctagtgagagctcaggttgggtaaacagcgcgctggagtaaagcatctcttcatcgaggaacagttgataaagctcattccccaaatcatagtgctggtgaatattatctttggcttgatctatggtgttgcgtttgagccagtgagtgaaacggtttaaccattgagtcacaggactactttgactttctagcttatccagcgtaccgaggttggcagccatcaactgcatcaaggccgtcagattagggctttcccaccacccttccatgtaagcttctgcggcagcaatactcccgcccttcaatactcggctgtaaaaatccgggtgtttaatttcaatcacggcatgaatggcatcgggcttatcttggccaaattgttcatgcgtggtttgggtttgatcggggaaatgttctatcactgttaaattgccttcgagatactgtaatgcacggtgaataatactgcgggcacctttctgccaactggtgagagagcgggatatttccatcgacgagctatttaacatgaggttgctccttattattgttctgagtttggtctgggtgcgcataaaacggggcacctttgcgccacaatttgaaagcgtgccaataaatgcccaataccacttttactgccatgatcggcgttttgatcaatcgaggtaataaattgcttgcgctcaagggttcagcctgcatcgctaaggtagcatcaaactctttattactacgatgacactcaagatggatcatcagcgcgcgagttaagggtttaattttccagcagtatctctgttcgatgggattgaatggcgaaacatgaaacgctttcgcatgctgccattcaatcacggcagcctcttctgaggttaatgctgcttgtgctggaaccgcatagtagtggcgctcattccacggggtattgctgacttcagccaacaaataacgccaacgcttttcgctatcatagacgtagtaaaagttgactgggctaaaatagattccgagatagcgcaggtgcagcaaagccaccactctgccgccttctattcgctctcccgtcagttgctcgatcttatcaagtactgcttgtttgagcgggccttgcccgaggtaatcttcacggcgaaaacgcgcccaatgccaccaacgctcacccaatccccacactttatccgccaactgtggccattcatctaaatcaatacaaggcataaacagcggatagttgagtgcgtgctcgaccggcgtaaaacgtcgatgtctgacttgtccaaccatcaaacaactttgccactcggtgctatcttggggcacaggcattaggccgctccttgctcactgcgctgtgcgtaagcttccaattgggtcaccacatccagcgcactgcgtaccccatcctcatgaaagccgttatgccagtatgcgccacaaaaccaagtatggttgacaccgctgatctgcgcttttttctgctgcgcttcaatcgcaggacgagaaaacaccgggtgatgataggtaaatcggcgcagtatcttgctcggatcaatgtcctcactactattgagtgtgacgcagaacgtctcaggcgcttcaatatgctgcaaaatattcatgttgtaggtcaaagatggcaaacgcgtttcttgattggcttcacctttcaaccagtaattccaagccgcccaagccgctttacgtttgggcagcagacgagtatccgtatggagcaccacttcattcgcctgataagcgagtgcagacagcagttgttgttcggtggaacttgcatcactgagcatggcaagagcttggtcgctatggcaagcaaaaatcacctcatcaaaacgctcactccgaccattgaccacaacctctaccccacttggtaaacgcttcacttgagtgaccgcgctattgaggcggatgcgatcgccaaatccttgggttaaaggcgcaatataactgcgcgaaccgccggggatcacataccactgtggacgattggtgacatccagtaggccatggtttaggaaaaagcgcgcgaaaaacatcagagggaaagctcgcatatccgccagagaggaagaccaaatcgccgcccccatgggtagaatgtagttttcacagaagtattcagaaaactgatgctgagccagaaaatcacctaaggtttgctcattcgccaattgattatcgacgcacgctttcgttaaacggttaaagcgtaaaatctccgcgataaaacgataaaactttggattcagccagttacgtttttgagcgaataaggtcgtcagggtatgcccgttgtactccaaaccgttagcatcattacgcacactgaagctcatctgcgtcggtttaccttgcacgccaatctcatccatcattttgatgaaattgggataggttctgtcgttataaacgataaagcccgtatccactgcgtacggcttacccgcaagctcaacatccaccgtcgcagtgtgcccaccaatgtagtcattggcttcgaatagggtgatatcgtgataacggtgcagatagtaaccacaggttaaacctgaaatgcccgagccaatgattgcaattttcatcaaaaaatccttattaagccttcaacagacgtcgaactaagcgaccttgccatgcataaggcaaagcaccgagtaaccgaatcagccaagtaaatcgtttagggaaatagagttgtgacacaccgcgcgccaagccagctttgatctcctgggcggcacgctctactgtgatgatcatgggcatggcaaaagtattgcgatccgtgagtggtgtggcgacaaagcccggaaaaatggtggtgacttcgataccaagtggacgccaatcgagttgaagcgttcgtgctaaataagcgacggccgctttggaagcgccataagcttctgctcgcggcaaggccagctcactggcaatcgagccaacaatcgccacacggtgaccacaggacaaatgtggctgtataccttcaatcaccgccgctacgccaagcacattgatattgaacacacgtgccatcagtgtgacatccatcttgccatcgtcgatgtactcacaatcgcctgcatttaaaatccagagttccggctgacatggaagctgcgctaatgccgcttttgtaccgggatgatcggtgacatcaaacgccaagggaaaaatgttggcatattgtgtatgtaagctgtctaacaccgactgattacgtccacacgcaatcacttgccaaccctgtttggcataatccaacgccagttgtttaccaattccggaggtcgcaccggtaatgaacaccgcggtcattgtcctagtctccgcttaatcgcgcggataacttgcccaagcacaggcaattgctcataaagcatttcccccatatcgaaataatcgcgatggtaggtcactttgccctcggcaaagtgcaagtggctcacgcctttcacatccacctgttcgcccttggctaattttgggtgacgtaaatgcatggtccagaccaaaaacgcgccctcattgaccgcatactgctcatgaatggtaaaagtacaggtatggacgttttggtaaagattcaaaaaatactggtaaagggcgtcaaacccttcgatgcgatgtgcggcatcttcaaacaccacatcaggatgatagatttcaatcagcctatgtaattggcttttatctaattgttgataaaactgcgcgacgtgttgtacgtccataatgctcatccctaaagttatacaaatttaagattcgtataatgcattacaaccatagttgagtttgtaaagttgtacaagattttttctgtacaactttatacttcatgttacgaaactcagaatgtaagggatcactaaagagcgttaagaaaacgagctcaagaagactatcaatcaagataaacaaaaccagcccgaaggctggttggaagagattacatattgcgcagtgctgcgatacgtttttcaaggggtgggtgagtcatcattaattcggatagagagcgtttacctgtgatgccaaacgccatcatcgaaccttcaagatgcgactcctgacccattttcaggcgttctaacgccgcaatcatcttgtgcttaccgactaactgagcggcacccgcatcggcatggaactcacggtggcggctataccacatggtgatgaagctggctaagaaaccaaacaccaattcaagcaccatagatacaccgaaatagaccatcatgttgctaccttcaccttcttccgaatcacgtgaagccacgatattggcaataaagcgcgacaagaagatcacgaaggtgttcaccaccccttgcatcagcgtcatggtgaccatgtcaccgttagcaatgtggctaacttcatgcgccaacacagcttcggcctcatcacgcgtcatgttgtgcagcaatcccgttgagaccgcgaccagagaatcatcacgctttgcacccgtggcaaacgcattcatgtctggcgcatcataaatcgccaccgttggcataccgatacccgcttggtttgcttggcgacgtaccgtttccaatagccaatgttccatctcattgcgtggagtatcaatgacgacaccacccactgagcgtagggccatactttttgacatcagcagtgaaataaatgcaccgccaaagccaaacacagccgccatcaccaacagaccagacaaactccctggctgcatgcccgtgacggcataaacaatattcaaaacaacactaagcaccaatacgacagcaaggttggttgctaagaataacaatatacgtttcatgacttaatctccgaaggaaacttctcagcggttgcgatgcgcgactttaccacacatcgtttgttcttatttacaacatatgttcttccatttgaaaaacaaggttaagtagtaaattgcaacatttaatgtccagattctgttcggcaaatgctgagcagcctagaaggcacaagggtatagactttggtcgtattgagatagccgtaatgaaggcatagagtgcgtgagtcgaaggaatttaaccacaaacaaaggaaaacacatggctgaagcacatagctaccaaatggcgattgatttactttgttgtcatttaggtatcagtgaacaagaagctcgtactcaactcggattggaagccaaagagcagacgctgcagcagcagatcgtcgatactcaacactctttaatgggtttgagcgcagagaaatagcctctcgcacactcaacttccatacagtctgatactaaaaaggctgctcatgtttgagcagccttttgttatttagcgtcgttatgccacggtgtcgggttctaacaagtgatccagttggatgaacttgcctaactcttgacgtttagccttaggcatataagggatctcccctaatttcggtgtaccaagccgcccttctagatgctcaatgatctccgcatagtgttcagttcccggattaatccggttggcaatccagccgactagctctaacccatcggcacgaatcgcttctgcggtcaaaatcgcatggctcagacaaccgagtttaattccaaccaccaagatgaccggtaaacgctcttgttttacccaagtagataaacaatcggaatcggaagtaggaactcgccaacctcccgcaccttctaccacgactaactctgcattttgcttatgtttcgagagcttattgcttagcagcgcataatcaatcgtaacattttcatgcttagcggcgatgtgtggtgaagtgggaagtactaaggcataaggattgacgtcctcatacggcatatcgacggtcgcggctttcatcagatgcaaggcatcggaattgcgatagccaaactcagttttatcactccccgctgcgactggcttatagccaatcgtagcgatattgtgtgtcgcgagcgcctgaagaatcgctttcgaagcgactgttttcccaacgtcggtatccgtccctgcgataaaaattgcatttctcatcggtgaataacccctaaacaaacctgatatgtggcaggcacaagaccctgttggttacgaaatgattggtaggccaattccacttttgccaacgttcggcgactgattagccccgttgaacgtccactgacatgattggcgccgatcccttttagatcgcgcatcagcataaaggcagcttcataccaaaccgtaattgccgctaagtctaagtgatgttgcgaacatccggcttgcgctaacgcaatttttacctgattgatggaaatgaactgattgatatgacgatgatgatcaacgctgcgccacgcttgctcgagttcaaacagcgaaccgtctaacaaggtggagaggaaggcttgaccatgtggtttgagtacacggcgaatttcgctcagcggcagcgacagatcttcacaccattgtaatgctaagcttgaaaataccatgtcaaaacaagcagatgcaaaaggcagttgctcggcatccgctaactggtaactcatgccttcatcaccgcagcgttgctttgcttgctcaagcatggcgtgtgagatatcggcgcacaccacttgcgctccccgctcgcgtagcaaggctgaaaaataaccggtaccacaaccgagatccaatactcgcagccccttcagacaactgggcattttttgcagtaaacgcaatccgacatcgcgctgaaaagccgcgtgctgatcatagtgcgcggcggctttgccaaaggcttgcgcaatcgcacttttgtcttttaattcaacacaaagctccgtggctgtcatgctcatgtgtccttctccatcacatgttttaactgctccgataagcggcgtatctgcgcttgggtatgcgccgccgttatcgtgatacgtaaacgcgcactgcctacaggcacggtgggtggtcgaatggcactcacccaaatcccttgctgcttgagctcgtgggatgcactcaatgcggaatcagagctgcccaacaaccaaggtttgatgggcgtttgtgttgccacaaaacccggaatattgcggcactgctcatcaaaacacgccagcagctcagccaattgttctctgcgccaagactgactttggatcatccgcgcagcatgagtcagagcatgcgcttgtgccggaggcatagcggtggaatacacatggtggcgtgcaaattgcgtcagataatcaccaacgtgcgcatcacacaacaccgccgcacctgctaacccaaaagctttaccaaaagtaacgaccagaatctcgggatgaatccctgccgcttggcagctccctgccccatcctctccaagcacgccaatgccgtgcgcatcatccaccatcaaccaagcgcgctgtttcactaaagttgcaatttgcgccaagggtgcgcaatcgccatccatgctaaacaccccttccgtcaccactaagctgttgctctgctcatgcagtaattggcgaagatgctcagtatcattgtgcttaaagcgtttcatggtggcaggacttaacatacccgcttccatcaaggaggcgtgattgagtttgtcttgcagcagcaagtcctctttttcgagcaaagtaaacagcagggcttgattggcactaaagccagagctgaacaagactgctcgctcgtaaccaagccagtgacacaactcatgctctaactcggcatgagcggagctaaaaccagttaccatcggcgaagcgccactgcctgcgccaaagcgcgccagaccggtttgccaagcctgcactaactcagcatcattggctaaaccaaggtaatcgttgcttgagaagttcaggtaagtacgatcttgctgaatcagttcaccttgtgcgcttcgatctaaaagctgaagacggcgagtcagccctgaatgttcacgctcattcagagcttgctcaatccgcgacttaaagcgcagcgtcataaaataaatcgctggcggttgggcgcgcggctactcgttcaacgactctatccaacaactcattttccgtgatttcatcgggcttttgcgccacttgttcgcggttaattcctagctttttaaacagcagcatatcgctgtcttccgctgggttgggggtggtcagcagtttgcaaccgtagaaaatcgaattggctcctgccataaagcacagcgcctgcatctgctcattcatcttctcgcgtccagctgaaaggcgaaccgcagatttcggcatcataatgcgcgctaccgcaatcaaacgcacaaaatcaaagggttccacatcatcgacttgttccagtggtgtacctttcactttgaccagcatgttgatcggcacactttccggatgagtcggcaaattcgcgagctcaaccaataacccagcgcggtcattggtgctttcgcccatgccgataatgccccccgagcagatcttcatcccggcatcacgcacgtgcgataaggtatctaggcgatcttggtatgtgcgtgtggtgatgatgttgccataaaattccggagaggtatcaaggttgtggttgtaataatccagccccgcttgcgccaattgctgcgcttgatctggcgtcaacatacccagcgtcatgcaggtttctagccccatatccttcacgccgcggatcatctctttgagcagcggcatatcacgctctttcggattcttccacgccgcgcccatacaaaaacgggtcgagcctgaatttttggctttttgcgccgcatccaatacgcgctcgacttccatcaaacgctctttatctacatcagtacggtagtgagcactttgcgggcaatatttgcaatcttctggacaagcgccagttttgatcgacagcagcgtgctgacctgcacatggttgtgcggatgatgaagacgatgcacctgctgcgcttcaaacagcagatccataaaaggtttatccagtaacgctttgacctcagcgaccgtccagttatgacgaacttccacgtgtaatccttattggggttattggttttatgcttggctagtctactgacaggcgttagactgtcaacaataagaaaatcacaaggtttacatgtggttattaattaatcttttattaattttggaatgatgatggatttagccttcgaccgttgccacatctggcatccctacacttcgaccttgacacctctgacctgttatccggtaagccgagccgatggcgtaatgatcacacttgaagatgggcgcagcttagttgacggcatgtcctcttggtgggcagcgatccacggttacaatcaccccaaactcaatcaagcggcgcaccagcaaatcgagcagatgtcacacatcatgtttggtgggttaactcatcaaccggcgattgagctttgccaaaagctactcaagctcgcgcccaacaatttacagcaagtgtttctcgccgattcaggttcggttgcggtggaagtgagccttaaaatggcgttgcagtattggcacagcaaaggtcaaccgagagcaaagtttctcaccctacgccacggctaccacggcgataccttcgccgcgatgtcagtgaccgatccagataactccatgcatagcctgtacaaaggttttctgcccgagcatattttcgctaattcgccagaaggcggattttttgatgcgtgggatgagcgtgatattgccgattttcgtcacaaattgactgaacatcaccaccagattgccgccgtaatccttgaacctatcgtgcaaggggctggtggtatgcgtatctatcaccccgagtttttacgccaagttagagctttgtgtgacgaatttggtgtactgctgattttggatgagattgcgaccggctttggccgcacaggcaaactctttgcttgtgaacatgcgggaattcaaccggatattctctgtgtgggcaaggcgctgactggcggatacatgacgctatccgctaccctcactacccaacaagtggccgataccgtttgtgcgggggaagcaggctgctttatgcatggcccaacttttatgggcaatccgctggcttgcgcggtggcaagcgccagtttatcgctaattgagcaaggtgattggcaacagcaagtcgcaaacattgaagcgttttttgccgagcaactgcctaaactcaacgattcgccacgggtgaaacagactcgttggctaggcgctattggtgtggtggagacgcatctcccggtcaatatggaagtgattcaggctctctttgtggagcatggagtttggatccgcccctttggtcggttgatttacttgatgccaccctatattagtcaacctgaacatctgcaaaagctggtggatgcaatggcagccgcgttaaaccaaccagactgctttaaacaatagacaatatgctgcgcaacaaacgacaagcataaaaaagccgacatcacgtcggcttttttcgttcttatctctttgagcgctgatttccctttagaggaaaacgggattaaccgatatgggttaaaccgcccatgtacttttgcagtaccgcagggatcgcaatgcgaccatcggcttcttggtagttttccaaaatcgcgaccatggtacgacccaccgccagaccagagccgttcagcgtgtgcaccaactcaggtttcttctcacctttgcggcggaaacgcgcttgcatacgacgcgcttggaaatcccacatgtttgaacaagaagagatttcacggtacgtcttctgcgctggaacccaaacttccaagtcgtaagttttgcacgagccaaagcccatgtcgcccgtacacagaatcactttgcggtaaggcagctccagcagttgcagaactttttctgcatggccagtcaactcttccaatgccgccatggaatcttcagggcgagtgatttgtaccagttccactttatcaaactgatgcatacggatcagaccgcgagtatcacgaccataagaacccgcctcagagcggaaacaaggcgtgtgtgcggtcattttcagaggcagttcagcttcatccaaaatggtgtcacgcactaagttggtcactggcacttctgcggttgggatcagtgacagacggcgtggctcttcatcactggctttctcagtcagaggctcagtgtggaatagatcttgaccgaattttggtaattgacctgtaccgaacagcgtttccgcgttcactaggtaaggtacatacagctcagtgtaaccgtgttgatcggtgtgcagatccaacatgaactgtgcgatagcacggtgcaaacgagcaaattgacctttcatcaccacaaaacgcgcacccgtgatcttggttgcgctagcgaaatccagaccgtcgcccatttcgcccaaatccacgtgatcttttacttcaaaatcataagtttttggtgttccccaacgagaaacttctacgttttcgctgtcgtctttaccgtttggcactgcatcgtctggaatgttaggcacggtttgggtgatcgcatccaattgcgccataaccgcatccaattccacttttttcgcatccagatcgtcacccaaagtgccgatttgttgtttaaccgcttcagcgcccgctttgtcgccagacgccatcagttgaccgatttgcttggagatggagttacgcgtggattgtaaattctcaacttctacttgaatggacttacgttgttcttcaagagtacggatagtctccacgtcgagtttaaaaccgcgacgtgccaattttgcagctgtttcgtccagctcagtacgaagtaatttagaatccagcattgctaatcctatgctttaagagttgcgagaaagcgcgtgtgcttcctttttagccaaagccacgcgtattgaaatttaccctgccaaagataaccaaaaggcactacttttcatagcgcttttgtgggctttttgcgttcaaatccgccagatacgctaacttttcggcaatcttagtttctagcccgcgtggagtaggctgatagtagcgagttccactcatttctggtgggaaatagcactcccctgcagcataagcgcccggttcatcatgggcgtaacggtattcctcaccataaccgagatctttcatcaatcgcgttggggcattacgcagatgcggcggtacttcaaactcaggcagattatgcgcatccgacagcgcttgtttccacgcggtgtacaccgcgttgcttttcggtgcgcaggcgaggtagacaatcgcttgagcaatcgcgcgctcgccttctgcaggccccacacgggtaaagcaatcccacgctgcgagtgccacttgcatgccccgtgggtcggcattaccaacatcttcagaggcaatcgcgagcagacggcgcgcgatatacaaagggtcacagcctgcggaaatcatccgcgccgcccagtacagcgctgcatcgggatcggaacctcgaatcgatttgtgtacagcggaaatcaggtcataccaaatatcgcccttgttatcaaagcgcgacactttttcaccagcgacttcagccaataaaggcagatcaatctgcttgcgtccctgatcatcttcgcgagccatgtcgtacagcagttcaagataattgagcgacatgcgcgcatcgccattgaccagttcggctaggcgatctaaaacattatcagcaaataccgccgccactttgccaagcccgcgttcagtatcggcaatcgcttgatgcagagcttgcagaatttcttgttgattgagtgaggtgagcttataaacccgcgcgcgggaaagcagcgcgttattaagctcaaaagaagggttctccgtggttgcgccaataaaagtgaccgtaccatcttcaatatgcggcaaaaacgcatcttgctgcgatttattaaagcgatggacttcgtcgacaaacagaatagtgcgtcgaccactgagtttgttctcacgcgctttttcgatcgcggcacggatctctttgactccggacgtcaccgccgatacgcgttccacttccgcattggcgtagttggctgccacttcggctaaagtggtttttccggtgcccggaggtccccaaagaatcatcgagtgaatatgccccgcttctaatgcacggcgcagcggttttcccggccctaagatgtgttgctgacctatatactgctccaccgtttgtggacgcatacgagcagctaacggacgaaaatcttcgtcgccggaaaaatctaagctgtaattactcactcgactcgcttccttggtgctgatttagttacgctgatcgtcaacttccacgcctttcggcactttgtagttaaatacgctagcgtttggtttctgctgtttcaccttactaaaggtaaattcgctctgctgaccatcttgctcaatcactttaaaaccttgtaccacccctttctcactgatggtgatttggaaacggccttggtttgaatccagcgcagtaggcgtcagagtaaatacatcacccttttcttccacatgataggcatcccaatcgctggctttattacgagtcagcagcacaaaaggcgtctgctctaaagcttcttcggcgcggtacaaggtgacctgctccacgaaagggtcgaaatgccataaggttgtaccgtcagagaccagtaagttttcatctggcgtttcggtttcccaacgaaataggctcggacgagcaatatccaccttgccatttccggtcaggatcactttgccctctgggcttaatacttgctgattaaaggtcgcgctgaagccttcactcatggctaaacgctcacttaaggtatctttaggggcggcaatggccgagaaactacaaaataacagggctaaccatttgttcatgctgactctgctccaagcaatttagcgatgaggaagataataaagcaaaagcctaagcgtttgccttctctaacgtgtcagtgatgtgtaataaactattgcccacaacactgtttgaattttttaccgctgtcgcaagggcaagcatcattgcggccaatgcctttaaacggattcacactttgtgctttagcgccgagcatggcttcatccgccgcgagcgcgacttcgtgcaccattaaattcagttgctcgatcaaatcggcgagcgcagggacttgttcatagcccgcttcgcgcatttgcgcttgggtttgcgcttcatcaatcgccaacatcaaggtggtcaataatgcttgcaacatacgaatcgagccatctgcaaatgcgccttgctgccacatgggttcaacttgcggccataattgcataaagccttccgcaaaatctgccaaaccttgcttacgcgagggtgcatgctcggccaacaatgccaacaaatcataaccgttgcctttaagcagctggtattggcgatgaatttgctcggtcaccggttgtaataacgcttgatgttgctcggtaaacagctctggtagccactgctcaggatcgagcggacgagtcgccaagttagcggcgagcaccacaccttcaataaacagatccgactcagggcattcaatcgcgctgagatcgatcagggaataattcataggaaacacttaagacaaggaaagttgcgccgcattatatactcaaagctaaagaagtggcaggtcgtcacactgaacttgaatcagaaaggatgagtgacatttatcgatgctactactacaatctcgctcccttttcttcagcgctagccggtattcatcactatgcgagttattttaggcccgatggagggcgtgttagatcatttgatgcgtgacatgctgacacaaatcaatgactacgatttctgcgtcaccgaatttgtacgcgtagtgaatctgctgctgcctgatcatgtgttttatcgcctctgtcctgaattgcaacagggttctaaaactccgtccggtgttccggtaaaagtacaactgcttggccaagacccacactggatggccgaaaacgcgatccgcgctgctgagcttggggcttatggcatcgatctaaatttcggctgccctgccaaaatggtcaatcagagcaaaggtggcgcggctcttttgcagcatcccgagttgatttatcaggtggtcaaagcgtgtcgtgacgcagtaccggcgcacattcctgtttcggcgaaaatccgcttaggttgggaagatccggaagattgttttgagattgtcgatgccgttgcgcaagctaaagccgatgagctcactgtgcacgcgcgcaccaaagccggaggctacaaggccagcgaaatcaaatggcattacattgaccagatccgccaaaaatgcagtattccattgattgctaacggtgaagtgtggaattacgccgatggtcaagcttgcatccaaaccacaggtgtcgattcactcatggtgtgccgcggcgcgctcaacgtgccgaatttaggcaatgtggtcaaacacaatcacgccgccatgccttggcatgaagtggtggatttgttgctgcgctacacgcaatttgaagtccgtggtgacaaaggcaaatactacccaaaccgtattaagcagtggtttgcttatctgcgccacgcctaccctcaggctaatgagctgtttggtgagttacgtacgttgactcaagtcgagccgatcgttgatcagttacatcgctatcgcgatcaactccatcatgctgcggccgagctacctgtctaatgagtaaaacaacgaatcagtaaatcaactgatcagtaaaccaactgatttttgccgctggttttcgctacatacaacttttcatcagcggctttaaacaaatcttcaaaactgcgatcggttgtactttcaaccacctctatcccaccagagatggtaaaacctggctctagtattaaaggggactcgcggcaaaccgcatcaaaaatgcgctgcataattctcgtgatctgctctttttcttttgctgtgacataaaccacaaattcttcgccaccaaagcgtgccacggcatctgagctacgaatatggttttcaatctgctcaccaatgtagcagatcactctatcccccatatcatgaccataagcatcattgatctgtttgaagtcatcgatatccaacacggcaatggctaaatattgactgtggcgtttgcctttcagaaagctttccataccacgtcgattgagtaaacccgtcatcggatcacgcgcggcgagctgcgcataatgctggcgatcccagcgcgtattgagatagataagtacgcctgtgagaaagaggtacaccagagcaacgaccagtaaattaccgctcttctcagtaagaaaattgctcaattcggactgaatatccaacttataaaataccacctgatgatagtctgcatattcactggtgagcttgtgtggacgataggcaaacgttggaatagccatctcattcaaatcaatcatgtcaaaacgagatgctaaatgaggcatgcggctaagcagttcgcgtaaaccaatatctaccgcaacgagtccttgataatccgcgtcacggtaaacgggcagaatcagtgttaataaccactcatgttgctctctgatcactgagcgataaggcccatcaacggcaatcatattgggggcagcaatcgcatggctccacaaaggactctcgctgataaagtctttaatttgctgataggttaccttttcgctgatggtatccggcgatgaaatgatataaccgctgctatccacataatgcacaccataaatatattcatccatgtcatgcaaaaacgagagtataggagccatggagagtttgatttgtaaactgggatcatgacttggtttggaatcgcataacgaggcatccccaatcagcatataacttagatctaatttgggaacagcaaagctggaactcagcccctgagccagaactaacccatctatcggtttgatttggcaaacattcgcaaccacacgggctgagtgtttaaacaatatattctctgccgggcgttgattatgcgtgaaagtgtaatccagcgctgtcaccactttttcggcgcgctcaagctgctgttgaatgtcagcgtaggcgtcgtcaatttcttggttaagatcgtacagatattgctgaaagaccgatgcggccagcacaaaaacgataaacagtggcgcacagataatccaagttaaactcatgcgctgattcataattgcctgctaacctctagaaatgaaaaacccaccataaaccgataacgcttatgatgggtagggatattgcgttgcggcgattatgccaaaaaacacaaaacagtgttagcgcttgttcatcatccgtctctttttcctcaccgttttctattcaaacaggcacttaactcagtagcaaactatcgtctgccaactcttctccacgcactttagaaaacatctcaagtagctcaggaacgcccatgttcgcgcgctgttcccctgtgacatccaagacaatctgaccttgatgcagcatgacggtgcgatcaccacaagccagagcatctttcatcgagtgggtcaccatcatcacggttaaattgaactctttaacaatttttttcgtgagatcgataatgaatgccgccatacgaggatcgagtgccgccgtgtgttcatctaagagcaagagcttgctttctgacagtgtcgccatcaccaaactcaccgcctgacgctgaccacctgagagcaaaccaatattgtcaccgagacgatcttctaaccccaaaccgaggatgctgatccgttcttggaacaacttccggcgctggtttgagagcgccaagctccaaccacgttttttaccgcgcatataagcgagcgccatattctcttcgatggtcagggctccacaggttcccgctaatgggtcttgaaacacgcgagcacacagattcgcacgctgatccacactctgtttggttacatcaatctcatcaattaacacctgaccgcccacgataggcgtttcaccagtgaccgcaccgagtagcgtcgacttccccgccccgttagagccaatcacggttaaaaattggtgttccggaacctctagcgatacgccgcgtaatgcgcgattttccagaatcgtgccagggttaaacgtcacctgaatatcttgcaaacggatcatactgcatctcctgacacgcttccctgctgagagacttcgggcttctgagcaggtgcgttacgcttttttgattttaaattccttttaatcttcggcatgatcagcgccaaagccactaacacggcagtcaccaagttaagatcggacgcttgtaagccaaacatgcctgaactgagtgcgaaggcaaccgctaaacggtacagcacagagccgacaatgaccgccacgacagcgacccagatcttgcgaccggggatcagggtttgtcctaaaataaccgcagcaagccccaccacaattgtaccaacgccagaagtgacatccgcaaaactgttggtttgcgcaaatagagcccctgcaaaaccgacaaaaccattagacagagccaaacagaaatacgtgtaaaacgcggtgcttgccccttgggctgccaccatacgagcgttgacacctgtggctcgcaatcctaaaccgaaatcgctgttgagcagtcgaataactaatagcgcagaaatcacgaccaatactgcgacaacgagaggacgaattaagacaggatcacccaaggcttcaaacggggtcaaaatggtgtcttcacccaataaggccagattaggacgtcccataatgcggatgttgatggaaaacgcagcaatcatggtcaaaatcgaggccaagagatgcaagataccacatcgcacactcagaaaagccgtgacccaaccggtagcggcgccagcaagaatggccaatcctgtcgccacccatggattaattcctgccacaatcgcagtagccgccaccgcagcgcccattgggaaactgccgtcgacgctcaaatcagggaaatccagcactcggaaagttaaatacacgcccaaagctactaagccatacaacaagccaagctccaaagcgccaaaaaaggcaaaagcagacatacatactcctttctgcttacagaagttgaaataccccaactccttggaatatacgcttccgacgaggggctagcgcgtcaagcgttaccccctcgtcatttggatagagcttacttatttggtactggttgcacgcgcaagtacggcttcaggaatggtgatgcctaactgttctgcggcggttttgttgatcacaagatccgaaccttttgccacttgaacatcaagcgaacccggctctttaccttctaaaatagccgccacgtagtcagcggtttgcactccgatttggtaatagtcaaaacctaggctggcaattgcgccgcgttctacataagacgttgctgcaccaaagactggggttttggcttggttagccgccacaatcataccttcgattgcactggcaactgtgttgtcgatcagggcataaatcacatcggacttttctgcaatcgcttgggtggctgattgaacatcagcacttttcagcgcagtcgcttcgaccagcttaataccatgttttgccgccgagagtttgagtaactccattaaactgaccgcattggcttcacctgggttgtacaccacgccaatcgatttgacgttgggtaggatttctttaatcagttcaacatgttgctcaaccggagacaaatctgacaaacccgtgacgtttttgcccggttgttcaagttgtttcaccaacttagccccaacagggtcagtcactgcggtaaacacaataggtatggtttttgtggcagaaaccagtgcttgggcggtaggtgtcgcaataccgactaaaacatctgggttttcaccgacaaattgacgggcaatttggaccgcaatggcagggttgccttgcgcggttttgtaatcaaactctagatttttgccctcttcatagcctttggctttcaatccatcgagtagcccttgacgtgtcgcatctaaagcggggtgttccacaatttgtgataccgcgactttggctgttttggccatgatactctgggaagacagtagtgcagctccggctagaacggcggtagcaataactttgcctgctctcatcttaactccttgatataaagcatagtttttatgatgttgtgtgtgggtgtagctttaatagttgttattggacacttagggtgtcgctgacaacattattaccagtaactttaggcaaagggaagtaggatttaacagttagataacagaaaaaagctcagaatttggtcaatgtcgaaaatggaagtgaagttaactatctctcttcccaaacgacgtggagcgacagaggatggtaggcaagttcactctcatgaacccagataaacgctatgattaaggtgaccccataaaagatgatccccataacagataaccatagggatgtaagatcaactctgctagaatgcgccgccgcgcagaggtcaacaagtacatggctcatctctgccaaatcttggtatacctactctatttacccttaggagccgattattatgaccgatcaagaaagaatcgaactacaaaagaacaatccactacacggccttaagttagaaaccttgctacaagagctggtggatttttatggctgggatattttagatactgcaatgcgctttaactgctttcataccaagccttcgattgccagcagtgtcaaatatttaaacaagaccgagtgggcacgagaaaaactagaaaatttttatctctatcgctttaaacgcatgcctcgcgcttccagtgaagagtttactctcccgccacgcgcaagaactttccctcacggcctacaccctaaagagccgatggcattaacggtagactctattttgaaatctcaggcgaaagcggcctctgctcataaagaaagaacgtctcgcagtcgctacaatcagcgctaactgatcttgatctcatgggataggttgccttggcacgcggcaagtttctgtgaccaacgattcgatatgctattcgatattcgttggtcacactgatgggacaaatagcctactcggtagccttaaaaccagcgttctagcgcagtatcatccagttgtcgaaacgcacgattcaacacttgcgcgagctctttatagcgcggtttgcttttgatcggctccagtgcaaaaccagtttcgacgatcttcatatagagttcgcgataccagctcgcaagcgccggaggtagttgggtattggcacggtgaccgagccaccaaatgccttgcagtggcaagctcatagcaaataaagcgaccacaatcgcctgaggcatggcctgcgtgttggcaaacaccatttgtgtcagcacgctgatcgccgcaaccgcaggcatcactttaatcgcaaagcgtgtggctttaatcacgcgttgctcagggaacagtggatttaactctttgcgcatcggccaaatatccatgtacttctggccatcttttaggctatgcactatgccgactttattattcatatccacttcctcgctgctctttgctcaacccactaaaatttagttgaatgattcaacaaaagacgcaaaaatttgacaaaagctaatattgattcaaattttttttgttatatttgtccattatcgctatgctttgcggactctcaatctcattgttgcccttatttacaatttaggcaacgttgagacgattcctgcacggattgcatcgacgacttatactgactttgtcacgtcttcacgatacggaaattgacgttttattgaccgagattagggcgcattcatcgaggcgtcatctactcttggtactgatttttttatcccaaccgattattacaggtagtcactcatgtctaagctggttttagttttaaactgcggtagttcttcacttaagttcgcagttgttgacgctcaaagcggtgaacaacatctttcaggtctcgctgaatgtttacaccttcctgaagctcgtatcaagtggaaattggacggcaagcacgaagctcaactgggcgaaggcgctgcacacgatgaagctctgtctttcatcgttgaaactattcttgcttctaaaccagaactggcagctcaactgaaagcgatcggtcaccgcgtggtacacggtggtgagcagttcactcaatctgcactgattgacgacgctgtactgaaaggcatcgaagattgtgcagcactcgctccactgcacaacccagcacacatcatcggtatcaaagcggcgcaaaaagcgttcccagagctgaaaaatgttgcggtattcgacactgcgttccaccaaacaatgccagaagaagcgtacctgtacgctctgccatacaacctgtacaaagagcacggtattcgtcgctacggcatgcacggtacgtctcacctgttcatcgcacgtgaagcggctgagcgtctgggcaaacctgcaaacgaactgaacatcatcaactgccacctaggcaacggtgcttctgtgtgtgcgatcaaaaacggccaatcggttgacacatctatgggtctgactccactggaaggtctggtgatgggtactcgttgtggtgatatcgatcctgcgatcattttccacctgcacgacacgctgggttactcagttgagaaaatcaacaccatgctgaccaaagaatcgggtctgttgggtctgactgaagtgacttctgactgccgtttcgttgaagacaactacggccaaaaagaagaagcaactcgcgcaatggacgtattctgtcaccgcctagcgaaatacgttgctggctacacagcaagcctagacggccgtctggacgcgatcaccttcactggtggtatcggtgaaaactctgcgccaatccgtgaaatggttctgaaccgtctagcgattttcggtatcaccgttgacagcgcagcaaacctgaaagcccgtttcggcggtgaaggtgtgatcaccactgcagacagccgtatcccagcgatggttatcgcgactaacgaagagttagtgattgcagaagatacagctcgtctgacgaacatctaatacgacttacactggctaactcaggttagccagtgtcatttaggggctcagcgtaagcctgtcctgcgtttgagctttgtcactttcaatctaagcaccttagattggtatcaatagtgttgaggtactttaccaatgtcccgtactattatgcttatcccaatcagcgctggcgtcggtctgaccagcgtgagcatgggtctcctgcgcgccatggagcgtaaaggggttagcgtttctttctataagcctatcgcgcagccacgtactggcgatgatcaacctgacctgacgtctactgtcatgagccgcaacagcgacatcaagatcggccagccgatgagtatgtctgccgccgagactctgatcggtagcgagaagatggacgttctgctggaaaccgtggttgagcgttacaaccagatcaacaaagatgcagaagtgactctgatcgaaggtctggttccaacgcgtaagcacccttttgctaaccaagtgaacgcggagatcgccaacactctcggtgcagaaattgtgttcgttgccactccgggtactgataacccaacgcaactgaaagagcgcattgaagtcgcgtgctctaactttggtggcaccaagaacaagagcatctctggcgttatcatcaacaagctgaatgcccctgttgatgaagctggccgtactcgtcctgacctgtcagagatctttgatgatgctgaccatgcgaaacaagctaaccttgaagtgatgcagatcttcaacaccagcccaattcgtgtgctgggctgtgtaccatggagcatcgacctgattgcgactcgtgctatcgatatggcgaagcacctgaaagctgagatcatcaaccaaggtgatatcaatactcgtcgtatcaagagcatcactttctgtgctcgctctatcccgaacatgattgagcacttcaaaccaggctcactcctagtaacctccgctgatcgtcctgacgtgattgtggctgcggcactcgcagcaatgaacggtgtggaaatcggtgccgtactgctgactggcggctacgacatcccacgtgaactggttagcctatgtaagcctgcttttgacacgggtctgcccattttcaaagcgcaaggtaacacttggcaaacgtcgctgaacctacaaagcttcagccttgaagttccagccgatgacaaagagcgtatcgaattcatcagcgaacacgtggcaagccacattgacggcccatgggtagactctctgactgaaggtgcgcaagcgtctcgtcgcttgagcccaccagccttccgttaccagctgactgaattggctcgtagcgcgaacaagcgtatcgtactgccagaaggtgatgagccacgtactgtgaaagcagctgctatctgtgctgaacgcggtattgcacagtgtgtacttctgggtaacccagaagagatcaagcgtgttgctgctcagcaaggtgttgaactcggctctggtatcgaaatcatcgatccaaaagtggcacaagagaaatacgtagcacgtctggttgaactgcgtaagagcaaaggcatgactgaagtggtggcgcgcgagcaactggaagataccgttgttctcggcactatgatgcttgagcgtaacgaagttgacggtctggtttctggtgcggttcacaccacagcaaacaccattcgtccaccactacaaatcatcaagactgcgccgaatgcgtctctggtttcatcgatcttctttatgctgctgcctgatcaggtactggtatacggtgactgtgcgatcaacccagatccaaacgcagagcaactggctgagattgctatccagtctgccgactctgcagcggccttcggtattgagcctcgcgtagcgatgatctcttactcgaccggtacttctggtcaaggtgcagacgttgataaagtgcgcgaagcaactcgcatcgccaaagaaaaacgtccagatctcgtgattgatggccctttgcaatacgacgcggcaatcatggaaaacgtagcggcttctaaagcgcctaactcgccagtggcaggtaaagcgaccgtattcgtattcccagatctgaacacaggtaacacgacttacaaagcggtacaacgttcagcggatctagtgtctatcggtcctatgctgcaaggtatgcgtaagccagttaacgacctgtctcgtggcgcattggttgacgatatcgtctacaccatcgccctgacggctatccaagcaggtcaagagcagaaataagcgctagtcacagtcatcttttctggtgataaataggcaaaagcccccgacattcgggggcttttttatgcgctttatagattgctatctacccttttcaaccaattcgttcacgctggtgtggactgagtagatccacttgcggcccgactggcacaacttgagtggggttgatcgtggtatgactgaaatagtaatggcgtttaatgtggtaaaaatcgaccgtctcttggatgccggggacttggtataactcccttaaataaccgctcagatgtgggtaatccgtaatacgctggcggttacatttgaaatgcccgacatacaccgcatcaaaacgcactaaggtggtaaacaaacgccagtccgcttcggtgatttggtttcccgctaaatagcgatgcgttgtcagatgctgatcaactttatccaacgccgcaaacagcgcttcaaacgcttcttcataggctttttgcgtggtcgcaaaaccacaacgatataccccattgttgatgttgggatagatgaactcattccactcatcaatcactgtgcgcagcgcttgagggtaataatcggtttgattgcccgttaactcattaaatgcactgttgaacatgcggatgatttcggaagattcattgctcacaatcgtgtgaagttttttatcccacaacacaggcaccgtgactcgtccggtgtaatcggctttagcatgggtataaagttgatgtagttgagtgtagccatacagcggctctggtatgccaaactgccaaccatgtgagagcatatccggacagacaatcgtcacatcaatatgcgtttgcagccctttgagagcacgaaaaatcaaggtgcgatgtgcccacggacacgccaaagagacatagagatgataacggccagattctgcagcaaattgcgcatcaggcgtcgctttcacccagtcacgaaaccctgcatcttcgcgtataaattcgccatcatgttgtttggtgtcgtaccaaacatcgtgccatttgcctttaattagcttgcccatcttgcccccaaattctcatcttttaggcattataagcaactgggcacgccacttaacccaaggcgattggtcgtgttgttcaaaatattcgaatacaaaaaaagcgcgatccgaacgaggaatcgcgcttggcccgtcacaggctgaatttatgcctcagcgtataaacaagagactgagtgaatatccgaacctttaatcactggtttcgtcttcgcacactctgccgtggcttgcgggcaacgagtacggaacacacaacctgaaggcgggttcatcggtgaaggcagatccccttccaacatctgaatggtcttattgcgctcgatgttggggtcaggaataggcactgcagacattaatgccttggtataagggtgtttagggttggcaaacagttctttagagacgcctaactctaccgcattacccaaatacatgaccaacacgcgatctgagatgtgctttaccaccgagagatcgtgcgcgatgaacaccagacttaaaccgagctctttttgcagctctttgagaaggttaacgacctgagcctgaatcgacacatccagagcggaaaccggttcatcacagatgatcatcttaggtttgaggatcagcgcgcgagcaataccgatacgctgacactgaccgcctgaaaactcatgcggataacggttgatcacgttaggcagtaacccaaccttggccatcatctcttttacccgatctttcacttcttgcttggaaagctcgggatagaaggtttgtagtggctcagcaatgatatcaccgaccgtcattctcgggtttaacgatgccagagggtcttggaagatcatttggatttgcttacgcgttgcacggcgtttgacttcctgcatacgtgttaaatcctgacctaaccacaccacttcaccgtgagtcgcttgcaccaaaccaataatggcgcgtgcaaacgtcgatttaccacaacctgactcacccactacccctaaagtttcgccttcatacagacgcacgttaaccccatcaaccgctttcaaggtaacgggtttggtccatggccatgccgatttcggggtaatgttgaaatggactttaagatctttaacgtccagtaataattttttctctacgctcattttgtccaagcctcccaatcagaaaaacacgcacgttgacgactgttaccaaacggcagcaagatcggagcttctcgcttacagcgatccgtcacgcgatggcagcgttcttgataaggacagccgacaggcaaacgcagcaagttaggtgggttgcccggaatcgtcggcaacacttccccttcggtatccaagcgcgggatcgcgctcagcaaaccttctgcgtaagggtggcttgggttgtagaaaatatcgtttactgaaccgtactccatagtacggccggcatacatcaccagcactttatcgcaagagccagccaccacccccagatcgtgggtgatcatgatgattgcggtattgaactcacgtttcagttcgttaagcagctccatgatttgcgcttgaacagtaacgtcgagtgcggtggtcggttcatcggcaatcagcagtttcgggcgacacagcaaagccatcgcaatcatcacacgttgacgcataccgccagaaaactcgtgcggatacatggtgatacgcttacgcgcttctgggatctttaccgcttccagcatgcgtactgactcttcaaacgcctccgctttacccatacctttatgcagcatcagcacttccatcagctgatcgctcactttcatgtagggattaagtgaagtcattgggtcttgaaaaatcatcgcgatttgctcggcgcgcactttattcagttcacgctctggcaagttgaggatttctttaccctcaaatttcgcgctaccggtgattttgccgtttttggcgagtagccccatgatggcaaatacggtttgtgattttcctgagccggattcgcccacaatacctaaagtttctccctgcttaagagagaaattgagatcgttcactgcggtgacaataccgtcttgggtagagaattctacgcgcagatctttgacatctaataaactcatcattgcttcctttttattcttcttggtttatctgtcttttggatcgagcgcgtcacgcagaccgtcgccgacatagttaaagcagaacaaggtcaacaccatgaatgcggcggggaatagcagttgccaaatagccacttccattgtgttagcgccctcttgtaacagcgcgccccagcttgtcatcggctcttgaacaccaagaccaaggaaagaaaggaaagattcggtcaaaatcatgcttgggatcagcagggtggagtaaaccgctacaatgcccaatacgtttggcacaatatggcgcgtaataatgttccacttactcacaccacacacatgcgccgcttcgataaactctttgctacgtaggctcaaggtttggccgcgcacaatacgcgccatatccagccatgcgattgccccaatcgcgacgaagatcagcacgatgttacgaccaaaaaacgtcactaatacaatcaccaagaacatgaatgggatagcgtacagaatttccagaatacgcatcattacacggtcagtacggccaccgataaaacctgaggccgcgccatacaaagtaccgatcagtactgcaaccaatgcccccatgatgccgaccatcagtgagatacgaccacccacgagcgtgcgcacaaagaggtcgcgaccaagagcatcagtaccaaaccagtgctccgctgaaggtccagcgtgcatggcataccagtccgtatcttcataactgtaagcggaaaacatcggcagaaagacgactgccagggtgattaacatcaaaacaaacaggctgaccatcgcggctttgttacgcataaagcgaatacgcgcgtcttgccacaggctgcgaccttgaatctcaaggttttgtgagaagttttcaatcgccgctaaattttcttttttcgtcaacattatctaagtcctattagtagcgaatcttcggatcgatgtaagcgaggagaatatcgacaatcgcgttaaacagaataaataggaaaccgatcaggatcgttacccccatcaccagagaataatctcggttgaaggcggcgttaacgaagagcttgccaatgccgggcaaaccaaaaatggtctcaataacaaccgaacctgtgataataccgacgaaagcgggtcccatgtaagaaaccacaggcagcagtgcaggttttaacgcatgcttgaccacgatatagccatagctcaaacctttcgcacgtgcggtacgaatgaagttactgttcaaggtttcaatcatcgaaccacgagtaatacgcgcaaatgtcgcgacgtagagcagtgacatacccaaaaccggcaacgccatatactcaaacccaccgtcttgccagccaccggcagggaataaactaaactggatagcgaagatatatatgagtactggcgctaacacgaacgagggcatcaccacccctaacatggcggtcgacatgatggtgtagtctatccacgtattctgcttcagggcggcaatggttccgaccgttacccccatgatcacagtaaacacaaatgcggcgagaccaattttcacggaaacaggcagtgcactggcgataagctcattcaccgtatagtctttgtacttaaacgatgggccaaaatcaccctgaacaatgttggtcaaataggttaaatactgttcagaaacgggtttatctaggccatatttggcattgatgttggccatcacttctggcggcagagggcgttctgaagagaatgggttacctggcgcgtagcgcataagaaagaaagatatagtaatcaacaccaacatcgttggaattgcttcaaatatcctttttgctatgaatttaagcataagctcactctttcaatctgtgacaaggaaatgcaaagaccctgcacgtgaatttcacatgcagcgtctacgttatttatagttttgtccccgacgaatgaagttgcagtcatcactgcaacttcaactcgttaggaatatggctctattattgagctttgatgtaaagatctttggcgtagatcttgtcttccgcgttattcgatgggtagccaccgacggttggagaaacaagacgcgatcttacgtattggtagattggcgcgattggcatatcacgagccaacaacttctctgcatccgcatagagtttttgacgctcttcttcagaagttgacgttttcgctttttcaatcacggcgtcgtattcagcactgtggtactgcggatcgtttgaagtgttgctcgacaacatcagagtcaagaaagaagacgcttcgttgtagtcaccacaccatcccgcacgagtcacatcaaagttgccttgacgacgagtatctaggtaggttttccactcttggttttccagtgcgatatcaacgcccagagaagttttccacatagattggatcgcagttgcaatcttcttgtggttttctgaggtgttgtacagcagagtgaatttcagagggttagatttgttgtaacccgcttcttccagcaatttcttcgcttctgcaatacgctctttctgagtcattttgccgtaagctggcatttctgggctaaatccagcggtgatttccggagtcaggaagtaagccggtttttggccttggcctagaatcgcatcagaaaccacatcacggtcaatcgcgtaagaaagggctttacgtacgcgaacatcgtcaaatggtggctttttgttattgaagccgtagtaataagtacagagttggccttgcacttgaacagattctggatgctcttttttcagacgtttgaagtgctcaagtggcagttcgttcgtgatctgaatttcgcccgataggaaacggttcatctctgccacttggttttcgattggcagataagtcactttattcagaacagtatttttgtcgtcccagtattgagggttacgcttgagctctaaacgctcgttaaccacccacttgtcgagaacgtaagcaccgttaccgacaaagttttcaggtttggtccactgatcaccaaatttttctactgtcgctttgtgaatcggtttcaccgttgtgtgacccatcatcatcacgaagtaaggaacggcagtctccaactcaaaaaccagagtatgatcatcaactgctttcgcgcccagtgttgatttgtctttctctccggcaatgatttctttcgcattcttcatcttggtgtattccatataccaagagtaaggagaagcggttgcaggatcgacagcacgttggaagctgtagacgaaatcgtgtgcagtaacagggtcaccgttagaccatttcgcatctttacgaatatggaaagtaaaggttttgttgtctgtcgtttcccagctttcagcgacacccggaaccacgttaccgttagcgtcttggtttaccagaccttctaacagatcacgaatcacgttggactcaggaacaccttccgttttgtgcggatcaagagacgcgacttcagtaccgttaccacgaaccagctcttgaacaggagcaagtttggtaccagcaggaacattcgctgcaaaagaggtgaatgacgtggtagccaccgctaaaccagcacctaacagcagtgcctgggtgattttgttcttatacatgcataaactccaagttttagtattgcatccatgacttccatgtcaggtattcagaacggctgattgttgtcgtttgtcgtataagttttaaacaaaaacaacttacacctgacagggattgcggcacacattagcaatcattgaattaatttgccataaaaatgtcttaaaaacagactatcctctttggttttctcagacattagtaaaaaacttcaccactcatgattatctctagcggattagagcgtggaagctggcctaaacagacaatgtgccagattatctagtgcgccctcaatgtacagcgcattatgctagataactctgatctatttaacattttgtacacaaaaacaccaactcttaatgacaatgcgctatctcacaacacaaaaacgtgagcaatatcaaacctacgtttcaagcaatcgtttggtataagacgacggattttgagcctccttcaagcctatcaatctgtattgagtaaaaacgtaaattttgctgaacagatagagcaacacttattcatcacttttctttaccagaaaataatcaccaagctgatcaaccattttctatacttaccccattagtattagaaacccaaaggtaactttatgcgctacggttggtttatattcatctggtgtgtttcatcatttacttgggcctcccccctctcttttggcgtcgtcccacaacaatcccctgaagaattagcgaagcgttgggtgccgattctggaaaatctttctgaaacgacaggcttctctattgagtttcataccgcgtcgactattcctgaatttgaacagcgagtgctaaatggcgagtatgatttggtgtacatgaatccttatcactacaccttctttcatcaacagccggggtatgtcgcgctggccaagcaaaaagatcaaaagctacaaggcatcatagtggttgcccaagagaacccgataaagtccatacaagatctcgatggaaaaagtctcgcctttccctctcctgcggcctttgctgccaccatcattcctcaagcgctgttaaaaaaagaagggataaatattgagtctcaatatgtctcctcacacgattccgtttacttgaatgtggcgaatggcttttttgtcgcaggtggtggtattaaacgcacgtttaacaatgccccaaaggccatcaccagccaactcagaatattgtgggaaagccccagctttacgccgcacgctttcgcctatcatccaagattgcactcagatcaggtgtccgctgtgcaaaatgcattagtcaaccttgatcagaccgagaaaggccgtttgcagcttaaggcgattgggttttccggcattgaagccgctcgagacagtgattgggacgacatccgtgaattagatatccaaaccctctctcatctgcttaaggaataagcgatgtcgatacgcttaaagaccatgcttggtgtggcgttgatcgaagctttgttgctgacgattttgatcaccttcaccctaagctatcttgagtccaccaactatgatggattacaaaagcgcgcccaaacgaccattgctctatttgccactatggtgaaaaatccagtactggcttacgatctggccagtatcgattctgccgccacgttaatgatgtccaatcaagacatcgtctatgtcgcggtcgaaaatccccatggaaaactcttaacctttaaaggcaaccgcgatttattcgaggcttaccatacgattaacgatcaagatttttctaaactccaatccatctatcccatcaccgatgttattgaggtgagcggcactctgtttggtaccgtatttatcggctttgatctctcttatctcgagcaacaactcgctcacgcccgtaaatggacactactgattgtgctaggggaaatgggcttagtcgccctgttctcttacttgttggggaatgccttaacccgacgtttaacggaactcaaaaccgcaaccgatcaaatcaccttcggcaatcgtgaagtcctgcttgaaatccaaggtcatgatgaaatcagtcgcgtcgcccactcttttcaacaaatggtgcaatcgctgcgccattcagaagcgaccatgcgagattaccaacatcaacttgagcagtggaatttggagcttgaagataaggttaaccagcgtacggaaaccctactcgcaaaaaatcagcaactggaagagatgaatactaagctcactttaatgaaagataagctggttgaaaccgagaaaatgatttcgattggtacactggctgcaggctttgctcatgagattaacaaccctaatggcgcactgaaaagccacttgcagctactccaacaagactttaatcaacttaaggtgggatttgaacagattgatattctgctaagcggaagtgattttcatggcaagttcacccaaaccaaaaatgcgctttatctcgaagagagtttttcagggattgaggaaagccttagggatgcgctgcactgtgttgaccgaataaaaacgattgtcgataaagttcagcgttgccaagccgaacccgcgctccatgacagcagttgggtttctccactcagcttagtggaacaagccattcaaatttgcggattacgagagtgggtagtctggaaagaacaaaccctctatccaccgttgatttattgctacagcaacgatttcgtgaccgcgttgagtgcgattttaaataacgcctatcaagcttacgcctccgatgacccaatgatccgtatcgaactttcgctgcgtcatgatcatcaacagttagaaattgaggtgcgcgattttggtcgcggtatgagtatcgaagaaaaacagcacgcttttgaccccttctttaccactcatgatgtgggtaaaggcgtaggcctcggtttaaccgaggcctacagcagcatcaaaaaatacgatggcgacatacaactctttagtgaactaagacaaggcacccgagtgttaattactctaccgttagcccccaacaaaccgtaacgacctgacgaatccttatcctgtgtccttatcctatataaacggggatcggcatattcatctcttgttctaactctttgagtttacgtaataaaggctcactcattgcgttgccagccgtcagcattaaattgccgttgggtagatagatatcacgtttgataaccatgcccggacgcacttcgctcaggctgacacacagttccataccctcttcaattcgagtcactgcactcacaatcgtaataaaggcttccacgactttaggatcgtaatagacttcggactgctgacgcagatagccttgcgcacttttggtgtgcatgcgtcttgggttattcgcccccgcaacgaagaagtcataatctttgacgacttttatgatccgcgcaccaatcggaatttgctcaccacgtaaatgatccggcttccctgtaccatcatacagctcatcttgatgacggataatttccatcagcggttcaaagcgcttaattcggcccacaatttctgcacccaaaatcggattcacgttcggggtaatggggatctccgaatcctgatgcaccttgaccactttccagtcattactggtttcagcaatcaggccgatttgatgcataagcccacataaataaacatggctggcaacggcctctgataatttcagtttaagagcgaccgatttggcctgatttgcgatccgctctgcatgatccgcagggaaccccgtacgatgctggataatcgcggtcaccatagccaaaatatctttaaacgttttattgcgtgaagcaagcaaggattctaagcgcttgttactctcttgtaaggcgacggtacgctcttgtactttcgcctccaattcttgattaaattgcgcaagtttatggttattctcagctaatgcctgattcgcaacttccagttctttattgcgttcttccaattcaatagtcaggcgctctttatcccgacttaagcgataaaactcggcggcttttcctacaatgagcttgaggttttcgttgtcccaaggtttgctgatgtaggtatgaatccctcctgcgttaaccgcacgtactgtcgattgaatatccgcatatccggtgagcagcaaacgcaccgtatccggctgcatttctcgcgctttggcaagaaaatctgcaccatccatctctggcatacgcatatccgagatgatgatgtggattgggttttcctgcagatattccaacgcatcagcgccgttatcgaaggtcactacgttgtaatccatccgcaacacacggttaagcgctttcaaaatatcgttttcatcatcaagtaacaggacgtttaacttctcatcgtgcatgttatccatttgcatagcgctcccctattttttatggagatagtttgttatggagatagttcaggacttgttgtggtgaaatagccgggctaactaaataaccttgcaccaggtcacatcccatctcttgtaaaatttgatattgctgatctgagtcgacccattctgcaatcacctgcatagacaaggatttaatgctagaaatcatcgattgtaaaatgaccgtacttgattccgccttgcccaaactttgaatgtatcgcccatcaattttcactacatcaaacggaatttcacacaagtactcataaccagaatatcccgtaccaaaatcatctaacgcgcagcgtattcctaatgattttagcttataaatctcatgtttagcggcatcaaaatccgcaatcaaatcgtgttccgtgatctcaacagagagtcgatgcaacgcatgttgtgcttgcttctcctccgcgacgctcagtaacaaacgataaaaactgccgtcagtgagcatttttcccggaatatttacccctatggtgatgtcttgtaagaccgcatcttccgtcattaaaaaggtcaaaatgtcgcgcaccatgacttcagttaacgtcgggatcaaatggtacttttccaagatcgggaaaaaacgatcgggcatttcatacaatcctttgccaatcactcgtctggctaaggcttcaaacgctacgacgcccccagaatcgatgtgcttttgaggctgatagaaggcacaaaaatggccgagttggaggtcacgataaatattcaatagctgtttaatttccagcgtctcgtccacattgcccaacccaaagatagggaaatgatcaaccaacgcgcttttctcacatggcggattgactaacttcaactcaacatcaggccaagactcaatatcggcaatccaccaatgcggcggctgagcaatatcaaaggccgcattatctgaaggtgctgggttctgaaagctatcaattaacttaaataatgtttgataccaaggcgttaagcggtgagtaacccaaaaccaacgtgctccatcttgatagatgtgctcagtttctggaagttgctggatcacatgttgcgaaatggcttgtttttgcaggtcctccagcggcgccgtccactccatgatcagcacaagataggggtggtcagccagtgactgtaataatgagatctgtttgttgagtgcttgccatgttttgagtccggaaacggtatcaaactcttcacggcgctctttttcactaaaacactgcaagattgtttgcagcagataatttcgctcccaaggcttgagcaaaaatttgtacagatcgccttcattcaaggctcgcgataatccattcatatccgcctgcccagagaggataagcgacataatgtgcggatagcggcgattaatctctatcaccaaatccgcaccattcatgcccggcatccgataatcggaaatcaccatctgtactggatgttgctttaaaagctctaacgcttcttgcgcacaagtggcggtatgtagatgggggaaataaggacgcagctcgcgctttaaggcattcaacaccgcaggttcatcatccactagcagaatttcacggttgctttgcatcagaaggctccttgagcacgcaccgcttgtggcagtgtcacaaagactcgcgttccgaccccttctgtcgaacagagctttattttgccatggtgttcttcgatgatttcacgtgccacggataaccccaagcccgctccgtcaccaacttttttagttgtgaaaaagggatcaaacactttttcaaggtgctctgcactgatccctttgccattgtcttcaatcagcacttgtacgcgtggaatgccttctcccggccaacggacttcacagagctcaagacgcacgaccccttcttgggttgcagagacggattgcaccgcattaataatcaagttgataaacacttgttgcagcttgttgtagctgccacgaatgtaataaggcttttctggtgcgggatacacaaactgagctcggtatttcagatcaccaataatcaaagccagtgccgaactcagtacgtcacgcatatcaatttctgccatattttcatgcgtatgtgagtacacattgaggctcgaaacgatatttttgatccgcgacagtccctctaagctctccatcaagatcgcttcactatcggcgatcatctcatgaagcctagggtcggctatcggttgaatttgtggatgctgccttatctgagcaacgtattcattcaggaaactgaagttactcatcacaaacccaagcgggttattgatttcatgggcgacgccagcggctaacttacctaaagacgccaatttttcttcttgctgaacctgatgcttatcgataacggttttgcgaaattgcagcatggagtaaagcgcacttttggtaacatcaaatagcgcatataactcatcgcgttgtgaatgattaaaaccatccaacatcggctgcataatcagcaggagataatgattttcggcggtgtgaaacttcgcagctaaggcgctctgacagtcaggaaaacagtgtgcgtaatgctctcgccacaccatttccgcttgcacattcggcatgcagtaccactcatcttcaataaatggaggtaatgcggttttgaagcgagtctccactgtcaagccactggtttgaataatacgccagtgctcgtcggattgacgttcaagtaacgcaatctgacacccgggcactaaatcgctgatggtggtcattaaactatcgaacttacgctttggctttacattggaaaacagcaccttgataaaggccaacagagcaaaaggaatatggcaatcattctcttgttctcgcatagctgcgccagaagtgcgtagtttgtctaccataatgcccccatttacatcgctttggcatcggtattgtctaccgcttcggcactgggattcaccggtaaacgaatggtgaattcgctccccttaccgacttcgctggtgacgctgatcgtaccattgtgcttattgataatgccgtaggagacagataaacctaatccggtccccgaaccgacaggttttgtggtaaagaagggttcaaaaatacgctcgcggatctcctccggaataccgcatcccgtgtctcgaatgtgtatttcaacaaagtcgtcccccgcagattgtaaggtaatggtgatcgtcccttcgcctttgatggcatggctggcattcaccaatatgttgagtaacacctgattgatctgcatcggctggcaaaaaacatcgggcacattggccgcgtagtgtttctccaacgtgatgttgtacttgatctcgttattgatgattttcaacgtcgattcgatacagttttctagattggcgtaactccactctgaacggtcaacgtgtgagaactctttgaggttttttacaatcgacatgacgcgtgaagagccttcgagagattcggtaatcaactccgccgtgtcttccaaaataaaatctacttgtccttgtttaaggatcttctgacaagcttcattgagtgccgtgtctttactctgaccaatcgtctgggtaatgcttttcagaactttctctaagctattaaagtagtcgcttaacgtttgtaggttcgaggtaataaagcctactgggttattaatttcatgggcgatccccgcagaaagttgaccaattgaggccattttttccgattgaattaattgcccttgtgcatcttccagtttcttgattaacactttttgggattgatgctcttcttcaagcttttgcgatactcgcttaagttcctgttgctggctcgcttgaatcgtgacgtcatacacacagagacagacatgctctatcgtcccatcttcactgtggatcgggatcacttcgaggttttgatacatctgctcttcttcgcccgacactgggcgagaacttttgaaaggcaaaagatgcggtttctgctcccaactgctgaaactggaggattcaatcaccagcgccgtatcaattttgcgctttaaataatcggcggattcaggaaatagctctaggatgttcttcccttgcatggtttccccatcaaaaatgacacgtgattcaaaatattcattcactttgacgatcacatagtcattacgcacgatacagagcgcaaaagagagttgatccagtagttcagagagcaataaacgactctttgccatactcgtatccttacatcaagagttcgtcgagatgggcaaataccttatctaactctttatcagcaaaacagatgatggttttggcagaaaaagaagccttctcaaccagaaaattgatttccataatcaaagacagacgccattgcaaaattggcaaaggctgatgggtcggatcaaagatgactggtggttgaattttggttttcaattcaatctgttgacatagaccttttaaactcgccccagaaaggatgttggagatatccaaaatgctctcttcaatactgactaatccatccgccatacctttcgaatggttaaggtcattgaccacttgctcacaaccgcaacggctcattaaggtgatcagctctccatccattccgccgtagaaagattgtcgggtgtaataataatcagcggcataagactgcagcgcacgcatatcttcctctgtcgcgacccgaatgttgggaacggagatggtgacgtgcaaattaagcaaggtcgcaagcttactggcggctcgacccatagagatgttcatgaattcctgcaatgcgtctttgtgatctgcggaaagtacaatgctcatagcaaccctgcctcatgaagtgtttgttccagttgcgctggatcgagtggcttttgcaaaaagttcagcgcgcccaactctcgaactcgttgctgaaccaagggttgaatatccgcactaatcacgataactaagcatttcgcatcaatgcggtgaaagtgttccaagacttgtatcccatccatttcaggcatggtgaggtcgagaaacatcacatcagcaaggccattgttatagttctctacggcttcctttccattttgagcctcggttatctctacatcccaaccggcaggaatcgccctaatcacggacttgcgtgacatctttgaatcatcagctaccgttagtcgaatcgccataaactcactcccttaaaattcagtatttcactgactaagctggaaaaaattgagtttccagttccttgagcgcaccttgtattgagtctggtgcttcttgtacaagctgtcggtattcattgatttgcttgcaattttcaattctattcgccagacatgaaagactgcctagctgctctaaatgctcaccgctaaacgaggtcaatctttggttgagaatgatatcccctatatcaatatcgtagccccacataatcagtatgtatgccgatatcacatcacaatcggcatacccaggctgtaagtggtagtaatccaaaaactcttttttacttgcaccatcttcgagcagcagaattttgccaattgaggtcagtaaattcgccacaaaaatccggtcttgatcctgacgcggaaaacccaactctctcaccaatgctctggcaatggagctggatttgaaggcgcaatctgccacccattgatgatcttccgctgagttcacattactgggatgaattgcgagcaaagagatggcgatagactccaccaaaaccgcgcccaaacgcgcaaccgcttcatgcagcgaatcggtattacgccgaaaaccaaagtaggatgagttggcgatttgaatgattttggccaccaatacaggctcatgaactatggtttccgcaatcgcgtccatactgcaatttggcgaagcaatcacttgttgtaacttacgaacggagttaggcaggatcggaatttcctctaacgcccccagtcgcttgcggcattcaatattgaacggcattcgatacagccgttcgacacataagaaaagatgttcaaaatcttcgtgagtaaaaggtttaggaagcacaaattgcgcataggtgtgcgctttacgaggcaattcttgggtcgtatctccggttaacagtacccgcatagtctctggacaacgcgcacgtaattccgtcagcaaggcttcaccatttttccccggcatcagcagatcggaaatcaccacgctaggcgcgtgctctacatccaccacccaatggttagcatcttcaactaactcaatctcccaatcaggtcgcatgcggcgaatcatacgtcctaacgctttgagcataaaatcgtcgtcatcgacgcaaacaactttcatcgcttctactgtcatcgattactcactttttgctgttctagatagatggtgacttgttcaaggacatcgcgacttcgctggcataattcttccacttgccgcacatagtcactatgccactctgggtcggcggccgttttcatctcaagttgaaaacagaattcggacagagcatcactaccaatgaaccttgccgaggatttcatgctgtgtgccaagcgatgcagctcactgacggactgcgttgcaacaatcgtgattaatttcgtcaactgagcttgcgtgttctcttgatagctcaccaacataggctctaccagatcgctgccgaccattttggcgattgtcgaaatgttaaatgcgacactctgctccatctctttttcattccaatgttagggttgcgatataaaccaataccttaacctcagtgtagttcattatcggatatgtaaacggtagcggtgcacacttttagttttaaagttatcgataaactccatactaaggtttatcgttcaaaagcattcttgagtagggatctgggtcaaattttgttagaatgccgcccttcaaaacaccggacaccctttcatcggtgaatggatgatgcgagtaagttatgccgaaccacggagattttttgttgaatacccaacagctttcagcgatgacacctgctgatattgaatgcgcagctcagttacttaagcaaggccaactggttgcgataccgaccgaaaccgtttatggactggcggccgatgccacccaacctgaagcggtgaagcagatttttagtgccaaaggtcgcccagcgaatcatccgttgatcgtccatctcgggtcggcagaacaactctctgaatgggcgaccgatattgcgccagaagcgtatcaacttgccgaagctttttggccggggcctttgacgctcttgctccccaaagccaagcaggtttcacctgttgtgactggcggtttagaatcggtcggcattcgtgttcccgctcatcctgtcttgctggatattttgaagacgcatcgcttagcggtggcggcaccttcggccaacccctacaaaaaactcagcccaacctcagcccagcaggtgcttgatggtttgaatggcagactcgccgcagtcttggatggcggtgaatgccaacacggtttggaatccacgattgtcgatttaaccagcaaaccttttcgtgtactgcgcgcaggcccgataacggccagtgaacttagcgcggtattgggtcaagaagtactgcagccacaagttcatcaagttgcggtgccgggaaatgtcgatagccactatcaaccgaaaacgcgcctacgggtgattgatgacctagcccgtgagcttgccactcaatcggatgagcttcgcatcgcgctacttaatctctctgcgctgcaagccagcgagcagcgtttactcaagccgatgccgcaagaagccaaagcctacggccaagccttgtaccgctctctggccgaagtggataaatggggcgtagatgaaatttggttagagcgtccaccacaaggtgaagcgtggcttgccgtgcatgatcggctgcgtcgcgcagccagctaagccaatacccacgccgagtacagagaagaaaggtcaccatttttgtgagctcacgcagcaaactagacaaccaaactgagatgtctgcagatatcagcttggttttgtcgatgtacatccccattgatgttcacaaagctggtgaaaaaaacgtgcttttcaatcgccctttcaataaagattgatgcaccgcaatgcgccgactcggcagccagattaattaatagcttctgtttcgaagcgccaccgataggatttgtaagatgtctgatgtttctaccaccgtcgattttgccacacaaaccgtacaacctgtagttgagtcaagcggctccatttggggttatgtggtcggcgggatcgtcatcgtgattgctgcgggttattttggttttagaaaaattaacaaacctgcgtttatgatcaagcaactgcgtaaacgtaaccaaaaagagatgaaaaagaatggcgtggaaagtgccgaagccatgaacgacctcgatcttgtgctggatgccgttgaagcgtacgccactgagaaaaaaatgaaaggcacggaaatggtgaaattgcttgcgccactcaatgacgccaccaagattaaatctgccagcgatttctatcatgcgatgtcttacatcgccaaaagcattgataaccaaacgttagcgaaaaatctgctcaacaaatctaagcaagtgaaatcgagctcagcgttgatggcaggccttctaaagcgcgcgggcatttaatctcggtaatccaatccatagttcaagagccacctaaggtggctctttttatttttccggcttatccgtaatggtttgtaaatactgataaggcgtaagccgatactgctgcttaaagcgcgccgaaaatcgagtcaatgattgatacccacaagccaccgcgacctccatcaaaggacgtagctcttgtagcagcgcaagcgcgtagttcatccgcacttcactgagcacttctcgaaaacccgtaccttccgctgccaaatgtcgagccaaggtcgctcgactcatcgcaaaatgcgccgaaaccgtttcaatattgtgttcatcaccgggattaacacttaaataacgcgctaaacgctctcgcattgaggcattatcgcttggaaataggagatgtagcgctttctcatcccgcagctgcgcgtaaaaacccagcacaaactggcgctgtgtctcttcactgagcgattgttggttcatctcgtaaagcagctcaaaacagtaggccagctcagccgtcactctcactctaggttgttcatttcgctcatattgacttgattgagttatccactctacaggtggcgcttcatgtaaggtcaaggtgcgtgaataaaactgcgcctgctgcggtacattcacaaaggtaagatactgattggctggcaacatcagccaatcagcagaatgaaaattgagcgtcgtgtcatgccaccagagctgtttatttccatgtgttacccaaataatggtgggcgcatagatcaagacattatgcagaggctgtttacgcaaacctttaaactgcccagtctgcacgatcactttgctcatttctcttccttattattcattcacataggttgcggttagcgtggcctgctcaagcgcattagcgcgcagcataaaacccactaaagcattagaagccccttgtgggatctccattttttcaaacgggagtgcccaaaccgtaaattgataacggtgcataccgtgaccttgtggagggcacgcaccaccaaagccgctaaagccgtaatcgttgttcagttcacgtacgcctttaagttgcttagctgcgccacgcgccacattatgttgatccgccgcgatatccagtgctacccagtgccaccaaccactgccagtcggtgcatcggggtcataagcggtaatggcaaaacttttggtgcctttcggggcattgttccagctcagttgtggcgacaaattatcaccgctacaaccaaaaccattaaacacaaaatgcttcgccattcgtgaaccttcttgaatgtcttggctagtgagcgtcatgacagggctgctcagcgcaggaaaagtgatcgcggcggcgagtacaggtaaaagatgacgtgctttcattgagattctcctcgttaagttgacgtgaataatttaccttcttcaatcactcaataagcaacaataaaactcaaaaaacactcaagattcgttacttttgagttttatcgttacattcaatcactgtcaacgtgcaaaaaaggctcacggtatagctgttcaacaggtttaaccagtaagaaagcctgacttcgtggcttgtccttgctcgcttagcacgtcattatccctgccttaaatacctcaagctcttgaagcaagaggaaataaataggatatcaatatgttactttctgcatccgctttgctttggctaccgctggccttagcgatcatggcgggcttcgctcgttatcaccgcgttagttggggactactgatcatcactctgctcagtgcattaggaagtggttacctcaccttcgttggcgctggaatcatctgtgttggttttgccctggcgtatctggctgcgaatggtcaatcacactggcgcacgaccgcttgggttgctttgctgctgtggtgtttagcgctatttctccattggctacccggtttttctaacctcaaagtgctggataaagtgatcgccagtgcgcacagtacccctttcagcctttatctgaatttagataaaccgctggtgttttttgctctgttactcgcgtttccagcactactgggtcagtctaaaactgcgaacatcaaggccacactgctgaccttagtgcctttatttgctctcttgccgatcgcggtttggttaggcgcgctggcatttgaatggtcactaccggagtggtggtggatttttgccctcaacaatttgctatttacttgtgtggcagaagaagcgctatttcgtggtttgattcagcaaaaagctcagcagcagtttggcgccattgccggacttttgatcgccagtgcgctgtttggtatggcccattttgcgggtggtccattactaatgatcttcgccgcccttgcggggcttggctatggtttggtgttccattttaccgggcgtctttgggtcagtgttggcgtgcatttcttatttaacttcgctcacttgctgtttttcacctatcccatgctggcgcgttaaacgccttttccatttttcttatccctttttccaagcatagaaaagcccagccaaatggctgggcttatgtttcatgaacggtagttaacttagattttgcacaccgctttccatgatgcatcggcgctggatggtgtactgttcgtccaccagttggcttgccatacagaaccattgtggatcagttggtcaccgcctgccgcgtggtcgccacgtggaaactctgggtacactttcaagccattagggttgatgccggcatcggcacaagattgacccgcaccgccttcgttcccattgccgccatcggtggcaccttcaaacgctggcaatgttgggaagtctttcttcaagccgaccgtttcgttacccacgataaagcgcacgccgttagccacgccagagactggggtgtagtacaccatatcgacgctgtactcaccgcccgcagggatcgtttcggttgagcgcagtgtcacggccactttgtggaacagtttcttctcaccattcaccgagaagttgctgccggtatgaccgctttcaatcactttcagaccagcaccgctccaatctttgacgatatcaccgcttgacgttggcatcaggaactcaatcgtagaaccacccggaatcgccacatttgagtggttggtaaacaccaatttcgggttgattgggtagttgctatcgccttctggccattctgtggtcgataccgtaacgtcaatcaccgagtctggttgtggcagatcgttatgacgaatatccatcggcttcgccgcggcaaacacttcatgggcataagaagtcatgtcagaaccgatcacgtattcgcgtttcaccgcatcatacgagtagtcacccgccatctcccaaatcatcatgccgcctaaaccgttatcgacgatgtaatccagttttggcttcagtgagtctttatcttcaatgctcaggaatacttttttggtgtcgttccaaagccatgccgtttgcagctcttgactccacacacgctcgtatttgccttcaatcaggtgtttcgggttgtttggatccataccccacgctgggccgtaacttggcataccgtcaatacccaatttttcagcgtgcatcaggttcatcgcgtgccacatgggtaccacaccggctttgatttcgttaccgttggcatccacatcatgccagatgttatcggtaccttccgcgccccaaccacaaacagtggtgccttctggacatgacgattggtttggctcaaccgcacgaccccatagacctttatcgccgccgctcacgccttgccagccacgggtgtagtaaggaatccccatgttgatttggcttggtttaaaggcgccacggaagaagtggtgcgtccacgcttggtttaagtagccaatgccttgatattctgcagtcgtgtacacgccccatttggccagctcagcatctttaccatcatcaaacagtgcggcttgtgggccgacaaactcgttccacgtaccatgcaggtcgtaagacatgatgttgacgtaatccagtacatcttgcatcgcgaagtcttgcataccacgcagcaggtaagctgatgaaggtgacgcgatagtcagcatataacgacggccatcttcttcgcccgctttatccagcgctttgcgcagttcggtcatcatcaccatgtagttatcccacaactggccacgacacttgttcgactgctcgaaatcgaccggattaccggaatctttcattgatgatgggtattcgtagtcgatatccacgccatcaaaatcgtattgacggatgaaatcgaccgccgatttgttgaacgccttgatgccttccatgttcactgaacaagaagccagatcggtcgtcattggatagaaaccaccggtttccgcccaaccaccgacagaaatcagcgttttcacatcggggtactgtttcttaaacttgctcagcaggttgaagtgaccttggtatggcagtgaaggatccatctcggcacccggtacattttcccacgtcatcttggtcgcggaatcatccacttgcatgctgaagtcagacttgttgatgctggcgaacgcgtagttaatgtgggtcagtttttcccaaggcagatcgccggcgaggtacgctggcagaccgtttttaccagtacgccatgaggtgtaataaccgatgatacggcgcgggtgatcgtcacccatacactcagtgccatcttcacgatagatctgtttgatgtcacaacttaggttgcccgtgcccatttctttggcgttcactgtcaccattggggtttgcgtttgatgacctgctgcatcgtaagcgatcgcttcgatggtgtattgacccaaagctaccggagtccaagccagttgatatggagcctgagtaacacggccaatcgattcgccattcaccaaaaactcaactgcggtgagatcattattttcgtctgtcgcattcgcagccagtgtggtgactttgcccaagaatacgctttgtccgttacgtggattggtcaactcaatcacaggtgcaacgggtacttctggctcaaccggtggatcaatttcttcggctttgacggtaatacgtaccgcttgctctttcagcaaaccagaagcatcttccacgatggctttgatggagtgagccccctcaccagccgcagtccagctagcttgaaatggcgcttgctcaagcaacgcaatctgctcaccatccaccaagaacgtgacagtttttactgttgtgttggttgcagtaacgttagccacaatcgcaacggtctggccttcaatgaactctgcaccttgaacgggtgaagccagctctagcgaaatttctggttcgcccggctccacttcaccatcggtttccagagcgatcgtgctttgcagcaggctcagctcgagcacaccactgacacctaaggtaagatcaatgcttgcccccggtagcagttgcgtttttacccaactgccttgatcaaagctcagagttaagcgattgctaaacactgaaccttgcgcattgctgctaaagctcatgcttgggtaagaaatgccttgtgctgaccaagaaggtgttgaaagtgaaaggttggtatcaaacgcaatgctcgcatcacgcagttcaactggctgattgccgttgttagtgagcgtcactttgtaggtattccaccactggctttccgtaccaaccacagaagcgtcactattgattgccgcctgcactgcaggcatcgccattcccactgctaatgcaagaacggtcggcattaaagttaatgctgatcttttcattatttcgagacttattttattgaacaaaatttatgtctcattatagaaaagaaactgtttcagtctgtttcaaacggatgtaagcaaatgtaacgacactttcataattttaaacaaactcattgagaacttgaaaataatcagaaagaaataattcataaaatcattgagatcacggttcaataaaattatcgctcgctagaaagaaccataattaagataaatacccaaacaacaaaataggcacaagatcaatgccaaccctttaaattcaatgcacaaaaccttaatcaatacaaatttcagtcacacttaattacatttcaggtcaataatcactcacgccaaataagtcagtcactttatttttgatcataaataaaaaatcagacaatactgatatacaaaaacaacatgtttttataaagatagccgccaagtcattaacccaagagtcagaataaccccacacaataaaaagtcgccaataaacatttccaataaataattatctgtgcattcccgtaaaagcggattggtaaattattgactaggggtacatatcgactacaaaaaatcgaccaagctcattatttcaaattcacttgtgacgtatacgcacgattcggcagccaaaatgagatcagcgtcgtcagcactaaaaatccgaaagagacccacaaacaagctgccagcccccaaagctggaagacccagccggataatatcgtgccgattaagcgccccatcgcattcgccatgtagtagaagccgacatcaagcgatacgccatcatctttggcgtagctgacaatcaggtatgaatgcagtgaagagttcaccgcaaataccgcaccaaacagcatgagtcctccgatgatcaccacttctgggtgccactgtatctgcacaccgtaagcaatcagccccgtgaccaaagacagtgccaatgcccagccaatagcggctcgccctgctggtggatgctccgatttgctgcctgtgattttgggcgcgaatccttgaatgacgccgtagccaatcacccaaagcgccagaaaaccgcccacagcactgtgatcccaaccaaacacgctgcctaaatagataggcagtgcgatgacaaaccacacatcgcgcgcgccaaacagaaatagccgtgccgccgacaggatgttcacactcgccgatttagagaaaatatcggaaaacttcggcttgttcttggccttgccgagatcggatttcaaactcattacgctgccaatgaaaaccaataccaacacagccgccatggcagccactgcgtactggaaaccgatcaaagacaacaacgctccgcccaagaaaaatccagcaccttttaaggcattctttgaccccgtcaggatcgcaatccacttaaacaacgcgccttgtgcattttctggcactagggttttgatggcgcttttggcactcatcttattgagatctttcgcgatgcccgacagggcttgcgcggccattacccaaggaatggtcagccagcttgctggcactgccagcatcaaaagtgcgatgatttgcaagccaagcccgatgttcatggtgcgattcagcccaagccgagccccaagccacccgccaattaagttggtcacgacaccaaaaaattcatagaacagaaatagcgaggcaatagctaagctggaatagcctaaatcatagaaatagagcactaccaacatacgcagcgccccatcagtcagagtaaaattccagtagttgaacgtcacgagcatgtactgacgaacatgggcattcagttgggacaacataaacactctcttaaaaagagccgcttatgcggcccttgatcgggttatggtttgacgatttgatgcacgtactgcacttgcacttctttggtaaatgcacccggccttaatgcttgcacctgagtaatgatgctttccagcggccaacctttttccagcagcagatgcgcggccagtaagccagtacgacccgaacctcccatgcaatgcaaagcgactttttcaccgcggctgagtgcctgatgcaaagcgggtgagcaatgctgccaatcttgcgcaaaggccgcatccggcgcgcaatcatcttcgatcggcgcatgaaaccactgtaatccggctttttcgacttccgctggtagctcaccgacaccatgctgctccatttcctcatggcttagcgccgtgactacggccgaaaccccttgcgctttgagttgggcaatgctttccggcagtggtgtacctttggttcccgggcaaggtgtgagcactaagctcgcctgattgtcagctaccggtaattcccaagttggatgcgtcattttttactactccttatgccaagccgactttacgaaccaattccgcggtgcgcgtggcgtaacccatttcgttgtcataccaagtgtagattttcaccattcgcttaccaaccaccatggtggagagcgcatccacaattgttgaacgttgatcgccttggtaatcaatcgacaccagtggacgctcttcaaaacccagaatgcctttaagctcgttttctgaggcttgttttaacagctgattgatctcttccaccgtcgtatcacgctgcacatcaaaaatgatgtcggttaacgaggcattcgccaacggtacacgtacggcgtgtccatcaatcttgcctttcagatccgggaaaatttcgataatcgctttagcagagccggtggttgtggggatgaggctcataccgcaagcacgtgcacggcgtaaatctttatgcggtgcatccaaaatggtttgcgtattggttaggttatggatggtagtaaaagaggcttgtgcgatacccagtttttcatggattactttcaccactggagcaatacagttagtggtacaagaagcggcagtgacaatgcgatgttgctccggattgaagatgtgatcgttcaccccgaccacgatattggcgatcccctcttctttgacaggcgctgaaacgacgacgcgttttactccttgtgccaaatactggttcaagaattcgcctttacggtgcttacccgtagcctcaatcaccacatcacagcccgaccaatccactgcatcaatcgatttttcttgtgttgtgcgaatgcgtttgccgttgatcaggatagcatccgcttcactgcccacagcatgatgccaacgaccttgtaccgaatcgaactccaaaaggtgcgctaatgttgcagcatcacccgccacatcgttgatctgtacaaactcaatctcaggccaatcaaacgaagctcttaaagccaaacgcccaatacgaccaaatccattaattccgactttaattgccatcttccttttcctttaaactcgtttttatcccttcccaactaagcagccatcgtggctacaacgctaagtcattgagggataactcaacttggttctttacacacagcactgaggacgagaggtcatctcggcgaggcgctgaatatcttgctggtattcttgtttaagacagttggactccaccaacccttggatctgcttgcgcatccatcccggcagttgatcggaaatacgataaaacacccactgcccctgacggatatcgaccaccacgccgctggcacgcagcaacgccaaatggcgggaaattttcggctgactctcattcaaagcttcggtaagttcagccacacaaaccttctcttcccgagcaatcatcagtaagcagcgcacccgcgtttcatcggcgagtaatttgaaaaactggtggggtaacataatcaaactccaatatatatggatatgcagatattttattggagaaaaaatcgatgtcaatcagtgtttgatgtattggataaaaataaatcaacgatgactgcaacatctgtcatcaagaattaataaaaccatgaataaacaatgaggtaagacaaattgtgcttggataaaaaatcattcaggctagaaaaatgagtagaaccgagggtaggaagtagcaatagcttagactaggtcaacttatcccttgaacaaggaagctcacagaattattggggaagaattggatttttagaacgtcagatgggcggagaccccagccacatcccggcacacacatcatccgctgtggctgcttccttccggatctgaccaggttcacgaactagtgttgcgggaggaccagggcccccatcgatttgagtttggattgctccaaagcgggtgcgattattaaacatcgacttaggcaatgcaagcgataatcctgatttacccccacattgctcatcaaccgaacagcatttcaccagtttgattaaacgatgtgtaatccttttaccttgctggcagcctgaaatggcgattgcgtcgattccgccttagcgcgatacatcgcaatatccgcttggtgcatcacctcattgagtgattcggtccgctcacgattcttagcaataccaatcgccacactcacttcaaaactgacatcgcgctctgcatccacaaacataaaacgttcacattgcgcaaccacatgttcaagccgcttagcagaacattcaccgattaaaataaattcatccccaccaatccgatagctgcgcccacgccataccgcttcgatgcgctgagccaactgcttaaggactttgtcacccacttcatgtccatactgatcgttgattgatttaaacgtattcacgtcaagataaaccaagcttaggcgaggcgataacccgcggcggtatcggttatacaaagcgcgacgattgcgcaacttagtaaggttatcggtatgtgatatgccatggaggtaaaacgccaccataaacaaaacgatgaaagccatggcaaaaagccattgagtactgcgctgatatttcttttccgcaagtaatgtggctcgccaatttggctgataatcataggtatgtatgatctgttcggtattgagcattttaattgcccgagagaaaagaggtgccagagttgcaccaagtggatttttagcaaaacctatcgcaatgtcatattggtagaaactgccaatcatggtgtcttctacaatcggtaacatctccgttgactcgcgaagcaagagattaaaattggctctattgagcactatgtagtccacctctttattcagtaaggcttgaactttctcttcctgacttgcgtagctgaacaagatcttgttcggcagcatctgctgtaacagctcttcaaaaaaatcgtctttgatgacgccaatacgttcagccaccaactcagacacattgctatacacatcgtctttatagtgttcacgtttgaccaaaatcgcttgtgggtggtagtagctttcactgaagtaagcgaggtttttacgctgctgagaaaccgttataggagccaaaatatcgatgcttttatcctgtaaatcatcaaacatgctctcccatgtttcttgaccattactgaccaattcgcatttcagcagtagcatctcacaggcctgaaacacaacatcagcactgatcccacgaaccgaaccgtctggctgataaagtgcatattgcgggttgttctctagcttaacacgcaatacacgctgcacgttgagtccgctctcaaccacggattgacgcagagcttgcttacggatgtccaattgatacttttggatcgattcacgcaataaacgttgtacgtgagccgaatgcgcgtatttttcaatcttgcccaatagcgctgagtgtttgcctttaggcgtcacaatagaaacaggctgaatcggtaattggtcgttaaggagttgtacatcaagccctttcagtagcataggtttgagctgattgatcgcatcaaccactccgtctactcggccactttccagcaaagtgagcgcttctaaatgcccttcatactcaacttgctggatatagggatagtgttcttttagtagggtcccgtaggtggttcctttcgggatacccacgaggcgcaactcgggtaaacgtaggccaccataactgtagagataggtgtactcgatgttggttggtcttgaaaaatcaaaacgttgagcacgcaaatcagtgtaagtaatgttggcagcaaaatcggcgttgccagtctctatcgccaccagaatatcgttaaaactggggtagttgacgtattcaatttcaaggttgaagtggtgagcaatcgaatcaaaaagcacacgagtcaccacgtcatccgcttcggtggcgaccttatacgtcgtagatgtagcggctaaactgctggtggaaatcaatagccaacctagccaaaggaagactcggcgtgaaaaagcgttaagtagcatagacgttgaataatggtatgttgtattttttgctgcgcattttatcgtaaatacccccaccccactatcaactttaggtaataaatttcatagagccaccgatgctttattaggctctcatctggctatttgatgcactcaatggactattcgtgcgcttcctctgtgcttttcaatacatagtctgtggtccaagctgtgaccaaaatgcagatccataccacaaagaccggattgggcacttctgtcgcgggtgaaacgactaacgcagcaaaactgacacaaggtaggctccatcccaacaagcttccccagtttaaagaaggggttgctttggggatcaggttttcgcatgcagcaataattccggttatcagtaacgctagggtgaccgcataaaattgctcggccacccagagcggaatcactaaagccaatgcccaccaactgtgagcatgatttggtttccaacctcgagctgcccaccagatcaacatcaccataactatctgcaccacagtcaccataggtgagccttccagtttgcccgccgattgcgttaccatgatgccgacttgcaaagtgagtacaatcaaagcactgactaagatcactccccagttactacgtggagaaaacgccaccatcaacagcggaataagcacccactgactgatagacaacgccaccggttggagtggtaaggttaggccaaagatccccatcgcgagcaacatgacaacgctagaaaatcctgatttaggtaatagccagagagcagggatcagaaatgcgatgatcggaatatcgccctcactcaaacctgccacatacgcagcaacaatggaaaacagaatcgcgatgagaaattgtaaggcagacagtatcatgccaactccctatacctatccttggtaaacttgtttcgggcacttgtattatggaccagtttttacaacagatctttgtcgtgattcaccaaattccggttggtcgggtttcgacttacggcgctatcgccaaaatggccggttatccgggctatgcacgccatgtgggcaaagcgctgggtcatttacctgaggggagtcagttaccttggtttcgagtcatcaacagccaaggcaaaatttcactacaaggggaagattttgtgcgccagcggcaattattgttagccgaagggatagaggtgagtgacaccgggaaaatatcgctacgtaaatatcaatggcagctgtgatggctgccattgtgcaatcagaaaagcttaacggaataacgccttatcgcgagttattcgccatgcacaccaatcagcatcataggtacgtgtttagtcgcttcaggatcggtgatcacaccgtaatgagtatccgtgatgaaacgtagcttaccgtcgacttcgatacgcgcactcacactgtaacggtgactcgctttgatcttgcggctgtcatacgctaggttgaattcaagtggtacttgcataccattagtgatgaagttctgttttgcgataaccgtcgctggcgcatcagccaaggaaacgtcttgtaggtaaactgtcaccaccgcattatccggcaacgcaatgcgttcacggtatgccacactccccgtaatcgattggattttatcttgtgtcttgttggattcattcatttggcagcctacgagtacagaaccaaacaggatagagataacaataagtagaacctttttcatagcgcctcactacacaactgggaaacatcacattagaaaaccagcaaattatatgccaccacggtatttgtgtcattggacagcaggattattgacaaatgtctgactaacatcacaaaatcatcaaactacaaaagagggtcctaagtcatgagtaaaccgttagacgaattattaagtctgctgcaattggagaaactggaagaggggctgtatcgcggtgccagcgaaaatttggggcttcctcaagtctatggcggacaagtgattggccaagccttgtcggcagctcgctacacggtcgagtcagatcgcactgtgcactctttccatagctattttctttaccctggcgatccagaaaaaccgattatttacgatgtagaaaatcttcgtgatggcaaaagcttcagcactcgccgtgttaaagcgatccaaaatggtcggccaattttttatctgactgcgtcctaccatggtgatgcaccgggatttgagcaccaaaaaaccatgcctgtggttccagggccagagaactttgcttccgaatccgaactcgcggcgcagattgcgcatttcttaccagaaaaactgcaaaaagcgttttgtggtgaaaaaccgattgagatgcgtcccgttactgtcatcaaccccttgaagccagaaaaagcggagcctaagcagtatttgtggatccgagccaatggcgatatgcccgatgaccagctcatccatcagtatttgcttggctatgcgtctgactggggctttttagtgaccgccttgcatccacacggtgtttctctgatgacaccaaaattccaagtggcaaccattgaccactctatctggttccaccgtccgtttaagatggatgactggctactgtttgccatcgaaagtcctacggcgagcaatacacgtggtttagtgcgtggtgagatttatgatcgccaaggcaatttggtcgcaacagccgtccaagaaggcgttatgcgctttttaagctgatctcacccttagagcggtaactgagtcgtgtatttaagtgactccatcgcaaaggtggaggtcactttgttcaacccttcgatactattgaccagttttttatagaatcggtcaaaacacggcatatctttgacctgcaccttcatcatgtaatcgtattctcccgccatgcgataaaactccatcacttcgggaaactcttccacggcagtcacaaagcggcagtaccattcatgggagtggttattggtcgtcaccatgacaaaggccgtgaaagagaggtcaagggcttgcgcatcaagcagtgcgactcgctcgcgaatcacgccaccttcttccatttttttcaaacgcttccagcaaggcgttgtggttaaattgaccgcttcggctaattcattgagtgacacggtgcagtcttgttgcaaaatggccaagatttgccgatcaactttgtcgagcaacatacaaattgccttttttagagaaaatttttctacaaaactacaaaagcataggcaaaatggcaaagtttttctctccaagcctagctaaactgattcggtaacctaagggagaaactggattatgtgtaccgaccatcagtggattaacagtgcaattcgtaaaattgaagcagactatcaacgctccgccgacacccatctgattaaactcgatttaccttgcgtctctggcgtcgatatctatctgaaagatgaaagtacccaccccaccggttctctcaaacaccgtctcgcccgttcactgtttttatatgggctgtgtaatggctggattggcccagaaactaccattattgaatcctcatctggcagtactgccgtatcggaagcttactttgctcgcttgcttggcctaccctttattgccgtgatgccaaagtgcaccgcgcgtaaaaaaatcgaacagatccagttctatgggggcaaggcgcatcttgtagatcgctccgatcaaatttacgcagaatctcatcgtctcgcgaaagagctgaaaggccactacatggatcagtttacttacgctgaacgagccaccgactggcgtggtaacagcaacatcgctgacagtatttttagccagatgcagatggaacaacaccccgttccaagctggattgtgatgagcccggggacgggaggcacctcagccactatcggccgctttattcgctaccaacaatacaacaccaaactgtgtgtggttgacccggaaaactcggttttttatgactactaccgcacgcgaaatgccgagctaacccgtgactgcggcagcaaaattgaaggcattggccgcccaagagtcgagccgagctttattcctgatgtggtagatgaaatgcgtgcgatccctgatgccgcgagtgtagcgaccatctactggttggagaaaattcttggccgtaaagcaggcgcctccactggcactaacctgtatggcgcgctgcaactcgcctgcgaaatgaagcgccgcggtgagcaaggttcgattgtcacgctcttgtgcgatagcggtgaacgctaccttgatacctattacaactctgagtgggtcaaaaacaacattggcgatttaagtaaatatctgcacaagttggaaacattctccgcgacaggctgtttggattaagtgcttactccatgcaaaccatcccagcgcaaaaagcgatgatttagggatgaccatgaaaaaacgcgcttagcaaactaagcgcgttttttcattacggcaacgaacagtaaaccaatcaaccttaaaccaagggacgttggcctcgactgatcagtttcagcaacacattgtcggcggcatcaccggccactccggccagtttatcggccagctttttcttttgcgtataacgcagcagaagtacggttttgctcttgcacgcggcaacaatcaaatcatcggacgtttgaatctcatcgaccaaccccagagctttggcctgcgtgccaaaccagtgttcacctgtcgcgactttatcgagatccaacgcgggtcgatgctcacggataaagtctttgaacagttgatgtgtttcttccagctcttgcttgaacttttcacgcgctttatcggtgttttcaccaaacatggttaaggtgcgcttgtattcgcccgccgtgagctgttcaaactcgatatcgttctttttcagcagtttatggaagtttggtaactgagccaccacaccgatagatccgacaatcgcaaatggcgcactgacgattttatcagcgatgcaggccatcatataaccgccgctagctgcaactttatctaccgcaatcgtcagcggtaagccagccgctttaaggcgatccagttgtgatgatgccaaaccataaccatgcaccatgccgccaccagtttccaaacgcagcagcacttcatcacccgcttgtgccaccgccaaaatcgcgctcacctcttcacgcagtgaagcgacttctttcgcatcaatactgccgtgaaaatcaagcacaaacagatgcggatcgcgtttgctttccaattcaccttctttcgccgcttgcttaagcgacttttcacgacttttctgctcagctttttctttcttcttatccgctttatcgcgcgcttttaaaaacgcttcgtcatgcagataagcctctaaacgctcaaccgtctctttatgctgttcggtcagatcggtgatttccaactcccctttggcaccaccactgcgtccgcccaatgattttactatcactagtactgcgaccaatgcgactaccacagtcacaatcttggccaaaaacaggccgtaatctaacaaaaactccaagtgactcatccttcttgaatacgaattggtgtattgtaaccaccttgtcacgaagacttaaagcaaatcctcttccaactcgactaaccttggatttttgacacgcctcagccagagtttgccagcaggaagagctaaaaaataataaggaataagacgtgaattattcagtctcaacagacgctttgaaagagaaagtgattttagtcaccggagcgggtgatggtattggtaagcaagcggcgatcagtttcgcggcgcacggcgcgaccgtgattttacttggccgtaccgtgaaaaagctcgaacaaacctatgatgctattgaagcagcgggttatccgacaccggcgattgttcctttagatatgaaaggcgcaaccaaacaaaattatctggatatggtcgatacaatagaagatcaatttggccgtttggatggcgtattacacaatgccagcttgcttggcgtactcagccccttcgatcaaattggcgaagacagcttcgatgaagtgatgcaagtgaacgtgaaagcacagttccttatgactcaagcgctgctaccgctgctgcacaaatcagccgatgctcgaattgtgtttaccacgtctaccgtaggtcatattggccgtgctttctgggcaacttacgcgatttctaagtttgcgactgaaggtatgatgcaaattctggccgatgaattgagtgaaagcaccattcgagtcaatgcgattaacccgggcggcactcgcaccgcgatgcgcgcgaaagcctacccagcagaggatgcagacaagttaaaaacaccgctcgatattatgccactctatctgtacttgatggctccagaaggccgtgaagtgcacggtcaatgtattgatgcccagccaaagaaataacgcggtttagttttcgctttcacacaaagacaaacgccttgcaagcagcaaggcgtttttgttctctaacatcaccatcgatgagtaaagcgcttaatctcgactcatcagcacaatgtgatcttcccaatcaatcacatccacttcataaacgattttaccgcgcacactttcatcggcggcatgcatggcgtctttcgagccggtcagcaaaggatgccattctggaagtgtttgaccattaccaagcaaacggtaagcgcaggtatcaggcagccagttaaactcttcaatcttgtcgcgagtgagctttaaacactcttcacctgagctaaaacgattggggtaatctttacaagagcaggtgtcgctattgagccagctacacgccacattggtgtagtagatttcatccgtatcttcgtccatgagtttgtgcagacaacatttaccacagccatcgcacagcgattcccactcggcttcggtcatttggtctaacgttttgctttgccagaagggtgtactcattgcagtgtcttacggtttatctatcggggggacgatttatactctttacatcgctaaagtgcaagaaaagcgcaagtgcatcctatcgagctttctgttaggatggccgcccatttttccagcgcaaagagattatgatggattgtcgattaggctgcggcgcttgctgcatagcgccaagcatctcctccccgattccaggcatgccgaatggcaaaccggctggtgtgcgctgtgttcagcttaatgaggataatttgtgccaactatttggccgccctgagcgcccaaaagtgtgtcacgatttcaaagcttgccctgtcgtgtgtggaaaaaccaatcagcaagccttggctaacttaaccgaacttgagcgattaacttaagcataacgtggattccgctacgcgacttcgcctccgaacacagattaaaagacaagtacagataaaagaatgccgctcatcgagcggcattgtaatttttgaggctgagttaaaacagtttgtgacggcccaacagcgaatgggataaggtcgtgccatccaccaactcaagttcgccgcccacgggaacaccatgtgcaatgcggcttgcggtgacttgatgctcacgacacaactcggcaatgtattgcgcggtcgcctcaccttccaccgtcgggttagtggcgaggatcacctcactgatatcaccgcgttgcaagcgataatccagcgtatcgaggccaatatcgctcgggccaataccatccagcggtgataagtgccccatcaacacaaaatagcgaccagaaaattgaccggtagcttctagcgccgcaatatctgctgggctttcaaccacacacaactgaccattttctttacgttttgggttgctacagatgtggcaaacatcctgctcagtaaaagttcggcattcctggcaatggccgatttcgaccatcgcctgactcagtgcctcagccagttgtaaaccacctttacgatcgcgctgtaacagatggaatgccatacgctgcgctgattttgggccaacgcccggcaggcagcgtaatgcttccatcaaatgttccagcatgtgactggtacgcataaattcagctcagattagaatggcattttcatgcccggaggcagttgcattccaccggtgattgaagccattttttctttttgcgtctcttcgatacgacgagcggcatcattgaatgcggcagcaatcaaatcttccagcatctctttgtcgtcttccatcagactttcatcgatgttgacacggcgcacgctgtggctgcccgtgacggtcactttcacaaggccagcaccggactcaccggtcacttccatgtttgcgatctcttcttgcagcttttgcatacgctcttgcatttgttgggcttgcttcatcaggttgcccattccgcctttaccaaacatctttatctctctggttatcgttgaatgtttcacatagtgtgggggtgagacacttaggtttcaaccccagttaaatgggtcgtacgctgtcgctatcgagctgtgcattaaatcgacgctcaataaactgcacgttgggatcagtttgtaaactgtgcagcgcagaagtgagtttctgctggtagagccgttcacgcagctcaaggggggtttctccctcttgtcccacggtaatgttcaatgaacaagcttcaccaagcacatgattcaatgcctgttctaactcttgctgcgctttttcgttgtgcagatgggcatgacttggacgcagcgtcagagaaatctgatcgccttgacgaacaaaagcggaattcagcgccaattgctcaaccattttggcagtctctagccgttgaaccaatgccgaccacgcgtcttgcgcgaccgcttcttcaatcaacttcgctcccatttccggcgttttttcatgctctaacgcttttttcagttgcgttggcgtgacttcactttttaccgcgacttcgataggttgcatcggacgccattgatagatttcctcttcaggctccaactcatcttcatcattgcgttctggcgacacctgcacttgctgtgctctctgcgcaatacgctctagcgccgatgctggagtagcagatgtcgcgtcagacttttttccatccgcgcctttgttttgtacttcttgtcgcttagagcgcagttgatgacgcagccctgctagggctggcatgctggcttgactctgcgtgtcggtattggtgacaacagaggcttctggagcgtttattgagtgtgatgcttctcgctgagtgactggcaccgcgctttctaccactggctgtgctgccatcattggcggtgcgacagggtgaggcatcgcttgcgaggcagattgcgatacgtttgactgagcaacgggttgtggttgcggcgctgcagccgccatttgagaagtcggtgccgcgattgttggagctgtcactgccgtattgggtggcacaatcacactcgccaaggagacgtgagaaggacgaaacgccatcatacgcagcatcaacatttcaatgccaattcgcgccgtgggtgacagtggtaaatcttgtcgacctttgagcgcaatttggtagtaaagctgcacatcttgcggcgctaaggttttggccaacgactcaatacgcgatgcctctggcagcgatttatccaaggtggcaggcaacgcttggtacatagcaattcgatgcagttgagtcgaaagctgttgcagtaatccatcccactctacgccattttgggcaagtgtttcgatgcaatccatgactgcttgtggcgtttgcaggctgatggcttgcaagagatgtagagaatgatccgtatctaatgtgccgagcatgtgcgcgacgatgtcacttttcactacgccattgcccaaagcaatcgcttgatcggtcaagctaagagcatcgcgcatactgccatccgcagcgtgggcgagcagattgagtgctttgctgtcgctcgaaatctgttcggcgtgcagcactttatcgagctgctgctggatattttctacactgatcggtttgagatggaactgcaaacagcgagacaagatggtcacaggcagcttttgtggatcagtggttgccagcaaaaacttcacatactcaggcggctcttcaagcgttttcagtagcgcattgaagctgtgacgcgagagcatatgaacttcatcgatcaggtaaactttgaagcgtccacgcgcaggtttgtactgcacgttgtcgagtagctcgcgcgtatcttccactttggtgcgtgatgcagcgtcaatctcgagcagatccacaaagcgtccctgatcaatttcttgacaggttgcacactggccgcaaggcgtagccgttatgcccgtctcgcagttgagccccttcgcaaacaaacgacctatggtggtcttacccacgcctcgagtgccactaaacaagtacgcatggtgcaaacggttttgcgccaaagcgttctctaaagcggttaaaacatgggattgtccgaccacttcgctaaatcgtgtcggacgccatttgcgtgctaaagcaagataactcattccaatatccgttgtcggttagtgaccttcaaattcacagatgctgtaaacctgcaagcctaacccttcaaggcgcttatcaccaccaatttctggcaagttgatcacgaaggcagcgtgctcgacttctccacccaattgacggataagcttagtggtcgcttcaatcgtaccaccggtcgccagcaggtcatccaccaccagtactttgtcgcccggtttgatcgcatccacatgaatttcgagcgtatcagtaccgtattccagctcataagattgagcgacggtttgacgcggcaatttacccggcttacgcacaggcacaaagccgacacccagttctagtgccagaggagcaccaaacaagaaaccacgcgcttctgtgcccacaaccttggtaaaacccatgtctttgtacttttcaaccagaagttgaatggtcgcttggtaggcttgggcatcttccagcaagctggtcacatcacgaaacagaatgccttttttcgggtagtcaggaatacttttgatgctggatttgatcagtgaaagagtttcagttgtcatagttactttaacttcagttgcttcatcaccttaggtgatgacagaacaatttcggagccgtctgccacaagggaacgacagcactgaaaaaacaaagcccactcgaagagtgggcacacttcccgctaatgctagtgattttcttgttggttagcaaccagctcatgggttggtaaacggataaaccaagtgatcaaaagcacaagccagataaacagcgcaaccttgagccacagccaaggaaccatccagatcgaaaaggcaaaactcagcacgataaagagtgtggcgcgctttttcaccgctttactgaccgcgccatgttgttgccagttttgaatcatagggccaaatgtcgcgtgttgattcaaccagcgatagaaccgaggactgctgcgtaaaaaacaagcactagacagtaagataaagggtgtggtgggcagaagaggaagaaatatgcccagtatccctaggcatagactggttattccaataacactgaacaaaaaacgtggtaaggatgaacgcattaaaatccagcgtacccgttaaatacacgaatccaagtcagtgttgcaggcagagtcgggattagcaggactgcaaccacgcctagaaagtaatagatattgaagggttctttgaactcttggtttgccattgtaattttctcttttgggtgactttaaactgggcaactctaaggtagcctcattaattttgtggtcggaactataacgaaagcgagctgcaacaaacactgacaatgtataaggttattagcagctcgatgcaaagttacaatcacactcacactttaggcggaaaaatcacccctcacaaccttgatagagatccaaagtaaaactgtaggcactgggtttacttaaactgatttgacaagcagcacgaatcggcaaatctttggtgatgaaattgcgcaggctattatcacctagctgaacaccagaagtaatccgattgtgtacgtagccgtttgaccactggcaatcaagccccgcgggtaatagtgacaaagtaccatcagcaagatcagccaccccaaacagggcagaaactttaccaatacactcagaacaatggattccccgttcgatgatttcggcaagatcttttagctcgacactaaagttacgcagatttcgcaaataatcatggaacaaggcgcgcaccagcaatgtagaagctgccccacactcacgatggctcgcggcatcaaccacatagaacacaaattgaccgttcataagccaagcgtagtcaaaaaccagtggcatcaattcggcggactgtagtaatcgatagctgcatttccagctcccgagctgagaatccttttctggtaatagtgcttcgagcaattctttggcagcattggggttgtctttcaaatattgtaaatgccaatgcaactcttgctcttcagggatactcccttggcgatcagcaccataccaacaacttgcaaaatctcgttgatgatcatcattcgccaacactttttctattgcgctcgcaagatgtgaatgattggtgatcggtttgggtagaaaatctttaatcccaaagcgcagcgctttagccacatcggccatttcttcggtggccgaaacaacaaccagaggcaaagaaggataggacgaactgacctcctcaacgaactcaattccgttaagcacaggcatggacaaatcacacagaatcaagtctggctcgtgatcacgcaattttcgcaaaccatccaaaccgttttcagcttcgatcacttgatagccatatttttgaagatagcctttggtcattcgtcggaaaacaggatcgtcatccaccagcaaaatcagctttgctgccgttatctgcgcttcttcttcgcagtcttccgggatgtgagatttatacataaacatcgacctcactagtaaagtctaccgcacaagtcaccattagcttgcggcggaaaagttgaattattgattaattaaaaagtagccgcgaactgggcattacacaaaccgtggggcctgaaatttaatcaatcacaagatgtatggttttcaataaatcatcttacaagttgacatcacgcaaaatttatcggcttatatgtgtataaattagcgatagttgcaacataatgtgtcagaaacgatgaaactagatgacctaaacctctttcgactggttgtcgaaaatggaagctatacctcaacttcaaaaaaaaccatgatccctgtggcaacgatcacaagacggatccaagccttggaggactccctaaaccttaggttactcaatcgtcacgctcgtaaactgactctgaccgaagcgggcgaacgtttctacaaagattgctctcccctgctggagcgtctcgcttcaatgacagaagagatcaccgatgaatgtcgtggtgcgtcggggcgcattcgtatttctgcaccatccaatctgacaaaacgaatgatgatgccgatgttcaatgcctttatggaaaaatatcccgatattcatattgagctgatgatgagtaaccaagccgacgatctcgaccccactgaatgggatgtgattttccgagttggcccacagcgtgattccagcttgatagctcgtaaaatcggtgaagtgaaagacattttggttgccagccctcaatacttgtcgagtcatccgcaaccgactcatgctgaagagttgcatcaacatcagttgctcaaaggttatccattgctcaaatggcaactgaccaacagccaaggtgaaactgtcgtcaacagtgatcgcggccgttttcaagccagcgcactgaatgttgttcgcagcgcatgttcagaaggtttaggcattacgctcatgcccgatgtgatgctgcgtgaatttcttgaggatggcagtttggtacaagtactgtcggattggagctcaaacccgcgggatatctacatgctgtataaccacaaagatcaccagccggaaaaagtgcgcctgtttattgattttgtgattggctaccacctgcaataaacactcgtctttttataaagcatttcaatagaaaaagggcttcgcgccctttttcttactgttgtacgtacccaatatttagagatactccacatacttgctaagctcacgttcgggcactttagctgccgtagtcccgggagtcccaagatagagaaaaccgacaatgtgatcttcgccttgtacattgaaagcacgacggacaaccggatggaacatccagcttccagagcgccaaattccctgaaacccttgtgctatggccgccatttgcatggcttgtactgcacaaccggcggatagatgctgctcaaacgcagggatcttttcactgtgagtgactttagcgatcactgtgatcaccatgggggcgcgaaaaggcgcatttttcgctttactgatcaccgcttcatcactgccgttggcaatctccgcttgctctaaaatggcggcaagtttggctaacccttcaccttgtgcaaccacaaaacgccatggagtcaaagcaccatgatctggagcgcgcaaacccgcgcgcagaatattatccaatgcctcattttgtggtgctggcgcatccaatttggcaattgaacgacggttgagcaataaatcgagcgcttccattttgattccttgttacttcttgattttatgtttcatcctagcacagatttttgagaatcactcgcaataagaaagaggcactcggcctctttctattcgtgataaggggatagtctcaccggatactaggggtagaacttctcgcccaatcccgctctcgtcaacaaaccgtcacatggagcaaaccgctctccatatttctcggtgtgttggttcatcatttccaccactttggttaaaccaagcgtgtccatgtaacggaaaggcccacctaagaacggcgggaaaccgatgccaaaaatcgcgcccatatcgccatcacgtgcactgcgaataatgccttcatcgagacaacgaaccgcctcattgagcataggcaacaagcaacgcatcgcgatttctttgtcgtttagcttagattccggggttaacttcagcagtttataaacggatttatcgacttctttcttcttgctgcctttgtaggtgtagaaacctttaccgcttttccggcctttacggttatctttcaacagcacatcaaacacgtccggtccttggaaacgcggcccaagctctttaaccaaaatcggcatgatcttggctccgatatcgacccctacttcatcaagcaaggtgataggccccactgggaaaccaaaatccagtaacgcagcatcgagtttttcgataggttcacccgccatcagcacttgcgcggcttcattcatataaggcgctaaaatgcggttgacataaaaaccggcacagtctttaacaacaatcggtgttttgccctgcttacgtgccaatgtcaccacggtcgcaatggtttcatccgaggtggtcgcgtgaggaatcacttccaccaacggcattttttcaactgggctgaaataatgtaaacccacaatattttgcggacgctgcgcttggctcgcgatctgatggatcggcagcgaggatgtgttggtcgcaaaaatcgttgtcggtttggcattcgcttcaatatccgccaccatttgttgcttaagtttcaggtcttcaaacacagcctctatcactacatcacagcgatcaaaacccacaaagccagtcccacccgagagctgcgacatctgcgcttgcaactgtgctttagtcaaaatcttgcgctgtctctgcttatcaaacagcttgtagttgtaattgagggcattgagcacaccatcattcgccacatctttgatgcgcaccgatgttttggctttcgccacagtaacgtgactgatgccagcccccatcaaaccaccaccgagcacgcccacagccgccacaggtgcgggtttggcatccgcaccgagatcttttttcatctctgtggtcgcaaagaaaatggagcgcagtgctttcgattctcgggtcatcaccagttcagcgaaacgcttggcttcatattccaagccggcatgcatccctttttctaggccatattgaatgacctctaaaatggcttgcgctgcggggtagttgccacgggttttctgctgcgttttcttggccgcttggtcaaaaatcaacttacgccccaagtcggtattggcgagcagtttttctttgatcggtagcgtaacttgagcgcgctttttgtgccctttttcttctagaagacgtttggccacatccaacagtactgagtgcggaacacatgcatcaaccacacccaattttttggcctttttggcacgcaattgtttgcccgttaagatgaggtccagcgcaggcagtaaaccaatcaaacgtggtaaacgctgcgtaccaccagagcccggaagcaaacctaacatcacttctggtaagcctagacgtgttacctcatcttcagtacagacacgataatcacacgccagagccaattctaaaccaccgcctaagcaagggccgtgaatcgccgcgaccacagggaaaggcaaatcggcaagctgctggaacatctgttgcccctgcgaggctaacgcttgtgcttcatgtaccgattggcaagcttccagcatgcggacatccgcgcccgcaataaagttatccggcttaagagagtggataatcagccctttgatctgtcctcgcttttcattgagcgttgcaaaaacggcttgcatctcttctgcaaatgccgcttgcagggtattcattttttcgcccgggacatcaatcgccagccaagcgtaatgctgctcatcaaacgagagctgaaatgcattgttgttatccattattccacctccagaatcatagcagcgcctaagccacccgcagcacaagccgtatttaaggctaaaccaccgccacggcgttttaattcacgcaaagtttgagtgatcatacgcgcacctgtcgccgcgaatgggtgaccataagccagtgagccacccagcacgttaaatttactcatgtccacttcaccaatcgcttgtgcgcgacctagctgctcttgagcaaacttgtcactggcgaacatcttcaagttcgctaaggtttgcgcggcaaaggcttcgtgcatatcaatcaaggtgagatcatttaaggtgatgcctgcgcgatccaaggctatcggagtggcgtaagaaggccccatcagcatatctttttctacgccaatcgcggcaaacgcataagagcggatataccccatgatctcaagaccaagctctttcgctttaccttcacgcatcaacataatcgcggcggcgccatccgtcagtggggttgagtttgctgcggtcaccgaaccgtattgacggtcaaaggcaggacgcaactttgcatagctctctagcttggagtccatgcgaatgttgttatccatatccagccattttttgtatggctcaggaaaagccgtcatcacttcatcgcgaattttgccctctgcccatgcttgagccgctaaagtatgtgaacgatgtgctaacgcatcttgctcagcgcgagagatcgcatagcttttggccatttgctcagcagtttgccccatcgacagacccgttgaatattccgcgaccgcaggaggtacgggcatcaagtctttaaaagagaggttactaagcagtttaagtttctgcccgaccgtcttagttttactcaaggctaataaagaagccgccagttttttagaaacaccaatcggcagaacagaagaagaatccgcaccacctgcaataccaatatctatgctgccagccatgatactttcggccacattgacggcggcttgaaaactggtggcgcaagcgcgagtaacgctgtaggcatccgtgttaatcgacattccggtaccgagtacaatttctcgagcaatattcggcgcttctggcatctgtaccacttggccaaacaccacttgctcaattaatttaggatcgatagcggtgcgcgccatcatctcttgtactaccattttgccgagatcgactgcgggtacttgaccaaactcggtgctttgacgcgcaaacggcgtacgtagcccggccacaatcgccactcgttctccagaacgagtcctgacttcctgtttgcccatgatttctccttcgaataagaggtctgacctggcgcattgtaacgagaatgttaaacaaatcaaacagccgtttaaataatcgtgatttaaacaatcctttcgagatgaaaaacactgacaaaccggtgttggtaggattttttgcaaaaaaaaaccacacagaactgtgtggtcggaatgggtaaagcaattaacttacgccaattgaaaaatcagtttcctgattaggagaaagtaaagtcagccttcaaaaggaagtgtcatctttgctcaacaatgtcagtcgtaatgactaacgagatgacaggagctactataacggcttcagagtatgagattttgaattagatcaagtttaatgcgattaaacgacttgttgagatagagagccataacgcgctgaagcttcataagtcgtgaactccttcgcataatttctgtcctatcaccatcttcgagtcaaaccgcatagcgcaacaggagtttggcaaaatgaattggaataacacgacgcatacagggagtccttggtgtcgatattgaatctgtttggaaagaaagtttcccaacgtccggtcaataatgacatggacagacaaagaaaatacgaagcactggtgcgagcttatcatcgcgacctttaccgatacgcctattggttgtgtaaagatcgctcgattgccgaagacttagtgcaagaaacctgcttgagagcgtggaaatcgctcgatagcctgctggatgaaaaagcagccaaagcttggctaattacgattttgcgcagagaaaatgctcgccgctttgaacgtaaacagtttgacttagtcgatatcgacgatcacgactacgaagccaaatatagcgatgatgagcaccatcaaaatgagtggctgcaaaggcaaattttgaagttagatgtcgaatatcgcgagctcctctttttacaagtagtgggcggattcagtggtgaggagatcgcagacatcctttcactgaataaaaatacggtgatgacccgtttgtttagagcacgtaaccaacttaaagagatgatggatggttcagaacactacccggagcagcaaaatggatgaactggaatttcgccgcaaagtcatgtctgatcctaaacagcgcgataacgacacactggatatgatgacctcaagtgaggctaacgctaagtttgtcgatgatgtacttcagctcgataagcagatcgctcaggccttcaaagtcgatgtgccggatgatttggccgataaaattttattcaaacaaacgactttagtggaagatgagaaagtcatccgcccgcagtttgttcgaaaagccatggcgatcgcggcatcggttgcctttactgctgggctgcttgttggacaaatccagtggggcaaccttttgatctctcccgcgcaagccagcctgtctgacatggcggtgcaacatgtcatccatgaagaagggttcgtcaaccgattggatgaacaagcggacatgcagcaaatcaatgccaagatgcggccttttgcctacaaaatggaaggcgattttccttatcacgtctattacctcaaccattgtggttttggtaaagacaatgccgtacatatggtatttcaaggtgaaaaaggcaaagtaactctgttctttacgcccatccacagcgcacaaagcagcctattcaagcaagaagggatggcaggcatcattgaacccgtcggaaatgccagtttgatcttggtcggcgagaaggatgaaaacctgaccaacattgccaataagctcatgcccatgatccaatcatccatctgatttttgcatactcaacatgacactgacgcattgttgtgaatagttaaaatagagcgaaaactctaagttttagagttttcgcctaaattcctgccaaatagccatcatttcagtaattttctcgctcaattagacaatggtcggatttctatctcctatactagcgtctaggatcagccaccactgagcaattgctcaaataaagcaaaagctcatacaacaacgcccataagaggcgaaaccaaaaaggaaaagtctaatgaacaacatgcgtctgtttaaaaaatctctgcttgccgtgacggtaacgctagccacacaacaagcgtttgcagcaggtttccagctcaacgcacaatctgctaccggcctaggtcgcgcttttgcgggtgatgccgttatcgccgataacgcagccgtaatgtctcgcaacccagcggcgatggcactgtttgatgagatggcgctctctcttggttttgaaaccattaccaccatgattgacgttaaaaatgtctcttatcgaggtgttctcggtaactcagtttctgttcaagacacggatgacgtaggtggtacttccgttgcacctaatattcatttgatcgttccagtcaatgaacagtttgcttggggggttaatgcttattcaaactttggtacaaaaactgagttttctgattcttatccagcctctgaatacggtggcttaacagacgttaaaagctttaacttaggcctagcaggttcttatcgcgtcaacaaagaatggagttttggtgctggtttagacctgatttatgggcaaggcaccatgaaacgtattgccggaaccagtttcccagcaagtacaattgtggtgaacccgacgaccgttatcccagctcgaggcacatcactactcaacgtcgataaagcggatggttgggcagtaggttttaacttgggtacagtttacgaaatggatgagaataaccgctttggtttgtcttaccgctatagcccagaatttaaagctaaagacgattacggacaagagatcacgctaccactaccggatatcgctgagttctctggcttccacaaaattgagaatactcagtttgccgtacactatagcgtacagtggattggctggagtgctttcgacaaaattgagttccgcaaccttgtaacgtctcgctcttctgttggcgctctaaccaaaggcagctacgataagatgtatgagtggcaagatggctggcactactctatcggtggcacatactacttaaatagtgattggacactgcgtgcaggctatatgtacgatactagcgcacaagattcacgtacttctatctctgttcctgattcagatcgccagtggttatcagcaggctttacctataacatcgatgacaaatcaaacgtagactttggatttacttacttaatgggtaaagatgtcgcagtttccgaaaatgatgcgggttctaagctaaccgcaacaacccacgcagacgcaatcctgttgggcttacaatacagccgtacgttttaattaaaacgtcacaacatatcattactaaggggctgatttatcagcccctttcttttgctgactgcctagttttgcttaatgtcagcgtacaagcgtgcgattaaatacctcaatatcactacatctgtacgctgaacctttaataacctttgtttaataaatagaaacatcatctataaaacatccattttacaggctaaaacttcaaatcctgcactttcattgatttgaagttttaaagcaattgatctagccgtagacttgccgcaacaaaaaccagcaaatttcagcgaacaatcccaatgaaaaccaataagactctcctctcctgtgctgtggctttcggtttagccagcgtttctacctttactcaagcggcaggtttccagcttgctgaatattcagcaacgggtcttggccgtgcttacgccggtgaagccgcgatggcagacaatgccagcgcacaatggcgcaaccctgcaatgctgacctatttagaaggcactcaagtttctgccggcgcaatttacgtgaatccaaacgtggatgttgagggtacagtaaaccacgcacaactaggtaaaactcacgcatcttcaaacgattttgcccacgatgcagtgattccgaatttctatctgtcacaccagttaaacgaacaaatggcactgggttttgctcttggtactaactacggtatggaaaccgatctgggtactgagtttgcagcctctcactttggcaaccaagcgagcgtgatcagcaaagaagcgaacctcaatattgcttaccaaatcttgcctcaattgagcattggtggtggtgtgcgttatgtgatgggtgaaggtcatttcggtgcaactgcgccagcaaaaaatctgattcgtcatcctgttactaacaacgtcatgactttacctaaaggtacaaccttaaaatatatggaaggtgaagataactcttggggttggcaagtaggcagtgcatggcaaatcaatcaagatcaccgcgtaggtttcgcctataaatcggaagtggtgatggattttgaaggccatgcagaaggagtcagttacggtagttataaacctggcatgatgtctgtgactctaccagcgacggctgaactggcaagcttccaccaactcaatgaccaatgggcgattcacgctagcattaactggacagattggagttcattcaaagagttgacggctgtgttcccagaaaaatctgacctcatcaaatcagaaaactgggaagacaactaccgctttgctttgggcacaacgtatcaatacgatgctaaactcgctctgcgtgcgggcgtcgcatacgacacatcagcggtagacgataaaaaccgcacagcaaccatcccggaaacagaccgtacttgggtaagtgtcggcggtagttatgttgctacgccacaactgactctcgatgccggttttacctatatctttgcgaaagatgccaccatcaacgaacctcgtgacgcttcagaccaaactgcagccgcaatcggtggtgcatttacaggtaatgtatcaggcaatgtatggctgatcggtgttcaagcgaactaccgcttctaaggtcattccactttagcaaggccagcttaacgctggccttgctgttttagtttcagtaaaaactgctctgctgcgtcttcaaccaaatcgagcaccagctcaaaaccgcgttcaccaccatagtaagggtccggaatttcttggtattccgagtcactgtggctgagcatcaatgacagcttatgttgatgggattgagggcagcgagctttcagctcagctaaattctctttgtcggccgctaaaatccaatcaaatttcacaaaatcttcatcgcggatctttcgcgctttgatgccagaaaatgagtatccccgcttctctcctgccgcttttgagcgtgcatccggtggattcccttggtgatacccaatcgtgcctgctgaatcgatttccacatcaaccttgagttgtgccgccttagcacgcaataccgcttctgcggtcggagaacggcaaatattgcccatgcacaccacgagtaccttctgcatcttatatccctatttttgtttggtgtttgccactgacgagttgggctatcatagcgacaagtttcagattgaaaaaggatttgccatgtccggcgatgaaatcaaacaagagcgtcacaaagctcgtcaacaaaaagtcaaagagcaagtggatgccaaaattgccgccgctcaagaagaaaaagggttgctgctgattattactggcaatggtaaaggaaaatcgacctcaggttttggcaccattgcgcgcgcggtaggtcacggtaaacagtgtgcggtggtccagtttatcaaaggcacttgggagaatggcgagcgtaatcttttagaaaagctcggcgttgaatttcaagtcatgtcgactggctttacttgggaaacccagaaccgcgacagcgataccgcagcggcacaagaagtatggcaacactgcaaacgtatgttgcaggatgaatcgctggatgtggtgctgtttgatgagctcacttacatggtgagctacggttacatcgagttggatgaagtggtcgaagcactcaatcagcgtccgaaaatgcaatcggtgatcatcacggggcgcggcgcacaccgcactttgattgagatggccgatacggtttctgaagtgaaaaacatcaagcacgctttcgaatccggcgtgaaagcccttaaaggggtcgattggtaaaacacttaaaaaaaatcaataagaaagggctgaaattcagccctttttagttcattagcgatgcataaccatcagttaaatagacctttcaacaacccatccaccgcttttttggtgtcttcatctttgattttatcggtcagtttttccacgccgcgatccacttctttcttggctttttgtttgagtacatcatcaaataccaaacggaacttcggatcactccacgcacctgaaatattgatcgggatagtcacatcgcgcagctcatctaaactcttaccgccctgaccttccaaggttccaacaatcgaagtacgcaccagaaaatcaacattttgctgtaggtaattggctttaccttcaccatgaatgcgcaacaatggcgattgcatattaagatcgttggtcgttacttcacctttattgagtttcagcgtcgtcgtcatcgcactaaagtcggttttctttaccgcatccgcttcttcgacattttggcctttgattttggcgtagtgggtacgaatcaagtgcgccacgttaatgcccttcaccgcaccatcggcaaagttaatcgccacagtaccgaccagatttttctggatgccgcttggtgttaggctctggccttgcacattcacatcaatattgcctgtgccttctagcatttcgttgttcagcacatcttttagtaaaggcttaacctgaacccctttgatctgcttcttcacactgtaagtcgcgggcgttttacgcgcatccacttgcgcgctagcttgcacggatccttgatacagattcgcggtgaaggatttcaaatccaccacgccacgattgaccgcaaaattcgcttttacattttgtagatgggcgttgctggctttgaatttatcaatgctgatctcaccggccacatccaaggctttgagtgccgacaagtccggttccacttctgctggggcatttgtcgcgggtgctgacgatgaggatgcagccgcttccttggctggcgcaggttgcgactcttgagctttcgtgcctaagaaggcatccaagtcaatctcagggctgtgcaagttgaaacgcactttcggaatatctgcgagggtgacatccgctttgccatcgaaactcagagcattggccgtcagtttgttgagcagcacactaagatggttttgtgtcaaatcgaaagcaatttgcgagtctaaacttaacttcatcggtgattgcggtaacgcagccccttccagttcggcttgcagtttcagcgcatccaaaccaactttgctgatcgcttgattgaccatcagtgatgcagaaccttgcgcattaagcttcatatctgccgctttacccgccacggagaaggtcaaagcattggctttatcaaactcaaaagtatcgagtttcagtttggctgaatcgatttggttactcggatcactaaagctcgcatcgagattaatgttgcgcagcgcatactgcttgaaatccgccgataggcgcacttcagcttcaccttgcgcggcaaacttctgctgatctttatcgcctttcgcggcaaaggtcgctttcgtccagttgtctggcacaaactcggcaacactcaattgaacgtcatacagcttggtatgcgaacccgcttttttatccgttatttccaacaccgcattggagacagaaacgccccctaattcaatactccacgccgcggctggctcgcttgagcttggctgagaagcaggtgcagagtcagttgtcgctggcgcggacgcgggtttagattgcgcttgcgtcaaggcatccaaattggagcgaccatctttaagcgtttccagatggaattctgcgccatccaaacggatgttgccgattttgagctgtttatcgagcagtggcatcactgagacatcaatacccacactctcaactttaaacaggtttgggctagcaaaaccttgcgggtttttcagctcggttttgcctaattcaaagccgatagatgggaaaaattgccagccaatatcgccttcaatcaccaaatctaagccagtttgttttttggcttgctctacgattaaaggtttaaattggttggggttaaccaacaacactaaggccagcagtgcgccaacaatcagcacaactaaaccgagaagagaaataaacagttttttcatctgcttttccttgcttgacgagaaaaagaaagtggcacttaaagtgccacttctactttgaaaaataaagctaagcgatgcaaagctctggtcaaaattacgatttgagcaattttgcgatatgcgctttgagaacatcaatcgcgatacggtttttaccaccacgcggcacaatgatgtctgcgtactgtttagacggctcaataaattgcataaacatagggcgcaccgtctcttggtactgcttcagtacagattccatggtgcgaccacgctcttgaacatcacgcttcacacggcgcagcaagcagatatccagcggcgtatccataaatacggtcgcgtgcatcaaatcacgtagacgtgggtcagtcagaagcaggatgccttccagaatgatcactttcttcggcgtcatggtggtggtttgctcggtacgcgtgtgctcagtgtagctgtattctggcacttcaaccgcttcgccacgcgccagcatttgcaaatgttggcaaaggagatcgtggtctagcgcacttgggtggtcgtagttggttttaacacgttcttccatgctcagatggctctgatctttgtagtagcaatcttccgtaatcacaccgatttgatggtcacccactttggcgcgtagctcattataaatcgtgctcgcaatgagactcttaccagaagcagaagcgccagcaataccgacgatgacacattgattattctcagacatggttatgcacccgaacatggttgtgaggaatgaaggtaaaccgcctgattatagggagaatgtgaccgagataccagtttgcattaggcaaaaacagccacataaatgtcggatggataagattaaaccagagcaaacgattacattcactctggctgttagagcaggatgctactttaattaacccactggatttgaatgctctccggtttggctttgccttgccaaaacagcgaagcacacacacgctgcgccaacgctaaatagcgttcggtatgctcgctattgggacgcgccaccacagtcggaactcccgcatcaatatcctctcgcatgtcaatatgcagcggaatttgtgccagcagggataagccaaattcagcggcaagagtttgcgctccgcccacgccgaaaatatgctctttttcgccgcaatgactacagatgtggtaactcatgttttccaccagcccaatcacgggcacgtccactttggcaaacatcgccgcgcctttgcgggcatcggctaaggctaaatcttgcggtgtggtcacaattactgcgccggtcaccggaatttgctgcgcgagggtgagttggatatcccccgtgcccggcggcatatcgatcaccagataatccagatccggccactcggtttcattgagtaactgtgccagcgccttagaagccattggtccacgccaaatcgccgcatccgcctcatccaccaaataaccaatcgaatgcgtggcaatgccgtgcgcctcaattggctgcatccatttattgtcacgcactactggtttagctttagttttaccgagcatcagcggtactgaagggccgtaaatatcggcatccaatagaccgactttgcctcctgacttcgcaatcgcgagtgcaagattcacagccgtcgtggatttacccacgccacctttgcctgacgtcaccgcaataatgtttttcacccctttgactgccgcacttacgcgagtttccagcgcttgaggttttacttgaatgtcaaacgtcactggcgcaacggctccactggcttgctgtttggcaatccaatcacttaattcagccagcagtgaatgggcagcaaaaggcaattgcacattgacttgctggttgggcgtgatggtgacgatagaaggcgacatcgcccaatcactgattaaatcgggatgcgaaaattggctcagccagcggcagagatcctgtttggattgaatagattgcataacttccccttttttgcccatgctaccaccgctcaaagagcaactgaaccccgaaaaagataggggaatcaactgttgcgcgccttggcgtgactgcgtgcttagggtagtattatcgcttcaatttggtctctatcaagaaaagcgaatattaagtatggcaaacgatccaagaaaacttctggtaacttgtgccctgccttacgcgaacggttcaatccaccttggtcatatgcttgagcatatccaagctgacatttgggttcgttatcagcgtctgcgtggcaatacagtaaacttcatctgtgcggatgatgcgcacggcacacctatcatgctgaaagcacagcaaatgggtatgacaccagaagcgatgatcgagatggtgagcgaagagcaccaacgtgactttgctggcttcgatattagctttgataactaccacagcacgcacagcgatgaaaaccgcgagctggcttcgcacatctatctgcaactgaaaaagaacggctttatttcaagccgcaccatttctcagctgttcgatcctgaaaaagagatgttcttgccggatcgtttcgtaaaaggcacttgcccgaaatgtaaatcggaagaccagtacggcgacaactgtgacgcgtgtggtgagacttacagcccgactgagctgatcaatccaaaatccgccgtctctggtgcgacgccagtgatgaaagattctgagcactttttctttgacctgcctcagtttgaaagcatgctcaaagagtggacacgttcaggctctctgcaatcagaaaccgccaacaaaatgcaagagtggtttgaaggcggcttgcagcagtgggatatttcccgcgatgcaccgtactttggttttgaaatcccgggcgagaaagacaaattcttctacgtatggcttgatgccccgattggttacatgggttcattcaaaaacctgtgcgacaagcgtggcgatttggactttaacgaatactggaataaagacagcaaaaccgagctttaccatttcatcggtaaagacatcgtttatttccacagcttgttctggcctgccatgctcgatggctctggtttccgtaaaccgaccaacgtgtttgtgcatggttatgtgaccgtcaatggcgcgaaaatgtctaagtcgaaaggtacgtttgtgaaagccagcacttacctgaatcacttggatccagagtgtctgcgttactactacgcggcaaaactgaataaccgcattgatgatctcgatttgaacctcgaagacttcacccaacgtgtgaatgcggatgtggtgaacaagatcgtaaaccttgcgtcacgtaatgcaggtttcatcactaaacgttttgatggcaagctgtctgcacactttgcggagcctgagctgtacgctgaatttgctggcgcagccgatcgtattgctgagctgtttgaagcacgtgagtttggtcgtgccatccgtgaaattactgcattggcagataaagccaaccagtatgtggatgaaaaagccccttgggttgtcgcgaaacaagaaggccaagaccaagcactgcaagacatctgtacggtaggcattaacctattccgcgtactgatgacttacctcaagccagtgatgcctgcgttggcagagcgtactgaagctttccttaaccaagaattgacttgggaaggcgtggcaactccgctaacggatcatgcggtaacgccattcaaagcactgttcaaccgtatcgatccgaaacaggttgaagctatgattgaggcgtcgaaagccgaggcggcagccgaaaaagccgcagcagatgccgcaaaaccaaagagcgcagaaaccgagctgagcaaagaccccctagcggcggagattgagtttgatgattttgcgaaagtggatctgcggattgcgaagattctttcttgtgaagcggtcgagaaatcggacaagctgctcaagtttgaactcgatatcggcggtgaaacccgtcaagtcttctctggcattaagtctgcctaccaaccagaagatctgattggtaaatacactgtcgtcgtagcaaacctcaaaccgcgtaagatgaagtttggtatgtctgaaggcatgatcctcgccgcaggccctggcggtagcgacctgtggttacttgaaccccatcaaggcgctcaagcgggtatgcgtgtgatgtaattattgcgtcttgattagcaagccaacacctgaaaagcctttgcatctgcaaaggcttttttgtcatcacccgctttctcaagccaaacattttctcttcttatccagcatgactctcttggccattacacggtctagctcacattttttgcgcattatgccccataaatgtgcatacccaatcaaccaaaaacaataacttattgatttttaatcattaattttttggcattcaaactgcaataccactctgtacccttccacataggaatgggatggtccaacaccaacacggaggtggctatgtttgtgacaatttctctggttctgtctttagcaattcttggcttgatctatacgctctctcagcggaaacattcaacacaacagcgtaaatttgaactgctgatctgtttgcgcgaagtgttggcgctgtgccgccagcaccgtagtctcactcatcaaacactcagccaacaagagacgcattcgcaaactgagcacgatctttccaagctacaaaagcgtttgttagaaaagtcggagcaactgatccagatcgcccactttgacaacaaaccctcctatcgaattttgcaaaactcgttgaaaacggtgttaaacgaatgggagcaagccaatgtgggaaaaaatcaacgcctgcatggcaaattgatccgccactgcatgtacttgatggatgatgtggtgctcgcttggcttgcggaatcaggacgagaagaattgagtgatgagtaccacatgaactggcaacaaatttttgatgcgatggaaacactcacccaattgcgcttgtgcattgatgactctcgaaatgaaaacaataacttacgtattcgccactattgtgagctgatgcaacgtaagctcaatcagttagcgctgatcagccctttaacgctgggatcaccagtctgctcatccgcgatgcgccaattgaacgaaatcaccgacagcagtgacttaatgccagagagccataaactctatcagttaagcactgaactttcggccaccattgcgcaggtatacgaccatatgctcaatgatttggtggaaagcctctatcacccgttaccacagcttgttgtggcgtaaacgggtaggtaaaggaaatagaaagcgccacatcaagtggcgctttttaattcagtgaagaagatatgcctcttatttcagcatcttacgtgcagcttccaccacaactttgatagaacgcgcttcggtttctttcaacgtcgcgtgatctgggatctctttttgagtacggttgatgatcacacccgccacgcagcccgctttcaaaccagagctcgcgcacatggtcagcagagttgccgattccatttcaaagttgagcacgcccatgtcttgccactctttcatcgagccttggaaacgacgcactacgcgaccagtgaaagtgtcgtaacgctcttggcctgggtagaaggtatcggaggacgctgtcacacccatatggactgttgcaccgctttcttgtgctgccgctttcattgcggtcgccacatcaaaatccggtaccgctgggaattccatcggcgcaaagtgcagacttgcaccatccaaacgcacagaaccggttgtgacaatcatgtcaccgacattcacatgaggctggatcgcaccagtcgtgccaacgcgcaagaaagtacgcacgcctaattgtgctaactcttcaaccgcaatcgatgttgaaggtccaccgataccggttgaacacaccaccacagactgcccatccagctctgcgcggtatacggtatattcacgatggcttgcgaggaaaacagggttatccatcagctccgcgattttctgcacacgagcagggtcgcccggaataatagcgagtgtggcaccgtttaaatctgcttcagtcacaccaaggtggaatacggttttggtcatagggggctccttcaattgcgtctattcagcgcacttatcatttagggtacggagttactttacccgatagcttcgcgcaaataagtgataacaatcacaccaaagacagcaataaacatcaaactttcataattaatcgatttgcatcacaaacaaatgtatctgtaatgcaagtcgattcctattacagagagatacctctatccccttcctacttgaagctgcagcggtgttggctacgttcgctcaccccaatcacagtgtttatctatgctcatggggattatgagagccatccttggctctcaccaaaggccagccgatggctgtgcaaatttgttccagacaaatttgtcactctcttgccgcctacctgcaactccaagtagttttggtatagttgttgagacttgaaacacatacggaaaaactaggaggcgaacctcctagttaaacgaccttattccgaagtcgaagagcggaatttaagcagacgcagtgcattgagcgtgaccagtgcggttgcaccgctgtcggccaataccgccatccataatccggtgatgccaagtaaactggtgactaagaacaccgctttaagtcccaaggctaagaccacgttttggcgaatgatggccaacgtagcacgagacagctcaatcatccccggcaactcaatcaagcgattgtgagtcagtgctgcatcggcggtttctagcgcgacgtcggtgccgccgcccattgcgataccaatactcgcctctttcatggctggggcatcgttaatgccatcgcccaccatggcgacacgttgatgttgcgccaactgctgaatgtagccgactttatcttgcggcaataaacctgcccgaaaatccatattcagttgctggctcattgcggccgcgctgcgttcgttgtctcccgtcagcatcaaggcgttaatcccgagttgatgtaaggcggcgaccgcttgacgtgcatcactgcgcagcgtgtcttgccaagcaatcacaccaaccaccgcgtcacttgccagcatcacgactacggttttactttcagcttcaagcatttcgacatgctgtttcaccacgtcgggcaatttggtttcgacccgatttggcgcaagcagacgatactgaacaccatcaatctggccgctaatgcctcgcccaaccaaggcggtacgctcttgcgcttgtgggatggtcagttgctccgcctgcgcttttgccaccagcgaggtcgctaagggatgatgtgagcccatctcaatcgcagcagcccgagctaacaaggtcgcgctatcccaaccttgcagcgggataaggtctgtgacttgcggtttaccttcggtcaaggtgcctgtcttatcaaaggcaatggtctcgatttttcccaattgctctaatgccgcaccacctttaattaaagccccacgacgcgccgccgccgccaaacccgaagtgatcgccgcaggtgtggagatcactagcgcacaaggacaagcgatgagcagcaaagcaaggccacggtaaatccaagtctgccaatcggcaccaaacgctaatggcgggaccacaatcacggcgagcgcgaccagcatcatcagcggggtataccaacgactgaatttatctaaaaaacgctccaggggtgctttgcgcgattccgcctcttcaatcatatgcaaaatacggtcgatggcgttttcaccttgtttcgaggtgatttcaatctgcaccaccttatccacgatcacacaacctgcagaaactcgctcccctgccgttaattcgacaggtaaggattcgcccgttaacgcactgttatccagactggcggcggcaagtaagcgcccatccgctggtaaacgacctccgggagccacttcaatgacatcgcccggttgcaactgcgcggcaggaacggtaacacgctctccatgttctatacgaatcgccgtttctggcaccagcgccatcaaggcttgtacgcccgtacgtgcccgagaagcggcataagcctccaagcgctcaccaatcaaaaacagcagtaataccatggcggcttctaaggtttcccccaaataaagcgcgccaattgcggcaaccgacattaaggtttcaatcgagaaaggagaacccgatttggcaagacgccaagcttgttgaaggatggggaacagccccaatagacaagtcagcgtataaatccagcggctcatctcgctggagttgactaaggcacctattgccatcagcgcagcgataccgataattcgtgcgttttcactctgccagaggggcggcttggattgggatggtgttgccgctgaactggcggctgggtttaggctaaaaccgctgtcgcgtactgcttgttcgataagcggcgcggttgagggttgattaaagccaaccaccaatttctgagtggcgaacatcacctgcacttgagtgacatcacccaactgcttaacggctttttcaattttttgtgcgcaagaaggacagtccattcctgcgatataccaactctgctgatagtgtgatgaacgtggttcgtgacgtcgctcggggtcttcttccaacgtcgcaccgccaccaccatcactggtacagcaactatcgccgtcacaagaagcgcttacgcctgccgcacgaatggcgacaattttggggcttccgtcacagctcgtttggtggctgtgcataggttgagttaacgattttgaacgacaagcatggtgtttagtacacatatttccatctcctttttgtgtgctgtgatcagcttacaccttggagtcaacttcaaggtcaagcggattcaagcacaaaagcataaaaagttggacatgctcatcggtcacattaaaccggatgttgaaaacagttggttaaggttttgctcaaggctcgtagcacatcacgccgcgtgatcacaccaaccaatttgccatcactcaccacaggatacattttcggttttccgaccttcatcatcgccgcaagctcaataatggaagtctctggcgcaaccgagagcacctctttgtgcatacaatcactcaccaaatgggcatcttggcagtgataactggcatgcaccagcttatccaacaaatcctgttcggataaaaagccaatcacatgccgctgcgcatcaatcacagggccgcccatgttgtctgaacgcaccactttttcgagcgccgcactgagcgacatatctggactgaacgttaccgcttgtagggtcatataatcgctgactttcagtgagtccatcctgttctcctttattaaacccatctcacgctgattgagttaagtgttgttcaaaatgagccatttatcctgtttcattttgtggttgcaccacacaatttccaaaaattcatccttttttatgaacatgagcttttgagattgaatgtgacggcctacccgtatccgttctgagtaagatcatctataaatagagtaataagcgatcactcattaggaatcaggtcggtgacttctattttttcctcgacgattattgccaatcctgaaattctgcagtttatttttcaatcgctgcctgaacccacttttctcatcaataagaaaggggtgtatatcgaagcatggggaggtacggacagtgaacgccatcacaacccctcttatctggtcggtttaaaccagtatgatgtgttaccggcagcacaggctgcttggtttactgacgtcatccaacaagcgatcgagcagggctgtgccaaagagttggaatatgaaattgatccaacccagttgccctgttttgacaatgtccctgggccaagccaaaagcagtatttctccgcattagtcatccctcttcccaacacagacatgatgttgtggaccgtgcgtaacatctcagactacaagcacacggttgaaaaactcgcgcagcatcagttggaacttgagcacctgactcatatggatcatctgacccaagtgtacaaccgttacgcaatggattcgttgctgccgcaagcactggacatcgcccgactcgatcgggtcagcagcgcattattgatgatcgatattgactgtttcaaagagtacaacgacggatatggccatattcaaggcgatgatgtcctgcgcaaggtcagccaaacgctgcgtcaatggaaatcgaatctcgatctctgctttcgctacggcggggatgaatttttgatttttatgaccagagtcgatgcaaagcagtgccagcaacgagccgaaaaactgatggcgatgattcatgagctgaacatcccgcacctgagttctcgagtggcggatcatgtgacgattaccgtaggcattcgccactgtgatcaaatagagaaagaaatgaccgcggaaaagcttgtgttagtcgccgataaagcgctgtttcatgccaaacatgagcaacgtggcaccattcatatgtttagtagtaccacttggcatgaatagccttattactcttcttattcccagcgctgcgcggcttgatgatcactgtcgcgtgaatcaatccagcgactcgcttcggtcgtcagctcttttttccaaaatggcgcgcgggttttcaagtaatccatgatgaactcgcacgctgcaaacgcagcattgcggtgcgcactgctgacaccaaccaacacgatttgatcgccgctgagcatatcgccgatgcgatgaataacgcgaacgcgttgtagaggccaacgctcctgagccatatcgcaaatctccagcaaggatttttccgtcatgcccggatagtgttcaaggtgtaagcccacgacattatcgcccaagttcatatcccgaactttgccgacaaaagtcaccacagcccccgcttgtgagccttgcgctaacgcttcatattcttgagcaacagagaaatcttccttctgcaccgatacgcgatggtccatactagcctccagtcactggtgggaaaaaggccacttcatcgccatcttgtagctctgtatcgaatggcacaatcgattgattaacggccgccaatagcttacccggttcaagtgccatatcccacttacccggctgctgcgctaaatgttggcgcaaagcttctaccgttgcaaaagcgtggtcaaccaccagactatcgcactccaccaactctcgagtttgggcaaaaaacagcaccttaatcatgcatccaccttaaagtgtcccgattttccgcccgatttttcaagcaatcgcacgttctcaattacgatgtctttttgaaccgctttgcacatgtcgtaaatggtcagtgccgccaccgatgccgccgtcagcgcttccatttccaccccggttttaccactgagtttacacagagattcaatgcgtacgctgctttgttctggcaaggcttcaagctgtacttccaccttggaaagcagcaacgggtgacagagcggaataagctcccacgtacgtttcgcggcttgaatgcccgcaatacgcgcagtggcaaacacatcccctttatggtgctggccagagaggatgagttgcagcgtttcgggtgccatgcgcacataggcctcggcacgagcttcacggacagtatcggctttattcgacacatccaccatattggcttcacccgaagcattaatatgagtgagttggctcatcaaacctcccctataccgttaggtgcggcataaagttacatgggcgatgggaagcatccaattgctgtttaatgatttttgtccaaccggtgcggcatgcgccagtcgaacccggcatagcaaaaatcaccgtgtggttagcaaaccccgcaaccgcgcgcgattgaatggtcgaggtgccaatctcttcaaaagagaccatgcgaaacagctcgccaaaaccttccacttctttatcaaacagaggcttaagtgcttcaggtgtgctgtcacgtgacgtaaacccagtgccaccggtgatcagaatcgcttggatggtttcatccgcaatccactgtgaaaccaccgcacggattttgtacatatcgtcaatcacgatctgtttatctgccagtgtatggccagcttcttgaagctgctctgccaagtaacggcctgaggtatcgttttcttccgtgcgcgtatctgacacggttaaaacggcgatgtttgctgcttgaaatttgctttctgcgtgacccatttgttcaccttttcaaaatggttaaacctcaatggtgaggtcagattatcggtagaaactcagccgccaatcgaggctaaatgcggcgtcacacccgaatttccatcatgcaggaagtgggtttccgccttgttttgcaactgagtttgaattcgttcaatcaatgcgttttcttggtgatcgtcttgcaaaagatcgcgtagctcgatgccttgttcgccaaataagcacagatgcagtttgccaagtgctgacacccgaaggcggttacagctgcgacaaaaatctttctcataaggcatgataaggccaatctcgccttggaaatccggatggataaacacctgtgcagggccatcgttatcggctctggctttgagtaaccagccgttaccgaagagatagtcgcggatcgaaatgccagaaacatgatggcgagcaaacagcgcgtccatttctccggtttgcatcaactcaataaaacgcagttggatggggcgagttttaatccacgccataaattggggcagttcaaggtggttaagatttttcatcagtaccacgttgactttgacttgctcgaatccaacttcaaaggcgcgatcaatgccggacatcacttgctgaaagcggttttcaccggtgatttgcgcaaacatacgtggatctaagctatctacgctgacattcagttgagtcaaccccgcttcgcgccactcaccaatatgtttggctaaacggtagccattggtggtcgtcgcaactttttgaatgccgggagtttgcgctatggtatgaatgatttcgccaaaatctttgcgcagtgaaggttcaccgccggtaattctgaccttggaagtaccacaatgggcaaacgcactcaccactcggcgaatctcattcaccgtcagaaaagaggcagggcgacccgctgatggcttgtaaccatcaggtaagcaatacgtacatttgaaattacaaacgtcggttatggatagacgtaaatagtaaaatttacgctgaaatctgtcttcgaattgttgcgccacagaacacctttccaaatacgggaggcaaaatcatttccaattctgcccttgtgacaagcggtcactggcttacaacgcatatttaaaggtttaaacttagcgcggtaagctcggagttaaggccaagcactatgatgttgccatctctttagctcaggctgctggtaaaatacttaataattgtacgtgattctagccttaaccagaaaaaaatggttaccttgcagaaattagccctaaatgggtactcattatgaaccaagttagctaaattgctgcgagttatgaaaaaataagaaaaacctatgtctctatacgaaaacaaaaaagtggttgcgattggcggcggccacggtcttgggcgaatgctggcagcgctcaaagtgtttggttccaatgccacaggcatagtcaccaccacagacaacggcggctcaacaggacgcattcgtcactgccaaggtgggattgcttggggagatacccgtaactgcatcaaccagttgattaccgagccgtcgatcagttcaatgatgtttgaataccgctttaaaggcgcaggggagctcaacggccacaacttgggcaacctaatgctcaccgcattagataacctttcggtgcgcccattggatgcgatcaatcttattcgcaacatgctcaaagtcgatgtcaatatcctaccgatgtctgaacatccatccgatctggcagccctcgctatggatggcaaatgggtcaccggtgaaaccagcgtcgatgagatgactcaagatttgcgaagacttgaccttgcgcctgaagtcccggccaccaaagaagcggtaaccgccattcaagacgcagactgcgtgattctgggccccggaagctttttaaccagcgtcatgcctcctcttctgctgccagaattgggcaaggcgattgctcgtaatcaaactgcgaaagtgatttttgtcgagaacctatcgccagaatatggacctgcaggacgaatgagcttagagcaaaaattggaatggtgtgaacgcgcctgccaagggcgcaaaattgatgtggtattgggccatcaccctcatccagagttagaacagcgttggaattttgttacccgagatttggcttccgccaaccgcgactggcgtcatgatcggcagaagctgagacaagctatcgaagagcagttaatgaactaaatcggagtagcattgatgcgtctgcttcagtaactcaagcatatgttcaacctctagcgagatgtccatcatctcgccagatttggcgcgactatctaactccaccgctttggcgcacaagcgatcagccccaaaactggccgcactgcttttcagcgcatggctgatttccttgagatacccgagtttgtccgcgaccgtatcactgactaacttactttggtaatcattgagttcaccaagaaaaatgttgaccaagatcggcacgttttcttcaccgatctccttcgccagtaagtcgattttgctttggttgatccattctctcatcgcttaccgttccttctctttttctttcactttttcattccaagtttgcagcttgcgatagatggttgacgggctgacatccagataggttgcggcacggggaatgttgccatcacacgcttcgatggcttgttcaatggcttgtttttcggtcatccacagcggaaaaatctcatgcacggatactttattctcatgcgcaagcggtaaagcccgattgatcggcgcggacatttgattaagaggaggaggcagcatatctagggtgatttcacgaccttcattgagcacaaccacgttgcgcaaaacgttttgcaattgacgcacgttgcccggccactcgtattggcgaaaacgctccaccacttcagccgacaaacggacaaaatctttgccctcttccttggacataaagccaagcagtgaataagcaatctcgatcacatcatcaccacgcgcgcgcaatggcggtaaatgcagcgggatcacatacaagcggtagtacaggtcttcacgaaagcgtccttcttgcacttccttccacggatcgcggttcgttgcacacacaaaacgcacatccacgcttttcattttggaagagccgactttttggaatgtccctgtctgaataaagcgcagaagtttggtctgcagatccagatccatttcgcacaattcatccaaaaagagggttcccccatcagccgcttctgccgcgccttgacgctcagtcgccgccccagtaaaagcccctttgacgtgaccaaacaactcactttcaatcagatctttcggaatggccgcacagttgatggcgataaatggcttatctccacgcttgctcgcggcatgaatcgcttccgcgcacacttctttacctgtaccactttcgccggtaataaaaatactggctttgctgctcgccgcagagtcaatggtgcggtacaccgcctgcatggtttgactgctaccaataaagccttgatagttttgatttttattatcaacatcgtttttgagtttcgaggctttgcgaatcgcattattcactgtgacccgcagtcggtccgcttcacacggcttgatcaaaaagtcttgcgcaccatgacgcatggcttcaaccgccgtatcaatcgaaccatgagcggtcataaacacgataggcacatccggtgatttctctttcactgcatagagtacgtccatccccgtcatatctggcaaacgtaaatccagcaggattaagtcaggctcgcgacggccaatactctcgatggcatcgcgtccggtacccacgatattgatatcaatatccagcggtgtgaggtaagaacgatacagcgccgccaccgacgccgtgtcttctaccatgaggacatattttgttttctgcaaagattgattatgttgcatagcctagccatattattttgcattttgctgtaataattgcatttggaattgcattttgcaaatttgaattaaaatttcttgataaatgatgccaaacatcacacatctagaccgatttgagttggcacgatatgtgcttgattactactgacccgcaagggtcacctagccaactgacgttgttagtgaataatcaatgttcacaaataacagccaatagactcattctattggctatttttttatctgcgtgtttgaaatcagtgtttttctcttcctaaacacttgctcagtggcgcctgatttatccctaattcacataaagatacctatgattggcgaacactgtcgtgttatcgcgcagcttcctctaaaaatgaaagaaaggctaactattggcgataaactgctgacgcaactgatgaatttcatcacgtttttgcgccgctaactcaaactctaagttctgcgcatgctgatacattgcggcttctaatttactgatctctttttcaagctgctgaggagtcaacacttggtaagccgccgattcttcagctactttcgccaatggcaccactttgctgttcttctgtttgcgcgatttcgcaatatcgcccagctccatgatgtctttaacgctgcgttttaaaggctgcggcgtgataccgcgctgctcattataagccagctgcttctcacggcgacgctcggtttcatcgatcgctttacgcatggatttggtgatcgagtcggcatacaaaattgctttaccattcacgttacgtgctgcacgacccatggtctggataagtgaacgctcggaacgcaaaaagccttctttatcagcatccaaaatcgccactaaagcgacctctggcatgtccagaccttcacgtagcaagttgatccccaccaacacatcaaatacgcctaatcgtaaatcacgaataatttctacccgttcgacggtatcaatgtccgagtgtaaatagcgaactttcacaccatgctcatgcagatattcggttaagtcctcggccatgcgtttggttaaggtagtcaccaaaatccgctcatcattggccgcgcgaatgcgcgcttcagaaagcagatcatccacctgagtggcgaccggacgtacttcaatgatcgggtctaacaaaccggttggacgcaccacctgctccgccacttcaccacccgatttagtgagctcatattcactcggtgttgctgacacaaagatggtttgcggtgctaatgcttcaaattcatcaaacttaagtgggcggttatctaaggctgaaggtaggcgaaaaccgaactccaccagcgtttcttttcgtgaacgatcgcctttaaacatcgcgccaatttgcggcacggtgacgtgtgattcatcgatgatcagcaagccatcgtgaggcaagtaatcaaagagcgttggaggcggctcgccttctgcacgaccacttaggtaacgtgagtagttttcgatccctgagcagaatcccaattcgttcatcatctcaatatcaaactgagttcgctgagaaatccgctgctcttccagcaatttattgttatccagcaaatattggcggcggacctgcaactcgctcttaatctgctctatcgcctcaagaatgcgctcgcgtggggtgacatagtgagttttggggtaaatcgtaaagcgagctaaatcgcgtgacgtaatcacgccggtcagcggatcaaataaactgatgcattcgatttcatcatcaaacatttccactcgaacagcttcttgatccgattcggcagggaaaatatcaatcacttctccgcgtacccggaactgaccgcgctcaaatgccatatcattgcgtgaatattgcagctccgccaaacgacgcaacatgtcacgttgattaatcacatcaccacgacgtaaatggagcatcatttttagataagagtccggatcgcccagaccgtatatggcagaaactgaagcgacaatcaccgcatctttgcgctcaagcaaggctttagtggccgataagcgcatctgttcaatatgagcgttcacggacgcgtctttttcaataaaagtatccgtggtcggcacataggcttctggttgatagtagtcgtagtaagaaacgaaatactccaccgcattgttgggaaaaaaggctttcatttcgccgtacaattgagccgccagtgtcttattaggcgcaagtataatggtgggacgctgcgcggtggcaatcacattcgctaacgtaaaggttttacctgaacccgttaccccaagcagagtttgatgagccaagcccgcttccaacccctccagcaattgcttaatcgcggtaggctgatcaccagcaggttgatagtctgaaaccaattcaaatgctttgctcattgcatcctcgtcacgcttttgtgttgagcgctattgtggcgggatgctgaccggatgatcaagcacttcttctctcgctttttgccacgtacaacgtggtgtaaacagatttcgtagttcctgtggggcagatcttaatcttcgtgaaaatattcctagcttcctcaatagaggtttgctaacatcctcagccctacatcggcctagcgccactcttgatccaaaaaataatccacctgttttccccagattttcttctgaacgcattttcttgtctgtaattcatcgatttactgagctgagttaccactgtggaaaagctaaaaattccccaaaaaaataaatacttaacgaaaataccacaccaaaatcaaactgagtatttactcaagacttattcgctcaaacattaactcaagatccattaacacacttatccacaattttggtggataagtgaatacagctcaatagcggtaagggatacaaaaaagtaaaccctttacgacataaaaaagtgcgctttttttcattgaaaatcattgacacccactagttgggtcgttaaaatccgcgccgaaactattcctccttagttcagtcggtagaacggcggactgttaatccgtatgtcgcaggttcgagtcccgcaggaggagccaaatttagagcccagtcagtaacgactgggcttttttattgatgtttttctctgcaagattcccgtcaagatctcttatcaatccctgccattcgcatcccatttgccacttattgcgtataatttatctccatctacctaaaaccttatctttccttggttgttattgctttggcaaagcaggataatgccgggatcggaagcaaacatttatataactatgaccgaatatcttttgttgttaatcggcaccgtgctggtcaataactttgtactggtgaagtttttgggcttatgtccttttatgggcgtatcaaaaaaactagagaccgccattggcatggggttggcgacgacattcgtcctcaccttagcttcggtgtgcgcttatctggtggaaagttacgtgttacgtccgctcggcattgagtatctgcgcaccatgagctttattttggtgatcgctgtcgtagtacagttcaccgaaatggtggtgcacaaaaccagtccgacactctatcgcctgctgggcattttcctgccactcatcaccaccaactgtgcggtattaggggttgcgctgctcaacatcaacgaaaatcacaactttattcaatcgatcatttatggttttggcgctgctgttggcttctcgctggtgctcatcttgttcgcttcaatgcgtgagcgaatccatgtagccgatgtccccgctccctttaagggcgcatccattgcgatgatcaccgcaggtttaatgtctttggcctttatgggctttaccggattggtgaaactgtaatgagtaccatagtcatcgctgttattgcgctggcggcattggccgccgtgtttggagccatactcggctttgcttcgattcgctttaaggtagaagccgaccctatcgtggaccaaatagatgctatcttgccacaaacccaatgtggccaatgcggctaccccggatgtcgcccttacgccgaagccattgctaatggtgatgcgattaacaaatgccctccgggtggccaagcgaccattgaaaaacttgcagatttgatgggtgtcgaagtgcaagactccgcccacgatctggacaacaaagtcaaaatggtcgcctttattcatgaagacatgtgtatcggctgcaccaagtgtattcaggcttgcccggtcgatgcgattgtgggcggtaacaaagccgtacacacagtgatcaaaaatgagtgcacgggttgtgacctgtgcgtcgcgccttgcccgaccgactgtattgaaatgatcccggtacaaaccacgccagagagctggaagtggcaactcaatgccatccctgtggtcaatgtgaccgattctgcgcctgctgcgcagaaaagtgcgaattaaggatgggtatgttgtcattaatcgaacaaatcaaatcaggtaagctttgggacttccccggcggcattcatccgtttgaaaataaacaccaatccaaccgtcagccgattatcaatgcgagcattccgaatgagctggtactgccactcaagcagcacattggtaaggccggcgatctactggtgaaagtgggcgatcgcgttttaaaaggccagccgctgacgcaatatacgtcgaccttcatgttgccgattcatgcaccaacttcaggcgttattagcgctattgagccacgtaccgtcgctcacccttccggtttgagtgagctgtgtatcgtactaacgccagaccaacaagaagagtggtttgagttgcagccgcagccggattttcagcagttgacccctgaaacactgttggagctgatccgtcaggccggtatctcaggtatgggtggcgcaggtttcccaactgcgaagaaactgcaatctgggctttcgcgcaccgaaatcttgatcattaacgccgccgagtgtgagccttatatcaccgcagatgatgtgttaatgcgtcaatatgcccatgaaattattcagggaatcgagattgttgagcacattctaaagcctaaactcaccatcatcgggattgaagataacaaaccggaagccgttgcagcgctgcagcaagccgcgcaagacaaaccgatggtgatccgcgttatcccaaccaaatacccgtctggtggtgagaaacaactcatcaaaatcctgactaacttggaagttccgaaaggtggtattcctgccgatatcggtttaatggtgcaaaatgtcggctcattgcaggcgattgcgcgcgcgattgtacatggtgaacctctgatccgccgtgtagtgacactcaccggcgattgtttccgtaaaccacgtaacgtttgggcattgctcggcacgcctgtccaagcgctgctcaatgagtttggctacaaagccgataaaaagctgccgcgtctcatcatgggcggcccgatgatgggcttcactctaccccatgcgcaagtgccgatcactaaaaccgctaactgtattcttgcgcctacacgcaatgagttaaccagtagtgataatgagatggcgtgtatccgctgcggtcaatgcgccgaagcctgtccggtatcgctattaccacagcagttacagtggcacgcgaaagccgaagaatttgataagtgcgaagagctcgatctaaaagactgtattgaatgcggcgcttgtgcttatgtctgcccgagtgaaattccgttggtgcagtactatcgccaagccaaagcagaaattcgtacccgcagcttagaagcggaagccgctgaacgagcaaaagcacgcttcgaagagaaaaaagcgcgcatggagcgggataaagcggagcgtgaaaatcgcttcaagcaagcggcggaagatcgccgcaaagagatgcagcagcaaggtggctccgatgcgattgcggcggccattgaacgggttaaagcccaaaaagctcagctcgagccaaccgataacagcgtaaaaccggctattgcggctgcgattgcacgcgctaaagccaaacaggcagaagcagcgcaaagtggtgccagtgagcctgataatagtgaaatggctaaactacgtgaagagcgtaaacgccaagctcgggaacgcaaggcacaaaaaggtgaagtgactgaagcatcaaccagtgatggtgcggacgataagaaatcggctgtcgctgcagcgattgctcgcgccaaagcgcgtaaagcggagcagcaggaaaccgaaagcgcagctcagccagcacaagccacaccaagcagtgacgatgctgatccgaaaaaagctgcggtcgccgccgccattgctcgtgctaaagcgcgtaaagcagagcagcaggaaaccgaaagcacagctcagccagcacaagccacgccaagcagtgacgacgctgacccgaaaaaagctgcggtcgctgcggccattgctcgcgctaaagcgcgtaaagcagagaagcaggaaaccgaaagcgcagctcagccaactcaagctacgccaagcagtgacgatgcagacccgaaaaaagctgcggtggccgccgcgattgctcgcgctaaagcacgtaaagcggagcagcaggaaaccgaaagcgcagctcagccaactcaagctacgccaagcagtgacgatgcagacccgaaaaagctgcggtggccgccgcgattgctcgcgccaaagcacggaaagccgcccaacaatcatcatctaatttaaacgctgaggagaaagactagtggccttctttattgctagctccccacatttacgcagtaagcgcagcacggctgacgttatgcgttgggtattagcctgcgcactgcccggcctgatcgctcagacctacttttttggctacggcacactgatccagttactgctggccatctcggtcgcggtggcactcgaagcgggcattatgctgctgcgtaaacgatcaccaatctcagcactgcgcgattacagcgcggtggttaccgcatggttactcgcggtcgctatcccgcccctctcaccatggtgggtcgtcgtgatcggtctgatttttgcgatcgtgattgccaaacatttgtatggtggacttgggcaaaacccttttaacccagcgatgatcgcctacgtagtgttgttgatctcctttccggttcagatgaccagttggatggcgcccattaagttaaccgccgaaccaagctcactggtagactcgttctcactgatcttcggcggttttgacagtgatggtctatcgctacagcaaatccgtacgggcatcgatggcattaccatggcaaccccgctcgatgcgttcaagacctcgctcaaagcaggacataccatgagtgaaaccttgacccagcctcagtttagtggctttgcgggtatcggttgggaatgggtcaatattgcctatctactcggtggcctgattctgctgaaactgcgtattatccgttggcacattccaatggcaatgctggcaggtttggttttcacagcgttactggcacaactttttgcaccgggaacaaccgcgtcccccatgatccatctactctcgggcgcaaccatgctgggcgcattttttatcgcgaccgatccggtcagtgccagcacgacggataaaggccgcttgatttacggtttcttcatcggtgccatggtgtttctgatccgtagttggggcggcttccctgatggtgtcgcctttgccgtactgctcgccaacatgtgcgtaccgctgattgactactacaccaaaccgagaacttacggacactaagagcgcgacttatgctgacagcaattcgaaaaaatggcctgattctcgccgtctttgcctgtgtttcaacgggtttggtggcgctgacttacgccctcaccgcagagcaaattcaacaacaagagcaaaagcagctactgcaggttctcaaccaagtgatcccacataagtatcacgataaccctctggcgcaagcctgtactttagtcaatgatgacaaactcggtacagccaaaaccatgcatgcttatctggcgcaacgtgacggccagcccacagccattgcgattgagactattgcccccgatggttataacggtgaaataaaattgatcgtcgggatcgccaataacggcaccgtacttggtgtgcgtgtacttgcccatcaagaaacaccggggctaggtgataagattgatttacgcatcagtaattgggtattaggctttaacggccaacaagtcaccgccgataatcaggatgactggaaagtacgtaaagatggcggtcagtttgaccaatttacgggtgcaaccattactcctcgcgctgtcgtactggcggtcaaaaaagccgtggagtatgtcaaccaacatcaacaacagctgcacaatcagccgaatccgtgtgagggtcaataacatgaatgaaaaccgaactctgatgttaaatggcatgtggaacaacaacccagccttagtgcaattactgggattgtgtccgctgctcgccgtttcctccaccgtgaccaatgccctcggattaggcattgctacgcttcttgttctcgtcggctcgaatgtcaccgtctctctcgtgcgtgattatgtgccgaaagaagtccgaattccggtgttcgtgatgatcatcgcttcgctggtgacttgcgtacagttactgatgaacgcctacgcttacgggctttatctctcgctcggcatttttattccgctgattgtgacaaactgcatcatcataggccgtgctgaagcgtttgcttcaaaaaatgatgtgctcccagccgcgttagacggattttggatgggattggggatgacctcagtactggttgtgctcggatcactgcgcgaaatcatcggcaatggcacgctgttcgatggcgcggacctgctactcggagaatgggctaaagtcctacgcatcgaagtgtttcactttgacagcgcctttttgctggcactgctgccccccggtgccttcatcggcgttggctttttgatcgccgctaaaagcgtgattgataaacagactgccgctcgccaaccaaaacaacaaaagcaagccatagagcgtgcacgcgtgaccaatgtctaacctgatcaaggaagccaacccgtctaatgaataacgcgaaacggattgaaattttagaacggctgagggctcacaacccaaaacccgaaaccgaattaaactggaactccccctttgagttgctgattgcggtgctgctctccgcgcaagcgactgatgtcagcgtcaacaaagccaccgataaactttatgcggtggccaatacgccacaaaccatgcttgatctaggtgttgatggcgtcaaagagtatataaaaaccattggcttatttaactctaaagccgaaaacgtcatcaaaacttgccgtattttgcttgaaaagcatcaaggtgaagtgccggaagatcgtgaagcattagaagcgctgcccggcgttgggcgtaaaaccgctaatgtggtgttgaataccgcctttggctggccgactattgcggtcgatacgcacatctttcgcgtctccaatcgcaccaaatttgcggtcggcaaaaacgtcgacgaagtagagcacaagctactcaaagtcgtacctaatgagtttaaactcgatgtgcaccactggctgattctgcatggccgttacacctgtgtcgcgcgcaaaccacgttgtggcagttgcattatcgaagatctttgtgaattcaaagataaagtgtacccagaaagctaatttcccaaaaaaccgttatccggaaagtaaggagctcttaatgtccaaccatcgtattttgcacaccatgctacgcgtcggcgatttggataaatcgatcgaattctatactcaagtaatgggtatgagcctgctgcgcaaaaatgagaatactgagtacaaatacaccctcgccttcttaggttatggtgatgaatcccaaggtgcggtcattgaactgacctacaactggggcgtggcggactatgagaaaggcaacgcatacggccatatcgcgattggggttgatgatatttatgcgacttgcgataccatcaaagcagcgggaggcattgtaacccgtgaaccaggcccagtgaaaggcgggacaactcacatcgctttcgtgaaagaccctgatggttacatgattgagcttatccaaaacaagcaagcccatgcaggtcttgaaggctaatcgccgattctgatgcatgatgccgtcttatggacggcattttttgcgcgctgttcttccaccctttctctgcaatgcgtaattcccacacaattcctgtcatttacatgataataattatcaattaatctgaggcaacagataatcaaggagaaggtgtgatgaatataaaagagtgggaaaggcataccctattagccgatatcgctatgcaggagtcagaccacctgcgcagcattcttcactatcaacaagcgctcaccgtcagccaacagttggatgaaagtgaagagattgacatggaagatcgcatgatgatctcggttatctcttgtcacaacatggccaagttttggcgcaccatgggcgataaccaatacgagcttaaatacctacaactggcctcagagcgcgtcctcacgctgatccctcagtgccataaaccaggctgtgaagcttttgttgactctctaggctgctgccgtaaagcgctgctcgattttatgaagcgccaccctaatccagagatcgcacgcatggtgcaacatatagataccgcctcaaaatgcgagattattgctcagtttcgcctcaattaacggtatcacccaaccaatgcgctctcccaattcaggtgtgactcgctatcacacctgagtgcggcctagtgaaatcaccacgcggcggtttttgtctttaccaatcggcgaagcgttatcggcaatcggccgccgtttgccatagccctgcacttgaatgcgatcttccggcaacccgatcgatttaaagtattcgcgcagcacctcagcccgttgttccgatagattttggctattgttattggtgtctgttgaatcggtataggtagaaaccagcactaaatcaatatcttggttatagcgtacatattcagcgatctgtgccaaacgcttttgtgacgctttattcaactcaacactggtgccttggtcgtagtgtaaaatcgtaaacgagatgtcttcaaagctgtaaggcaatagcttagaaatacagtcactaaactcattgtagggttgctgaaacagcactgaagagagcgcaacctcaatacgttgatcgcggctttgccaatcttgataactgaaggtcgggtagcgccccttttccagttcactgagtaacgaccacgcggtctgtccaccaatatatccatcaaactgtttgaaaaactgcagattcgtgatgcgatctgcgccttcccccggccgccaaaccggaggcatagagactaggctgacattacgggtatcccccattgggcgacgcatttttaattcaaagtcgagattgattttcttgccagcgcgagacgaaaactcggcgtcaccatagttggggatcgggtgcacaaggcggcattccaacggagtattggttgccatttgccacgtagactgttgtggtgttgccatataacgcacttccaacgccgaagcgacagacgctgataaggtgcttatggcaaacaaacttgtgataacccatttattcataaatactttttctcactactgatactgcatgctcaggcgataatttgccgcctgcgagacttggtggagatgatgcaaaaatctagccagcacgatactggcatgacggtacccaaacaacttgcttgccgcaaaacagccttgaatgaatccctttcaaccttatcgcttctctttattgaacaattaattgccgcgatttagataagctaggttttgctctaccgcagaatctgcaataatgccagccttatcacacaatttagaacccgcatgactgataaaaatgacgcgctaaccttgaaaaaacgctttcgtggctattttcctgtggttatcgatgtagagaccgcaggattcaatgcgcaaaccgatgcgcttttagaaatttgtgctgtcaccttgagtatggatgaaaacggcgatttacacccagcaagtactatccattttcatgtcgaaccctttgaaggcgcgaatctcgaaaaagccgcactagaatttactggcatttacgacccatttagcccactacggggggcggtgagtgaagatcatgcattaaaagagatttacaaactggttcgcaaagagcaaaaagccgcagattgcagccgcgccattattgtggcgcataacgcgcatttcgatcacagtttcgtgatggcagcgagcgaacgttgtaaattaaaacgtgttcctttccatccctttgccacgtttgacacggcaacgctaagtggtcttgctttcgggcagaccgtgctggctaaagcctgtaaaactgctgggatggaatttgacaatcgcgaggcacattccgccttgtacgatacccaaaaaactgcagagctgttctgcaccattgtcaaccagtggaaagctttaggtggctggccattggtcaatgatgatgaggacaataacaacgatgccgatttagattgaagctcgttctacccatggaccgctttaaccaatcaggcccatccctacccttcttgcttcttcaagtgggctggggatacacaacatcccgagaaaaaatatgaatccagtagtcatttccgtttgtgtcatgctgctgctagccctgatgcgggtgaacgtcgtggttgctttgacgttcagtgccgtggtcggtggtttagtcgctggtatgagtttgaatgaaaccgttgccgcatttgaaagcggtttgggtggtggcgccacgatcgccctgagttacgccatgcttggcacctttgcggtggccatttcgaaatcggggatcaccgatttactggcgcaaagcgtgattcgtcgcattcacggccaagaaagccacgcagcatcaaccgggttaaaatacctcgtactcatctctttgctgctgatggcgatggcctcacaaaacgtcatccccgtccacattgcgtttatccccattttgatcccgccgctcctgagtgtctttgctaagctgaaactcgaccgtcgcttagtcgcctgcgtcctcacttttggcttgatcacaccttacatggtgcttcctgtcggttttgggggcattttcctcaacaacattttgctaaaaaacctgcatgaaaatggtttggaaagcatcaccgcaagccaagttcccacggcgatgattttgcccgcagctgggatgatttttggtctgttgctggcggtactttttagctatcgcaaacctcgtgagtatcaagaaacagaattgaccgttgtgcaacaagaaagctcgtcgatcaataaacagcatattgcgattgcgggtgtcggcattgtggctgcattagcggtgcaattgttgacggggtctatgatcattggcgcactagcaggctttatggtattcacttttgggggcgtgattgcgtggaaagagacgcatgatgtgttcacaagaggcgtgcatatgatggcgatgattggctttatcatgatttctgcggctggttttgccgcggtgatgaaagccactggcggcgttgaaacgctggtcacatccctttccaccagcattggtgacaataaagctctagcagctctgctgatgttagtcgtaggtttgttggtgactatgggcatcggctcgtcattctcgaccattccgatcatcgcgaccatctatgttccgctgtgtctttcgtttggtttttccccaatggccaccgttgctctggtcggtaccgccgctgcgttaggagatgcaggatctcctgcgtccgattcaaccttaggcccaacatccggcctcaatgcggatggtcagcacgagcatatttgggaaaccgttgtgccaacctttattcactacaacctgccactcattgtcttcggttggattgccgccatggtgctgtaatctcagctaaccgagagtcaaaccatcacctcatcccctcacccaagcgtagcggtcgtgagggggataacgaaaaaggcttcccgcaggaagcctttttgatgattatccgaacccgtttgtttgcttaagcgccttcgttatgcagctcaaggttagccagatcttgttgaatttcacgctgcactttcgcgtcatcactgcgcatcgactcgagaaaatctaagtactgctgatcgatgtcacccgtcacgtattcgccattaaagaccgaagcttcaaacttgacgatatcagggttgccacagcgaaccgcttccaccaaatcctctaaagtttggaatatcaaggcatcggcaccaatctgcttacagatagcatcgttatcacgaccatgagcaatcagctcattggcacttggcatatcaataccatacacgttcgggaagcgaatctcaggggcagcagagacgatgtagactttcttcgccccagaatcacgagccatctcaatgatctgctctgaggtagtgccacgcacgatagaatcatccaccagtagtacgtttttatctttaaactctgagcgaatcgcattgagtttgcggcgtaccgatttcttacgttgctgctgacccggcatgataaaggttcggccaacatagcggtttttaacaaagccttggcgatatggtttatcaatcgcctgtgcaatttgtagggcgatatcacaagaggtttcaggaatcgggatgactacatcgatatcgagatcgctgtaatcatttttgatgcgctcacctaaacgcttacccatctctacacgagcgctataaacagaaatcttgtcgataaacgaatcagggcgcgcaaagtagacaaattcaaagatgcatgggttgagtgctggattatcggcacactgtttggtgtagagctcaccgtcgaaagtggcataaatcgcttcaccgggcgcgacatctcgcacgaagtcgaacccaaccgcatccagtgcgaccgattcggaggcgaccatatattcgagctgaccattgacttcacgcttaccgagacacaatggtcgaataccgtgtgggtcacgaaacgcaatcataccgtgaccaatgatcatcgccgccaccgcataagcacctcgaatggtacggtgaacattgctgattgcacggaacacatcgtcggcggtgacattgccctttacggtatcaatttcatgagccagtacgttgagcaacacctctgaatccgaagtggtattcacatgacgacggtctttttcaaacagcttttgacgcacttggttcgcgttggtcagattaccgttgtgagcaagtgtgataccgaaaggagagttgacatagaaaggttgagcttctgaggcgctagagctacctgcggtggggtaacgcacatggccgatcccgacgttgccttgcaggcgttgcatgtgtttcgcttcaaagacatccctgactaatccgtttgccttacgcagacgaaaacgattgctttctatggtacaaatacccgcggcatcttggccacgatgctgcaagaccgtcaaagcgtcataaattgactggtttacaggcgttgtacccacgattccaacaataccacacatgtcctaatcctcgatttcaaccgtctccggcgctaaatcgcgccagagagaaaacttgatgttgcttttaggtgttcaaagaacggagcaataacgcgactgaattcaggcactagctgcgagcttttccaccactctgtatttggaaatgcggtaaacgcatccatgaagaacagacctgctgcgacaatcaacactccacgtagtgcaccaaacaccacaccgagaattctgtcggttcctgagagtcctgttttttcgaccagttgggcaatcacgtagttaacgatagcaccgacgatcaatgtcgccacaaacagagccgcaatcgccgctccattgcgaaacatgtcatctttaatgttggtgaaatacaccgccagtttggcgtagtactccgaagcgatataaaacgccccaaaccaaatcactaaagacaaggcttctttggcaaagccgcgaacaagactgatcagcgcagacaagccgatcacacttaaaatgacaatatctaaccagttcatgagttcttacatcttaagttggcgcgcattttaacagaaaaaaacgcgacgcaaacgttttcttatgggtttagtggtttgaatttgagcaattgacctttagcaccggtaattttttctaattccacgagttgggtttctaacttagattttgaaacatcaggaccaataatcactcgggtgaaatcattctcttgtttgacatgcgcttggtaaccacgcttttgtaagtcagccacgagattgcgtgcattatcggcatttttcagtgccactaactgaatgatccacgcggaatcttggtattcattcgtttctggaacctctgtgaccgtcacgggcacaggctgctctgctgccactttgactggcgtactgtttttcaccaccgtcggcgttactggtgcaacactggcttgattatcctgaccggtctgagtgacggaaaccggcgcttcaggtaaggcaatgtcatcttgcaccggatccagcacttcaaacttttctacctcgccttccggctgcggtttaattgggacgctggcaatctcttctttaaaatgcgttttcttaccatcaagcacatcgggcagcacaatcacgccgatggcgaccaacactatggtgccaactaaacggctttgaaatttactggccatttattcccctctcttttgccaatgttcaagcacttcacctaccgtatggaaagagcccgcaactacaatgacatcttgtgccccagcctgtgtcaacgcggcttcaaatgccgacacaggattggcatattgagtaatatccgcaggtaaatactgacagagctgcgccgcagtagccgcacgagggccagacaacgaagcgggataccaatgtgtcaccgccgggcttaactcgaccaccgttgaagcaatatctttatcatgcaacatcccaaacaccagatgaatggtgcgctctgggtagcgttgtgtcagttgctgaaccagataatgggctgagtgcgggttatgtgcgacatcaagcactatcgtaggttgatggctaatcacctgcattcgtcccgctaattgggcattccgtagcccatccacgatattaatatcgctgatggcaagcccagagcaacccagcgccattaaagccgttgccgcattcggtaacggcagagatgggataggaagatcggtcaattcaaagcggccactacgccaattccaagtcgttgctgaggttttctcataactaaattggatttccacctgatgcagtttagcgccgatatcatcggcatgcgcagcaacggttgcgggtggcttaggctgcccacaaatcgcaggctttcctgaacgaaagatgcccgctttctcataaccaatcacagcgatgtcattgccaagccaatcggtatgatccagcgctaagctggtgatgacactgacatcgtgatcgacaacgttggtcgcatctaaacggccacccaaccccacttcaagcagcaacacatcgactttctgctgctcaaaaagataaagagcggcgagtgtaccgaattcaaataggcttaagcttatgtcaccgcgctcttgctcaatatgcgcaaacgcttgggtgtgcatctcatcggcaagatcttggccattgatgcgtacacgctcgttatagcgaatcaagtgcggagaactgtacacgccaacggaataacccgcttgcagtagaatcgcttccattaatgcacaggtggaacctttaccattggtgcccgccaccgtgataacggtgggcgctggtttggtgagtttggctttttgagcgacggcttgaacacgttctaggccgagatcaatggcggaagtgtgtatgtgggctaaataatcaagccacaccgcgagtggagatgtggcttgaggaacaggcttttgagtcatctaacgtacaaccatagaatccgttggtttagttagcgcttactttacccttttttattggcttctggtaccgcataaggcacttcatttggcgcgtcgttcacagaaactacgagaggagacgcttggccagtcattttcgccagtaagctagcgacacgctgacgcatgtctcggcgatcaacgatcatatcaatcgcaccatgctctagcaggaactcactgcgttggaaaccttccggaagctcttcacgtacggtttgctcaataacgcgacgacctgcaaaaccgatcaatgctttgggctcaccgatattaatatcgcccagcatcgccaaactcgctgacaccccgcccatagttgggtcggtcatcacggaaatgaaaggcaagcctttatccgataaacgctctagcgcggcactggttttggccatttgcatcagagacattaatgcctcttgcatacgcgcaccgccgctggcagagaaacagattaatccgcagttgtgttcaatcgccgcttcaaccgcacgcacaaaacgagcaccaaccacagaacccattgagccgcccataaaagagaactcaaaggcacacgccacgacaggaacaccaagcacagcacctttcatgacgaccagagcatccttctcaccactggctttttgcgccgcagcaagacgctctttgtagcgtttagaatctttaaatttcagtttgtcttgtggctcgagctcttcacccagctcaacacgctcaccttgatccagaaacgtttccaaacggcgacgtgctttcatgcgcatgtgatgatcacacttaggacaaacttctaggttacgctccaactccgcgtaataaagcacttgttcacacgatgtacatttagtccaaacgccttctgggatagaggctttgcgtgaactgacgatgttgcttttctctaaaatcttttcgagccaactcatggaagaccttttactctcaatctcccgccatcagcaggagagataaattcgacaaaaaatgcgtgtggattaaaacacagaaaatgccaactgtagacaaaaaactggttgtacctatttctgcgctttagccaaagcacaatattgtttatttttgagtcaattactagctgttagttcaaattatcaggcaagaaaagtggcccaattggcatttcgggcaacccaaaatgcgcagggtaatcaacagaaaccaagtagagcccctccgctttggccgtcgccgccgctaaggtgcgatctttttgtgccaataaccattgaatccactctggcttctgctcaccacgcccgacggctatcaagctacccgtgatattgcgtaccatatgatgcacgaacgcattggctttaatatcaatcaccacataacgaccgtgacgcgtcacattcagatgcatgacgttacgccaaggactacgggactgacaatgcaccgcacgaaatgaggtgaaatcattttcccccagcaagtactgccctgcttgctgcattttttcaacatccagctcgccgtggtaatggctgacaccagaattcaaaatccccgggcgataaacatggttgtaaatgacataacgataacggcgtgcagtggcactgaatcgtgcatgaaattcatcaggaaccgccatcgcccagcgtactgcaatatccttcggcaaattcgcgttggcgcccatggtccaagcgaccatctgccgttcggcggtggtatcaaagtgcaccacttgcccagtaccatgtacccccgcatcagttcgcccagcacactgcacttccactggatgattggcaatcttactcagcgccttttctaacgcttcttggacacttttgacttctctctggcgctgccaaccgtagtagtgagtcccgtcatactcaatacctaacgcgattctcatgctgtttgtctcaataaaaatgggtcgggaagtataaacagtttgccagtaaatttctaatcactacaaaagtaaaaggcagctaagctgccttttaaagtgtcgaaagaatcagagggagctacactcgcccattcagcacatcgatcagccgtttagcttgttggcgaatctcatcatcgccgtcaacaatcgcctcttcgagcagtttaatcgcccctttctcatcgttcatttcaatgtagattttggccaaatccagcttaccagctgcttccgcaccactatccacatcaatatctcgaatatcaccaatcacatcaggaaactcatccagacccacatcaagcttaagctcctcttcatcaggatttaagccttgctcttccgattctacctgtgccatgagctcgtcgatggtcatgtagccatcacgctgtgggtcgaaatccagcaaatcctcttgcgatccccagttttcaggcttcgcttgcggctccggtgtttcactcgcccaaatcgcttgctcatcctcaggtacatcatccggcaactgcgcttgctgatctggggttaggtggaaaccattccaatcttcgccgcccatttgcaacatggcatcaatatccatgcccgcgctatcaatcgttttagcatcaagtggacgatcaaagctaaacggtttttcaccatcgggattatcactcagccaatcgtgcagcgcttcttcatcaaatgccttgttagccaaagattgtgtcggtggcacatcttgagtcgcgcccaaaagttcaggctgaacctcgtctactgcgctttcaacactggccagtaaatcctcatcggcaaccagcgcatcactttctgtctcttgtgctagcgtttctgtctcatcaccgagctctggctcaacttccgattcagcggcaggctctaactgtgcatccgccaaggcgtctttttcagtgtactcaggcaaatcgagctcatcaagctcagtaaaggagtcttcctcttcgagaacgcttgccaactcaagctccggctcaacttctgattcggcggcaggctctaactgcgcatccgccaaggcgtcttcttcggtgtactcaggcaaatcgagctcatcaagctcagtaaaaggtttctttctctttcgagatcgcttgcagctcaagctctggctcaacttccgctcggcgcaggctctaactgcgcatccgccaaagcgtcttcttcggtgtactcaggcaaatcgagctcatcagctcgggaaggcttcttcctcggctgctcagttgccagctcagctctggctcaaacttcagattcgacggcaggctctaactgtgcatctgccaaagcgtctcttcggtgtactcaggccaaatcgagctcattagctcggtaaagggttcttcctcttcgagatcgcttgccagcctcaagctcggactcaacttccgattctgcggcaggctctaactgcgcatccgccaaggcatctcttcttcggtgtactcgggcaatcaagctcattaagctcggtagaggcttcttcctcagcaggcttcactgctagctcaagctctctggctcaacttccgattctacggcaggctctactgcgcatccgccaaggcatctctcggtgtactcaggcaatcgagttcatcagctcggtaaaggctttcctccgtgactggctcacttactaactcaagctctggctcaacttccgattcggcggcgggctctaactgcgaatccgccaaggcgtcttcttctgtatactcaggtaaatcgagctcatcaagctcggtaaaggcttcttccgcagctggctcacttactaactcaagctctgactccaacttccgatctgtggcggactctaactgtgcatccgccaaggcatcttcttcggtgtactcaggtaaatcgagcttattaagctcggtaaagcttcttcctcggctggctcacttgccagatcagctcgggytcaacttccgattctrcgrcaggctctaactgcgcatccgccaaggcatcttcttcggtgtactcaggcaaatcgagytcatcaagctcggtaaaggcttcctccgtgactggctcayttactaactcaagmtctggctcaacttccgattctgcggcgggctctaactgcacatctgccaagacatcttcttcggtgtactcgggtaaatcgagttcattaagcgcagtaaggtcactttcatcattagatgcttctgcagccaacggctccgactcaggctcaatttcggtctcaacttgttgttcgtcgaatgcagaagacggagtgacttcagccaattgaggctcatcattctcttctggcagctccaaatcgttaagagtgagaggctcctcgacagactgagaaagcccgtcaggggctaacgcatcatcagacgtatccactgtatttgattgcggctgcgcagccaaatctgccagtaattcatccgccgtttcatttgtggcggtagtctgctctggcaaatcatcctcagccgaagatagctcaagctcagcattaccctctaaagttggtgaggagtcatcctcatcaaatacccaatcctcatcttgaggagtaccaaactcattggcgggtagcgcacttggctgcgataaatcgtcttccagaccaccttcaatttcaggattgaaatcaaaatcatccgcttgtgcgaaagcttcattttcatcgagtacaggttcaagtaacggatcttttgcgggtgccgagttgagtaagtcgtcaatgaaggtatcgctattaaactcatcttcggttgccaactccgggagtgattctgctgactctggatgctgctcaatttcaagcaactcatcaaaaagctcagtaccatcttctacactgagtttttccggtgccactgagaattctgtagcttcgatggattcatcatccaagtccagatcatccagtaattcatccaaaagctcagtgctgttttggtcaatttcaagcccagaggcaagctcttcgggcacgggttcccccaacacctcattgagtaactgagtgctatcttcctctaaatctaaaatgggctcttcgggttgaagaagatccgcagtttgggcatcaaactcatcgttttctggcttatcaaaatcatccaacaactcatctaaaagctcggtactctcttcgctcagaggagcatcttgttcagcgagtatttcatcaagtaatgccgtttcatctatcgctttggcttcaagttgctcaaggtcagcttgctcttcgatagaggcaaacaggtcatccaaatcttggtcacccgctacgcctgcaccactgagatcaaattcgtcatcatcctcttcactgagcgacgccagctcatcattgagtagcgtatccaaggtttcggtatcttggatcgcgggttcatcatctaatgcgtcgagttcactggcgagtaagtcatccagcagcgattgatccactttgccatcgctaagcagctcattctcttcatcaccggataacagcgcttcgatgtcatcctccgacatttgattttcatcagccaagtcaaaagaattcagatcatcgttgtcggttggttcactaacatcatttagcgcgcgctccatctcctcaagtccgagcgctttatcatcagcgttaacagaaatgccgttggcactttcatttagagcatcaaattcggtatcgagatcgccatcatcatcaattcctacaaacagatcatcgctgtcctgtccatcaagattgaaatcaagatcggtttcgttcagatcggcgaagacatcatcttcatccgagaacgctttttcagcgtcattttcttctttgtcgtcggtggtactgaagaggtcatcatccaacagcaggtcatcaccaatatcttccgtctgttctggacctaaagtgacaggcgccgcggttggcatttcagaagtgatattgttttgcgttggattctcttgctgagcacttgagcggcggttaagcagcagaagcaccacgatagcaataagcagaccggggattagcgctaacaatgccactaaccagccattagaaagcaaattatctaaagctgatggcgcaagacgcgaagcttcttccgctttacggcgctcttcttccaacaatctctcgacttcactgcggatgcggttctcatcacccagctcttctttgagagtactgacttccgattgcacttgcgaaagcatcaagcgcaaggtgtgattcttctcttccagagccatcacttcagcatctgttgattggctgggtttagcgggcgtcttgagctcagtaggcgctttctcttgcggcgcggtcgtaggggtgacttgaggtggcgtttgcgcgaccgcttctacttttggcgttgcaacaggagcaggacgtggaggagctacaggcctcactggcgtatcgggtgtttggtttaattttgcttggtgagacgccatgatgttgacagcgtcttgagtactattgcgactgatttgtgccagtgacggaacacgtagagtactacctgggatcagagtgtgaatattctgattttcaaacgcctgaggattgagctgataaatggccaataacgtttgttgcaccgtgacgctggaagaaggccgtaactggctggctatcgaccacaaagtctggttggctgaggtcggcccgaaaaatcgaccgggttcattattagccgaattgcgaacaatattttcactatattggggcgtaggttgtacttggccatcagggccaacaagacgaatgctttctgcactgacgaaagaagtctgagtcacgaccattactgccactggcagcaggagtcgttggaaaaatcgacgcataaaaggctcagtatgtgctttgaattttgaagtacggagattggttaaatatatcggatccacctagcaaaactatagactggctggcaaaaaatgtgtcacgaccggaataatcgcaggaatctcacacaaatttcagtcctagcgtgaggcaacaccgctttctccacgcctaaaaacaaagccagcacgttggctggctttgcattttactctcgtttttcggcttactcttcgtcaattttggcgaaactatcgcgcaaaccaacagtgcggttaaagaccaaagcctgcgggctagagtctttgttatcggcacagaaatagcccatacgctcaaactgataaccaaattcaggttttgcttccactaagcttggctcaacataaccttgaacttttaccagagattctgggttaatggtttcggcaaagttatccgccgcacctggattgggtacagtgaacagacgctcgtagagacgaaactcagcaggaacgcctttttctgcagatacccagtgaataacacctttcactttacgaccatcggctgggtttttacccaaggtttcaggatcgtaagaacagaagattgtggtgatattaccttgttcatctttttcgatgcgctcagctttgatgacgtaagcaccacgcagacgcacttctttgcctaacaccaaacgcttgtatttcttgttggcttcttcgcggaaatcttcgcgttcaatccacaactcacgggtaaatggcacttcgcgatcgcccatctcaggtttgttcggatggttagccagcgtcaaagtttccactgtgcctgcggcgaagttctcaatcaccagtttaaccggatccagaacggccatcgcacgtggcgcattttcgttaagatcatcacgaatacaagactctaatgcactgtattcaatcatgttttcttgcttagtcacaccaatgcgcttacagaattcacgaatagcgcttggcgtgaagccacggcgacgcaggcctgaaatggtcggcatacgtggatcatcccaacctgtgaccaatttttcggtcactagctggttcagtttacgcttagacatcacggtatattcgagatttaagcggctgaattcatactggcgtggatggcatggaatcgtgatgttatcaagaacccaatcatacagacggcggttgtcttggaattccaaagtacaaatagagtgcgtaatgccttcgagcgcatcagaaatacagtgtgtgaaatcgtacatcggatagatgcaccacttgtcacccgtttggtggtgttcagcaaaacgcacacggtacaaaacaggatcacgcattacgataaaagacgatgccatatcgatttttgcacgtagacaagcttgaccttctgcaaattcacccgcacgcattttttcaaacagcgctaggttttcttctacgctacgatcgcggtatgggctgtgcttaccaggctcagttagagtgccacggtattcacgaatttgctcaggcgtcagttcatccacatacgccaagcctttttgaatcagctcaatcgcgtattcatacaacttgtcaaaatagtcagaggagtaacacacctcacctgaccaatcaaaacctagccaagtcacatcttttttgatcgactcaacatattcaaggttctctttttctgggtttgtatcatcaaagcgcaggttgcactgcccttgataatcctgagcaataccgaaattcagacagattgacttggcgtgaccgatgtgcaggtagccattcggctccggcgggaaacgagtatgcacggtcgtgtgtttaccatccgcaagatctttatcgataatttggcggatgaagttcgatggacgagcctcagcttcactcatctatagcacctcaaaattcatttagtattgtcagaaagcgtttctgcttcttgtaccatcaaggctagaaaacagaaaatattgccgctaatcatccacaattcttgcggtgggcacaataaaaactatggatttcttgtgattatttctacggttcgatgcttatatcgccacttctcaaacgggaaataagtaaaaagccttcgctttcgcgaaggctttgattcaggctagggtttaaactcgattaaggcagtttaacgtcagaaagatcttctttcgggctgatggctttcatctcacccgcgacgatttctgctagagggccaaggataacttgcaggttattttcacccagtttcacaacacctttcgcgcccagtttcttcagtaccgcttcatctgcaacagagcggtctttcagagtcagacgtagacgtgtgatgcacgcatcgatagatgtcaggttttcatgaccacccagtgctttcaggtattggcgagccaaatcacctttagatgcatcagcggagtctgtttctgtttccacttcttcgtcttcacgacctggagatttcaggttgaacgcacgaatggcgaatgtgaacgtaaagaagtacagagcaaagaacgccagaccaatcacaaacagagttgcaggtttcgttgctagaccccagttcaacaggaagtcgataagacctgctgagaaaccgaaaccatgcagtgtgccaaacatgttagccacaaccagtgacagacctgtaaataccgcatgcattgcatacagcgcaggtgctaggaacacaaacatgaactctagaggctcagtgatacctgttaggaatgaacagaacgcaacagagaacagtgcaccacccacttggtgacgacgctcagctggagcggctaggtacatagcaagtgcagcacctggtagaccgaacatcatgacagggaagaagccgttcatgaataccccagcgctcttatcgccaccgaagaaacggtgtaggtcgccagatttaaccacttcagtcacttcttttaccacagctgtgatttcaggcgttaccgcatttttgaacgcaaaagtatgctcttgacccacaactagggttttcgctagagctggatccacacacagtttttcgagtgcaggcagtgcttgaccagcggcttgagcacctgaaactaggatctcttgacaggtacccatgccgaaccagaagtaagagttcagaacgtggtgtaaacctacagggatcagagcacggttcagagtaccgtaaacaaattggcctaaagcacctgatgtagagacggcatgcgccagcgcatctaatccaccttgaattgatggccagataacgccagaaagcgcaccagcaaccagagcgaacagacccgccataattggcactaaacgcttaccagcaaagaatgctagccactctggcagacgtgtagtgtggaacgcgttgtaagagtgccctgcgatgatacctgcgaagataccgccaaagaaagacatgttgattgaagcatcaatcgtttttgccgttgcactcagaacaaagtaagctactgcacccgctagacctgcggcgccagatccatctttcgataaaccaatggcaatacccaaaccaaacagtagtggcagctggctaaaaattgcatcgcccgctgcagccatgaatggaatgcctaacaggtctggttgacctaaacgaagtaagagcgccgctacaggtagcgtagcgataggtagcatcaatgctttacctaacttttgcgcatatccaagaatattcaccttaagttccccctataggatttttgtatagtattgagagactttttttagtcgcccaatttagtcctggtcagtttatgacattaattttgctccgcaaattaaaacctcatcatttgtgatcctaatcacccgtggttctaagaacgaaatgattttgctagccagatcataaaacttattttatgatgtaaaaaaacaacttttggacgctaatattacagcgtttgttggtcagacagtcaccgtgttacactcgttaacatagtgcatttctcttaatgcccttaggttaaacaccgcgaagagtggattgaccaatgacttatttttagccgcagttgctgtggccttttgcacaaaagataattcgcgacctgattgaagtgaagcagcttgcgctttggctgtaacctcggtgagtcgctaaaatgaatctaaaaatatcgacaagaggattagctgattatgtatgcgctaacgaactgcaaaatctacacaggcaatgatgtgcttgtgaaacatgcggtaatcatcaacggtgacaaaattgaagccgtttgccctatcgaatctcttccatctgagatgaatgtggtcgacctaaacggtgcaaacctcagccctggttttatcgatttacagctgaatggctgtggtggtgtgatgttcaatgatgaaatcacagcggaaaccatcgataccatgcacaaagctaaccttaaatcgggctgtaccagcttccttccaacgctgatcacttcttccgatgagaacatgcgccaagcaattgccgccgctcgcgaatatcaggctaaatacccaaatcaatcgcttggtcttcatttagaagggccttatctgaatgtcatgaaaaaagggatccacagcgttgacttcatccgcccctctgacaatacgatgattgatacgatttgtgccaatagtgatgtgatcgccaaagtcactctcgcgccagaaaataataagcctgaacatattgagaagctggttaaagcgggaattgttgtttccattggacacacaaacgcgacctatagcgaagcacgtaaaagctttgaatccggcattacctttgcgacccacctctttaacgcaatgaccccgatggtaggtcgtgaaccaggagtggtcggggcgatttatgatacacctgaggtgtatgcgggcatcatcgccgatggcttccatgttgattacgcaaacatccgaattgcccacaaaattaagggtgaaaagctcgtattagtgaccgatgccacagctcctgcaggcgctgaaatggattactttatttttgtcggtaagaaagtatattaccgagatggcaaatgtgttgatgaaaatggcacgcttggcggttcagccctaacaatgattgaagcagttcaaaatacggttgagcatgtcggtatcgctttagatgaagctctgcgaatggctactctgtatccagcgaaagcaatcggtgttgatgagaaactcggtcgtatcaagaaaggtatgatcgccaacctgactgtttttgatcgtgacttcaacgtaaaagcgacggtagttaacggacaatacgagcagaattgataatgaatggcggacagattggtaacgtagatttagttaaacagctaaacagtgcggcggtttaccgcttgattgaccaacaaggcccaatcagtcggattcaagtcgctgatgtaagccaactggctccggccagtgttaccaagattacccgccaattgcttgaacgtggattaatcaaagaagtcgcgcaacaagcttctacaggtggtcggcgagccatttcgctgaccacagaagtcaagccgttccactctattgccgtgcgtatcggacgtgactatattcaactcagcctctatgacctaggtggaaactcactggttgatgagcatcatgaatttcactacaacacgcaagacgtgttgatgtcgagcctgattaaacagatcaaacaatttattcaacaacacaccgcattaattgatcagttgattgcgattggtgtggccttacccggtttggtgaacccagaaacaggtgttgttgagtacatgcctaatgtcgcgatcaatgaattacctctcggcgcaaccattcgtgatgagttccatgttgaatgttttgtgggtaacgacgttcgtggtattgccttagcggagcactatttcggagcaagccaagattgccaagactccatactagtcagtgtacaccgtggcacaggtgcagggattatcgttaacggtcaagtcttcttaggctataaccgcaacgtcggtgaaattggccacatccaaatcgaccctcttggtgagcaatgtcaatgtggcaactttggttgtctagaaaccgttgcgaccaaccctgctatcacttctcgtgtgcaaaaactgatcgctcaggggtatgaatcttcgctctctactctcgatacgattacgattgatgatgtctgtgagcacgcaaatgctggggatgaactggcgaaacaagcgttggttcgtgtaggtaatcagttgggtaaggcgattgcgattaccgtaaacctattcaacccacaaaagatcgtgattgctgggcaaatcaccgccgccaaagagatcgtgttccccgcgattcaacgcaacgtagaaaatcagtcactgaaaacgttccaccaacatctgccgattgtgtcttcacaagtctacaaacaacccactatgggcgcttttgctatgatcaaacgtgcgatgttaaatggggttctgttacaaaaattgcttgaagactgagctttttagttaagcttacgcaaccgattgacctataatgacggtggtatttttataccaccgtttttttattattaaattaagaatatagctcatggatttgatacttctttctgccgcatttttagcaggttttatcgctttaaaatgccatttaccgccgctggttggttttttgattgcaggttttgcgctcaatgcctacggatttaccagtaatgataccctttctctgctcgccgacttaggggtaaccctactcctttttactatcggtttgaaactggaagtcaaaactttactcgccaaagagatttgggcagggtcaaccattcataacttgctctctaccgcactgtttacgcttctcttactcatttttaagcagttagggctcgatagtctggcggatctttcttttgataaactcattttgatcggatttgccctatccttctctagtaccgtatttgccgtcaaatcgctgcaagaaaaaggggaaatgaatgcgacctatggcaccttagccattggtattctggttatgcaagatatctttgctgtggtgttcttaaccgcatcgaccggcaaactcccagaatggtatgcgataggcttatttgtactccctttactccgtccgctcttttatgagttattggattgggtcggccacggcgagatgttggttctgtttgggattttctttgcattggttgtgggagccggatccttccagctcgtcggaatgaaacccgatcttggagcactgatcttagggatgatgctcgccagccaccacaaagcctctgaattatcgaaagcactatttaatctcaaagagctgtttttagtctgcttcttcctgaacatcgggctttctgctcacccgactaccacaggaattatgctcgctctactgctcctgttactgctaccaataaaaggcgtgctgtatttttgggtcatccaccagttccatttccgtgtccgcacgtcactactggcctcgctatccctattcaactttagtgagtttggcctgatcgtgggtggacttgctttcaaaatgggctggataaacagtgacattctggtggctctcgccgtttccgtccccttatcgtttatcttagccgctccgattgaacgtaaaggacatgccatttatcaacgttcggccaaatggctgaaagagcaagcggctgaatccttacacaccagggatcgcctaattgatcctggagaagcgcaagttcttatcttaggtatgggacgtatcggccgcggcgcctatgaagagctcacttcacgtcacggggaaatctgccttggggtagaaattcgtgaagaggcggccaatagccatcgtgaagaaggccgtaatgtgatttctggcgatgcaaccgacccagatttttgggaacgcattttcgataccggcaaagtcaagctggtgctgctggctatgcctcaccatcaagctaaccaaattgcccttgagcaactgcaaaagcgccactatcaaggccaaatcgcagccattgcagaatacccggatcagatagaaagcttgcttgagcatggtgctcacgcagcattcaacatttacagtgaagcgggtactggttttgctcgccatgtatgcgaacagctcaaaccaaacttcactcgccgctaaaagatagggcgaatatcgccctatcgtttcttttttcaccactttttaaagctcatttaaacaacacgaagattaaatagaaaatttccaatcaaaatctttttatttaaaataaaactcaacatggggttgaagtttttaatcagaatggcaaattaagtccaacagattaaaaaacatttaaaaggaattcatatgtgctctatctttggcatcttagacattaaaactgatgcagcaacgctaagacctatcgccctcgaaatgtcgaaaaaactgcgccatcgcggtccagactggtcaggtatctatgcttctgataaagcgattctggcccatgagcgtctggccatcgtgggtttaaatagtggcgcacagcctctttatagcccagatcgtaagctcatccttgccgtgaatggtgaaatctataaccacaaagaaattcgtgaacgttacaagggtcaatatgaattccaaaccgattctgattgtgaagttatcttggcactataccgcgataaaggagctgatctcctcgaagaactcaatggtatttttgcttttgttctctacgatgaagagaaagatgaatacctgattggacgtgaccatatcggcatcattcctctttatcagggtcatgatgaacacggtaacttctatgtagcgtcagagatgaaagcactggttcctgtgtgtaaaacattgagtgagtttcctcctggcagctacttgagttcaaaagatcaagcggtgacacgctactatgtgcgtgattggaatagttttgatgaagtcaaagataacgtcagcagcaaagaagagttaactcaagccttagaagctgccgtgaaacgccaactgatgaccgatgttccttatggcgtactgctatctggtggcctggattcatcgattacctctgcgattgcgaagcgttttgccgcaatgcgtattgaagatgatgagaaaagtgcggcatggtggccacaacttcactcttttgcgatcggcttagagggggctccagatcttaaagccgcacgtgaggttgcagagaaaattggtaccgtacaccacgaaatgacttacaccattcaagagggacttgatgcgattcgtgatgtgatttaccacatcgaaacttatgatgtcactacgattcgtgcttctactcccatgttcttgatggggcgtaaaatcaaagccatgggcatcaaaatggtgctttccggtgagggagcagacgaaattttcggtggctatctctacttccataaagcgccaaacgctaaagagtttcacgaggaaaccgtacgcaaactgctggcgttgaacttatttgactgtgcgcgtgccaacaaatcgctggcagcatggggggtagaaggtcgtgtgcctttcctagataaagaatttattgatgttgcgatgcgcctcaacccagccgataaaatgtgtggtaatggcaaaatggaaaaacacatcctgcgtgagtgctttgagcactatctgcccgagtcgattgcatggcgtcaaaaggagcagttttctgatggcgtaggttatggctggatcgatacgctaaaagctaccgcagaagcgaagatcagtgatcaacaaatggaaactgcgaaattccgtttcccatacaatactccaaccaccaaagaaggttatgtgtaccgggaaatttttgaggaactattcccacttgaatctgcggcacgctgcgtaccgggaggcccttccgtcgcttgctcttcagctaaagcgattgagtgggatgagtcattcaaaaactgtattgacccatcaggccgcgcggtgaaagccgtccacaaacaagcctactaagacttgaagttctagccagcagcgctgctgcttcaagtagggcgagtatagtgattaaaaaagccagagtgatgactcattctggcttttaattctttcatcacccgatgattcatcaacagaaaaatcaagacggtaaagataagattaggtgacttcccaatcggtattttcaatactcattggtacttgctgactgatcatcttcaccagcataatcgagcgagtatcaccatccggctctaaataaatcgcttcaatgcccgcaaactgacctcttgcgactcgaacggtttgccctttttctggcaattgtttggtggcgtgcttcaattgctcacaatcaagctgtttcaattgataaatcaaatcgccttgcagttcacgtggatgaggccccaagcggacaaaatctacgacaccacgcgtagaacgtacggtcgtaaatgaaggtccattttcgaaatcgaaacgcacaaacatataagaagggaataacggctcctgaaccatttgccgcttaccacgtagaattttttcaacgcacacttcggggtagaagcattcaacactttgattttctaagtgcatcttcgcgcgctgctgctcgcctcgtttgcagtaaagtagataccaacgtttcatttatattctgttatgccaacctttttcggcatgctaccacacccacagagcaaatatgaaatgcactcttgtaaaaagcgttgagtcccccgcacctgatttaaatgcataaattagcttaatctgtgcattttccaagcaaacatccagtaagaaatcgcctaccaaaacaataaaaaacacaaattaatcatatcgatagattcaacaaacccatcaaatggagcattcacgcccaagtttggtggcaagtcctttttatgaaaaattagtttgcgcgacaaaaatcacgattcatttctcggaagttttattgattttcattgagttacatttatttacaactgaattctgagaaaaccagtattgctcatcatttattttgaatgtataggtatcagccgaataaaaaactctcatggatgagttgaataaatataatgtttgacggttggagcttcacaacagacttcaaccattgcactgcacaatgatacaggaatgcttatgtccaaccttaatatctttaaacaaccgaatgccttctatttgatcttctctatcgagttttgggaacgatttggcttctacggtatgcaagccattctgacggtttacatggtcaaaattatgggcatggatgagtccgcttctttcgtactcttcggtgccttttcagcgttagtgtacggctttgtcgcaattggcggttggatcggcgataaagtcattggaacaaaacgtgctattactctcggcgcgattgtcatgatggtcggttatgttctgcttggactctccaccgcagatcatccgcttgttgggccaacgttaatctacatcgcgatgggctttattacggttggtaacggcttgttcaaagcaaacccttcgagtctacttgcaaaaatttacccagagaatgatcctcgcttagatggcgctttcaccatgtactacatggcgatcaatttaggctctttcttctcaatgatcattactccacttgtagcaatcaagatgggctatggaatggcatttggagtgagtgcagtcggccttgccatcactgtggtgaacttcctattttgcttacgcatgttaaaaggcacaggctctccagccgaccttatgccggtgaacaaaatgtatctggttcttgtcgccgtgggttctatcattgccagcctagtgtgtagctacttactacaaaacctcaccctagcacacggtattttggttgttgcgggtctgtttattctgggatgttattttaaagaagcgttctctatgtctgggattgaacgcgccaaaatgctggttgccttcatcttgatgctgcaaggcgtcgtgtttttcgtactctatttccaaatgccaacttcactgaatttctttgctatcaataacgttgagcaccatatctttggttttgatgtcgcgccagagcagtttcaagcactcaatccgttttggattatgattgctagccctattttggcggcgacttacggcaaactgggcgataaattggcgatgcctttcaagttcgctttcgggatggctttatgtgcgctctctttcttagtattaagctggggaaccttgtttgctaacgaacaaggcatcattagctcaaactggcttatcgcaagttatgctttccaatccatcggtgaactcctagtctctggtcttggtttagctatggtcgcgcaattggtaccacaacgtatgatgggttttgcaatgggtatgtggttcctcacttcggcctctgccgcggtcattgcaggttgggtcgctagcctgacttcaacgccggctaatgtgtctggcgccaccgaatcactgcatatttatggtgaggtatttgcgcaaattggttatgtgacagccggaattgccatcgtcaccttcatgattgctcctaagctgactcgcatctgccgcggtgaatcagagccgttagagctggtgacgcaataaagattgaatcataaatacgccccgtgaaactgaaaacagcgccgaatgaggcgctgtttttgtatggctgctttatggatgactcgctcacattggagcttaacaatcgactttaaccagcgcggccatcagctcaatatggctctgactgtcattcaaacagggaacatagtggaacgcttcgccaccactgtgcaaaaagatttcttggttctgctcagcaatttcttccagcgtttctaagcagtccactgaaaaggcagggcaaataacatcaagctttttaatgccttggcgaggaagcgcttccatcgtcttgtccgtgtatggttgcagccactcttccttaccaaactgagattggtaagtcatcatgactttatcttgaggcaatcctaatgcttgagccaataactctgtggtttttaggcaatgctctgggtagatatcgccattttgcgcataacgtttgggaataccatggtaagagcagagtaacagatcaccttgtccatgttgttgccatgaagcacgaacgcttttcgcgagggcttggatatagagtggatggtcatgataatcacgaataaagtgcaattcagggactacaggtaactgacgcaacgctttggcgagaccatcaaacaccgccgccgttgtcgtcgcggaatattgcggataaagcggcagcaccactatctgttcaacaccttgttgctgcaacttgcgtacaccctccaataaactcggctctccgtaggtcatccctagctcaacaggccgttggctaagctctgccaatttatcgcgttgacgtcgagagtagaccatcaaaggcgatccctcatccatccagattgattgatacagcttagccaccttaggcgatcgcgttggcaagataatgccatgtaaaagggggcaccataaccaacgactcatgtctaccactcgctgatcatgcagaaattggctcaaaaacgcttttaccgcttgagaggttggcgcttgcggagtacctaagttggcaagcaaaatgccaagttttttatgattattcatggcttccttcaaaatgcactgttgaatacgttattacgtctctttctggtaaaaagtttataaaaaaagcggctttactgccgctttatttcacctatcaatgcaatcagcacatcacaataatgattaagccaacgctttagcaatgtcagcactcacttcgctcacttgcttagtgccgtcaaacttcaggtattgagttttacctgcagctgcttctttaccgtagtattcaataagtggcgcagtttgggtgtggtaaacattcagacgcgcacgtacggtttcttctttgtcatcttcacggatcacaaggtcttcacccgttacgtcatctttaccttcaactttaggtggattgtacactacgtggtacgtacggcctgaaggtagatgagcacgacgacccgccatacgctcaacaatcacatcatccgctacgtcaaattcaatcacatagtcaacattgatacccatctcttttaggccatcggcttgtggaatcgtgcgagggaaaccatctagcaggaaacctttctcacagtcagcctgagcaatacgctctttgataaggcctaaaatgatgtcatccgataccaattgtcctgcatcgattaccgctttcgcttgcttaccgagctcagtgcccgccttaatggctgcacgcagcatgtcaccagtagaaatttgtggaataccaaatttttccatgatgaattgagcttgtgtgcctttacctgcacccggagcaccgagaagaatgatgcgcatgttttatcctcatactaattgatttttataccgaagctcacagcgcttgcaaatactcacggtaagtttcggtataacagacagaacagcccgcacagcgagctggcgtgcaaaaatacacgcgttaatgaccacattcaagtgccgcattctatcacagaaatcgtttggcataccgctctaagactaaagaatgtgatgggtaaaattgagatagacctcatgatactgacgcaaaacagccattcacctgtttagtcactaatccgtccttcgatagctcaaaggcagaaaaaagcccgccgaagcgggcttaagatgcgatagcaaggacttagtggctaggtgcaagcagttggtttactgcacctaagaattgtgatggatcttccatcgagccacgttcggcaagcatagcttgacccagtagcacttccgcccaacggccaaaagtttgctcatccgcttcatccgccatgcgttttaccaaagcatgttcagggttaacttcaaggatgtacttcacttcaggcacaggctggccggctgcggccaatagtttcgccatttgggtacccatttcataatcatcggtcaccacgactgctggtgtgttagccagtttgaatgtggtacgaacctctttcactcggctacctaaatagcctttgaggcgttcaaccacagacttaaattgctcttccgtctctttatgtttctctttttcggcttcatcttcgaactggctgagatccaagcctgctttggtgatggactggaacgctttaccctcaaactctggcaaataattcatcaaccattcgtcaatgcgatcaaacatcagaatgacttcaatcccttttgacttaaactgctccaagtgtgggctgtttttcgcagcggtatagctgtctgccgtcagatagtagatcttgtcttgaccttctttcatgcgctcgacataagaagcaaggctgatggtttgctctgccgaatcgatatgagtagaggcaaaacgcagcaagctagcgattttctcgcggttagcaaaatcttctgccggaccttctttcatcaccaagccaaactctttccagaatttctggtaattgtcagcatcattgctcgccatgcgctcaagcatagtcaatacgcgcttagtacaagcttggcgcagtgactgagtgatcttgttatcttgcagaatttcacgcgatacgttgagcggcagatcgtttgagtcaatcaaaccacgtacgaatctcagataagaaggcatgaattgcgccgcatcatccataataaagacgcgttgcacatacagttttaaaccatgcttatgttcacgattgaacagatcccaaggcgctttagcaggaatgtaaagtaagctggtgtagtcatttttaccttcgactttgttatgactccacacgagtggatcagcaaaatcgtgtgatacatgcttgtagaactctttatattcctcatcggtaacttccgatttagcacgcgtccacagagcttgagccttgttgatctgctcccatttggtttcttctgtcgctttcccttcttcatccatcactgaggtttggatatagacaggaataccgatgtgatcagagtatttggaaatcacatcgcgcaaacgccattcggacaaaaactctttaccttcttcacgcagatgcaaaatgatgtctgtaccacgagactctttattgatagtttcaaccgtgtactcgccctcaccttttgagtaccactgtactgcatctgctggtgcactacctgcagcgcgagtccgcaccgtcaccgcatccgccacgatgaaagccgagtaaaaacccaccccaaactgaccaatgagctgcgagtttttagactgctcttgagaaagttttgagaagaattcagccgtacccgatttagcaatcgtacctaagttttcgatcacttcatcacgggtcataccgatcccgttatccgaaatggtcaacgtatttttgtctttatcaaaagagagttttacgcctaattcagcgtcgccctgatagagatcaggatgagaaagcgcttgaaaacgcaacttatcaacggcatcggaggcgttagaaatcaactcacgcaggaaaatttctttgttggagtacaaagagtgaatcatcaggtgcagcagttgtttaacttccgattgaaaaccacgcgtttctttattagtggttgcagtctcgctcataatcgctccgtttacttctgtttcaaacaattgatccattgagactcaatggaattaccttgatgtrcaagtgagatatggacaaaaaatgtaaattcaaggtcaaaactcataaaaacactgttttttgatcgagattggattattctaagtctgcatttttatcaaagaagataaaaaaaccagtaaagtctgagtgttgggacagggagatactgggacattagatgttcggattaggacacaactcaaaagagatatcgatgagtcatattggtactaaattcattcttgctgaaaaatttacctttgatcccctaagcaatactctgattgacaaagaagatagtgaagagatcattcgattaggcagcaacgaaagccgaattctttggctgctggcccaacgtccaaacgaggtgatttctcgcaatgatttgcatgactttgtttggcgagagcaaggttttgaagtcgatgattccagcttaacccaagccatttcgactctgcgcaaaatgctcaaagattcgacaaagtccccacaatacgtcaaaacggttccgaaacgcggttaccaattgatcgcccgagtggaaacggttgaagaagagatggctcgcgaaagcgaagctgctcatgacatctctcagccagaatctgtcaatgaatacgcagagtcaagcagtgtgccttcatcagccactgtagtgaacacaccgcagccagccaatgttgtgacgaataaatcggctccaaacttggggaatcgactgcttattctgatagcggtcttacttcccctcgcagtattactgctcactaacccgagccaaaccagctttaaacccctaacggttgtcgatggcgtagccgtcaatatgccgaataaccaccctgatctttcaaactggctaccgtcaatcgaactgtgcgttaaaaaatacaatgaaaagcatactggtgggctcaagccgatagaagtcattgccacaggtggacaaaataaccagttaacgctgaattacattcacagccctgaagtttcaggggaaaacataaccttacgcatcgttgctaaccctaacgatgccatcaaagtgtgtgagtaggatcttgctatgcaaaatagacacatcgccatgggtattcttctgctctctctgctgctcagtagctggttatattgggggagtgacttcaagcttgagcaagtgttaacctctcgagaatggcagtccaaaatggtctctctgattaagaccaacagcaaccgcccggctatggggccactcagtcgggtagacgtcacttccaatgtgaaatatctgcctaatggcacttatttacgggtttcaatcgtaaagctattttccgatgacaatagtgcagaaagcgtcattaatatctccgaatttggtgaatgggatatcagcgataattaccttttggttacgccagtcgagtttaaagatatttcgtcaaaccaaagcaaagactttactgacgagcaattgcagctgattactcaactgttcaagatggatgcacaacaaagtcgtcgagtcgacattgttaacgaaagaaccattctctttaccagcttaagtcatggttctaccgtactgttcagtaattcttaacctgactgagcgtagaataggacataacaaggacgtcacgatgaacaaagcccaaatcgagatttattactgccgccaatgcaattggatgctgcggtctgcctggctgagtcaggagctactgcataccttcagcgaagagattgagtatgtcgccctgcaccccgatacgggcggacgcttcgagattttttgtaatggcgtgcagatttgggaacgtaaacaggaagggggatttccagaagccaaagtgctgaagcaaagagtgcgtgatttaattgatcctgagcgcgatcttgggcatgttgatcgcccctcttctacgcaaagttaagcgatccccaaacgactcagaataaaatacggccaacaccgctgcagcttcaagtcgcaaggggatgtcgaactttagatttattgaaggaggcaactggccagcgtttcgccagcaaccgatatcaccttcattgtatcgccttccagcacgccatagctcgcggcatactcaccgcggggaaacgtcatagaacccgggttaactaggtatattgagccaacttgttcggccacaggaatgtgcgtgtggccatgcaccaaaacatccccatcgctaagcggcggcagcttatctttatggtaaagatgcccatgcgttaaaagtaagcgtcgccctgaacttaacagtacccatgctgagtcactcatcataggaaaactcaacagcatctgatcgacttcactatcacagttcccacgcacagcaatgatctgctgagcaaactgattcaatttttcagcgacggctacagggttgtacccttgcgggataggattacgtggcccgtgatttaatacatcgcccaacaaaatcagagattgcgcccccgatgcttgataaagcgcaagtgcttgttcggtcgcagataaagaaccatgcagatctgagacaaaaaatagtttcatggttaacctcttaaaaaacactgggtaattgtaaggctttcttttctaccgtgcaccgttgttttgtcacccaactcaccgtaaacaaactctatcttaggatgaataaacctagccaacagcgctacgatcttaaataaggaaccgataccgcttcaaattgagcaggataaacgggtaaatgcccgcataacccatgagccagatttgacaaagccccctttcactcttcactatttcaatactgcgttatacccaaacgacttggagtttcaggtaggcggcaagtgagaaatcaccatgagcatagataaactatgtgattgggtgatcaagcgtagcctgcaccgcggcaacttcaagtaaaaaaggtatagttcgaatcaccgaacccgcttcacacaaggagtcaccatgagaattttaattactggaggaaccggatttgtcggttttgagctgataaagttgctcagtagtcatgagctgctggttctcacgcgtgacctaaccaaagccgctcagcgctttgcgcacattccaagtcagaatctgcaattactgcgctcgttagacgagctctctgatttcaacgggatagatgccatcatcaatcttgccggagaaccgattgccgataaacgctggagcaaaagccaaaagcagcgtattgcccgtagtcgcctagacatcacggaacaattagtcgagaaaattcacgctagcgctcacccacccgccgtatttttgagtggatctgccgtgggtttttatggcgaccaacaacagcatgcctttgatgagagccttcaggtaagaagtgaccatttttctcaccaagtttgccaacagtgggaacagcgcgccctcaaagcacaatctgaacagacgcgggtctgtttattacgtacaggaatcgtgctagcaccggaaggtggggcactcaaaaaaatgcttcccccttatcgactcgggttaggagggccgattggagatgggcaacaatacatgccttggatccatatgcaggatatggtgcgcgccatcctttttctgcttgaaaccgaacacgctcaaggtccttataacctttgtgccccacatcctgtgaccaatgccgaattcagcctcacattagccaccacattgaagcgtccgcacctttttaaaacgccgcaatggctcataaaaatgttattgggtgaagcctctgaattgctgctcgatagcattagagccaagccgaaaaaactgaccgaccttggctttcagttccactattcacgcattgatcgagcctttaatcagctccttacggcatcacaataagccataacggacacaagcaaacgcatacataataggattgcgatgaccaaatcgattttcattactggctgctcaagcggcattggttacatggcggcgaaacaattgcagttacggggttatcaggtgatagcatcatgtcgtgatgcacaagatgttgcgcgcctatcccaagagagtttgacctgcattcaactggatctcacctgtgaagccagcatcaaccaagcggtagagcaagcgctagaactttccaaccatcggctttatgcactgtttaataacggagcttatggccaaccgggcgctttggaagacttacccgtacaagctatgcgcgaacagttcgaagccaatttttttggctggcatcatctgacgacccgcttgcttcctcactttcgtcgtcaaggttacggacgcattattcaaaacagctctgtacttggctttgccgccatgaaataccgcggtgcttacaatgcttccaagtttgccatcgagggctggacggataccttaagactggagttgcaagggtcggatattcatatcagtttgattgaacctggtccgattgaaactcaatttcgcgccaatgccttacacgcctttaagcgctgggtaaacatcgaacaaagtgttcaccacctcgcctaccaacaacaaatgcaacgtttgagcaaaacgcactccaacaaccgctttgtcttaccgccagaggcttgtctagcaccactttgccatgctctggaagcacgcaaaccgaagatccgttatcgcattacgacgccaaccaaagtctttgcggtattaaagcgacttttacccacacgctggctagacaaattattatttaaagccgcataaattatttaattgtcattatttggtaacaattgcgcggcaaacttcataatgctcactggattaactcctagacattgagtaaaaacatcaatatctatcaagcgttgcatgtggttcgacaaaaaatgacattaaaccaatggaattggatcggtgtcggtgttgcgctgaccttatttatactgctttaaacacctttgcttgctcgctcgtaagagccacaaaatcaccaccttcgggtggtgattttgttttaatcctgcatatatcaacctcttgcatcactgttcgacgactcagttcaaacaagagaaccgctcccatcacgcgatcactttatctagtaaggaacttacctaggcttgagttttgaagccttcatccccatagtttattcagcgatgtgccatccaaaccaaggatttgctatgcaagcagcgaagattattgacgtttctcaacataactttcaccaagtgctccaacactccaccctctcaccagtacttttttatttttgggctccaataagccatgagagtgccgagctgttacccgcgattgaacaactcaccgaacgttatcaaggagcctttgttcttgcacgcttaaattgccaagaagaacaagggattgctgcgcagtttgggatccaagcgattccgaccattgcgctgtttattgaaggtaaacccgtcgatggattaggcggcccccagccaattgaagcggttgaggaaatgcttaagcgtcatttgccaagcgatgaagagcgcctcatgtaccaaggattcgagcttgcagagcaagagcaatttagtgaagcattatctctgctcagcacattgagtgatgagtggcgtaataaaggtgaggtcaaactcactctagctcgctgttatctagaaaccggcgcagtagaagcggcgcaaaccgagctggccaacatgccacttgaataccaacaaggtgaatacaaaacgctgatcgcgagactcgaattacatcaacaagccgcgaatagcccagaaattatcgctcttgagcaagagtggaatagtgacccgcagaatcccaatattgctatagagcttgccaaacaatatcaccatgtcaaacgcgacgaggaagccctctccttactctggtcttggctcagtaaaaatctaaacaccttagatggtgaaatgaaaaaaacctttatggatatcctaaccgccctaggtcaaggtcatccattagcgaatcagtatcgtaaaaaactctattcacttctttactaacccaagtccagccgattcacgacgtgaagcatacagccaacacggcggctgcttgaaataggaaaagacatatggcgctctaatatgagcgccatatttatatcctcaaacgacttgaagttgcaggtaggcggcaaataagtgaatcccctccagcatagatacactatgcgattggggtgagcgaatgctgccaacaccactgcagcttcaagcaggaagtataatcatcagctataaaattgattgttaacccttctctaggatagtaaatcgcattagttgctgttaacttagtcacaagtcactgattgggaacgttttcggctatttttttaggcaagaggcgctcattcttagctgactaaatattcgctcatcgctttaacggcaagtagcaagctattactttaaaaaacaaggatacgtcatggctattgattcattgatcactatcgcagttctcgtactggctgtggttattttcatctcctctgcagtaaaaaccgtgcctcaaggtaataactggacggtcgaaagatttgggcgctacacacaaacactcaagcccggactcaacctaatcatcccttttattgaccgtgttggtcataaaatcaatatgatggaacaagttttagatatcccagctcaggaagtcatttccaaagacaacgcgaatgttgtgattgatgcggtctgttttgtacaagtcattgatgcagcgaaagccgcttatgaggttagccaactgcaacatgctatccgtaacctcaccctcaccaatatgcgtaccgtattaggttcaatggagctggatgagatgctcagtcaacgtgacatgattaataccaagctgctgtcaattgttgaccatgccaccagcccgtggggtgtaaaagtgactcgtattgaaattaaagatgtacagccacctgctgatttgaccgctgcaatgaatgctcagatgaaagctgaacgtaacaaacgggcggaagtccttgaagcagaaggggtacgccaagcgcaaatcttacgtgcggaaggtcaaaaacaatccgaaatattgaaagctgaaggggaaaaacaagccgccattttacaagctgaagcacgtgagcgtgccgccgaagcggaagccaaggcaaccactatggtttcagaagccatcgctaaaggtgatatgcaagcggtcaattactttattgctcaaggctataccgaagcgctgaaagctattggtcaagcagagaatggtaagatcatcatgctgccacttgaagcaacaggcctcatgggttctgtcgctggaattgcagaaatgtttaaatcatcacaaaccactaagtaggtgccccgtggtagagctactctcacaattgaatttctggcattggttggccttgggcctacttctattagccgctgagctactcggcactgcaggttattttttgtggcttggcctatcagcactattagttggggtattgctggccgtaatgcctcttggttggcaactgcagtggctggcttttgcgagtttttctctggtcacgacttggctttggtggcgacgtcaatttagccgagataaaaagcaagatacagaacgcgaccttaaccagaaagaaaaacagttactcggacgtattattccgataactcaagataccccagcaggagagtttcaagtaacactgggtgatacggcttggacagcgcgctgcgatcagcagcttgcggctgggagccgtgtttctgtcgttgctgtggatgggattatcttagtcgtccaacctatctaaaagtctatcattctgtaggcaacttcaagtcggaactaagatcctacggggtcttagttttattgtttgaacaacaatgtcccttcaactgttctatgattgggcaatcgctgccttgatctccgggacaagatgcaatccactcttctagctgctgcttaatcatggtgagctcggagagttttctcgagatttcttgccacttttcttgcgctcgcgcgcgcaccgctgcgctcgttcggtttggatcattggcaagagtgagcatggctttacactcatccaaactaaaaccgactcgccggcagcgagcgatgagcagtaaatcatccacatgctgctgagtgtaagtgcgataaccactttcagagcgcagtggtgggatgatgagacctttctcttcgtatagacgaatcgacttggcagtcagcgaggtgagtttggcaatctggctaatattcatgacacataaaaaatcacagaggcatggaaagaccatgcctctatccagcgagaaatgcaattattcttggctaatcaaccaagagagaatcgatgctttttcggctttatcggcttttttgtaccaatcagccatcatttcgaccaacttattttgtgtaaccataggctgggctacctctgcacggttagcaaaagcccagttagcaaattcttggcgctctgctgaactggcttcaccaaacaaatattggatcatttcgttaggtttggatgcggttggttgcgcttgaacagcaacaataggagcaacaggtgccacatctgtcccttgtaagacaaatttcgcctcattaataaccgctaaaaaatacgctttaggaaccgtgaattctacttggtttttgtctgttgacgaggacagcgtaaacacaactgaatccgagttcagttgctgaatatattcttgagataatgggaacttaaaccattgcgaggtcgtgcaatgttcggtacaggtctcagctaatggacgatatgtttctacttttaacttctgtgatgaataagcaacagtgtcatattggtcataatttttaaaataagtgacgttcatatcaacgtatgaattttcaatattaacgccttcagctttagggaaattaccgacatagcttaactctgcttttacaatatcaggtcctacaattgcttttgcgtcaggagtaatatctttcgcgacaacttgaacatagttgtgcctttctttgacattcttcgccacatcattgaacacactcgaactgtctaaattactgcatccaacggccatggtgatggttgagaataatatggtcgttttaaataaattcatcatttatgtccttgtttatggagtaaaaacaccggcacaaggccggcgtttttattaaagaaaggcagggttcgtctgattagaaaccgtattccagacctacacgtacgaaacctttcttgtcggctgaatcataagcatcatgctggccaacacggatgtatggtacgaaaccatttttcacgtacatcagctgtgcagacaatacttcatcatcatctttttgttcaacaccgttcacttcagactcaaggttggcagcgtaacctactttaaagccccatgggccattccagtattgaccaatcagagagtattggccttgctcgccttcttgacctttcactgttttagaagcaccttcagtgtacttataagcaccagctaaaccaaaaccagcaggtagaggcaactcaaaacctacgatatacgctgttgcatcagtcaggaatgtattatcgacatctttaccagctgtatctttggttttgtagtcatacttgaagttagagttgttttcataaccaacatggaacgttacgatatccgcagcattgtagtgtgcagccgcaccaaagtggttagaacttttagtacccacatcaccacgaccagcagaaatgttgaacgtcagaccaccgaaagctggagagtcataacgcgcaatatcacctttacgatcatagtgaccagcaacgtcgccaccccagtcgaatacacgacctaaacctgggttagagtatggccagtcaacgatttcatatagtggtgtcagcatacgaccgaaacgtactttaccccaatcgccttgtaggccgaggaaagtatcacgagcaccaagcgtgctgcctttaccatcttcaccaacgtaacctgattcgatctgcatgaatacgtttacgttatcaaacatatctttgctagcacggaaaccgatacgagattcgttttcgtagtcataaccgttgctatcttcttggtagaaagcagagattgctgcaacaccgtacgcttgtacgttgaaatcagacagaacaccgattgcaccagtttcagatgcggcaaacgcaccagttgacgccatcgctactgctgcacccagaagagtacgtttaaacattttgtccatggataactcctaaaaatggatatagctgttttttgagtttctcccttaagttggccgccgaagggagaagtcatttccttttcgagtatcgaaaccgattctcttagttgttggcacactgaccgtgtatccatatccgtagactaactctcggttagaaaacatcaatcagaacttaatttttatctaaaaaaatatgagccacggcaaacttctggggagtaagtgatcgagatccaattattactagcacaaagccagggcaaatctaaccaactgataaatataaatttttattattggttaatgtcttttatttgaaatgcgtcgaataaaaacaaaatgagggatgacttttaaaaacaataaaagtcctgaacttgatataaattggcgagttgtttctgagcaaaaataaaccccagcacaggctgaggtttagacttgggatgagcaagaagttcaatctatttataaaaaatgcagcagatccaacatgaaacataccgaatcgagttggaattgtaggtaggctgcaagtaaattcatccctataagcataggcaggcgatgttggagtgaacacacatcgccaacaccactgccgcttcaaatattaagtgaataggcttatttcaaaaattcgattaatgcttgctcatcgaaaacttggatacccaactcggtcgctttggctagcttagagcccgctgcttctcctgcaaaaaccatatcagtattttttgatacgctcccagtcaccttagcacctaaagcttgtagtgcggctttcgcatcattacgagacaattgagtaaaactgccggttaacacaacaattttgcccgctagagcagagtctaccgccacgggcgcagccgttagcgctggccatgtgatgccttgttctagcaattcattgatcacttgttggttacggtcttgcgcaaagaaggcctgtaaatggcttgcaacaaccactccgacatcgggaacttcgataaattgttctaaactcgcttgttgaatcgcttccaaacttaaaaagtgctgagccaagttgagtgcggtagcctcgccgacttcacgaatacccagtgcatataaaaacttaggtaatgtggtttgcttcgctttattgagagcatcaatcacattctgcgccgatttggggcccattcgctccaaaatcgtgagctctcccgctcttaaccggaataaatcagcaggtgtactcaccatttctctgtcaaccagttgctcaatcactttatcgcccaagccttctacatccatggccttgcgagaaacaaaatgcttcaatgcctctttgcgctgagcttggcaaatcagtccaccggaacatcgagcaaccgcttctccttcaacccgttcaacatccgattgacaaactgggcaacgagtaggaaatacaatagattttgcattctcagggcgtcgctctaataccacagagacgatttgtgggatgacatccccagcacggcggatcaccaccgtatctccgaccatcactcccaaacgctcaatctcatcggcattatgtaatgtggcattacttaccgtaacaccaccgacaaacacaggctccaacttagcaaccggggtaatcgcaccagtacgacctacctgaaattcaacatcattgagcaaagtaagctcttcctgcgcaggaaatttataggcaatcgcccagcgcggcgctctagccacgaaccccaatcgctcttgcaactggatatcgtcaactttaatgacgacgccatcaatctcataagccaaagactggcgacgttgcaaaatgtcttgataaaaagctttgacttcggcgagagaagttaccagtttggtttctggacaaatcggcagcccccagccctttagttgtaaaaatcgttgatagtggctggtcgctaactctccgccttcaataacaccaacactgtaagcataaaaagccagtggacgttgggcggtaattttggagtcgagttgacgtaggctccccgccgctgcattacgagggttcacaaactgcttttcaccttttttaagcgctcgtgcgttaagtgcttcaaaccccgctttaggcataaacacttcaccgcgcacttcaaggcgagttggaaaatctgcgccttgcaggcgtaaagggattgatttaatggtacgtacattttctgtgatgttttcgccggtcgtaccatcaccacgagtcgccgcgcgggtcagaacaccattttcgtatagtaaactgaccgccaagccatccagtttcggctcacaacaaaaggcactatgctgtaccgccgggatccgatccgtcatacgacgataaaagctttctaattcaccatcatcaaaggcgttatcgagcgataacatcggaatttcatgcacgacagattcaaaagcatcaagcggacgtcctccgactcgtaaactgggcgagtccgagctcatcaattccgggtgagccgcttccaattccagcagctcgcgcattaagcgatcgtattctgcatccggaatgctgggggcatcttctacgtaatagcggacaccatgctcatgcaaggtttttcttaattctgttaatcgttgcgcgacatctgacatcgtaattctctcggatgatgaaaaaaggctccgctacggagcccttttagtataactagggatatctctatcttgttactgacgaagtaaagcagcgcgctatcgcgtggtgcttgaatgaatacccaaaacttaggcttgagcggctcgaactttaaactcttgaatttgcttacgataagcatcaagtcggttcggagtcattaagttacgagcatcgtccaacacatgcccaccaagatcatcggcaatttgttgagcggtttttagcatcaacttgaagttttgctcaggatcgccaaaacacggcagtgtcataaaaaaggagatgcctttggttgaaaagtccgcaggatcatcatgcataagggtaccaggttgcatcatattcgcgacactaaacaacactttccccgttccagagagatccgcgtggcgatggaaaatatccatctcaccaaataacaaaccattttgctgcatgctatcgaacagtttggtcccgataaaaggctggttaccagcacagtgtacattgagcacaatcacatccagcttttcttcctgcggctcttgtacctcaatctcggtcaccacttcaggttgcaccttagccattggcacgtttggcgcaactcgaggcatctcaacctggggctgaacctttctaggttgaggttgggattgaggctgaaccggaatgcgcgcttcctcatcctcttcttcatccagctcatcatgggccgcgaaatcagagatcagaggatcgtgctgttgattcggaatgccaaaatcaggctctttgcgttccttgcggatgatttcgaaatcgtcttccgccgcaaaggcacgcgaaggcggatcatcactttcgactttcatcttgcgcagaggtttatcaccaaacttggactttccctcttttttgctggtccacagaccatgaaacagcaacgccgctatcgccaacgcgccaacaattatcaatacgaatcgcagttcctgcatcttaaactctcagtatcccgtttgatgttctgagctctagcgcccgacaggacgtttatcagggtgtgtttttgacttgtcggggtactttaccaaaactctcgttgaatttagaacaacttaatgtgagaagttgaaaagatgacgcgttttttgcagtttcgtcatttcacttcagtatcaatcaagtacaatcttcactcggtttatcaaggagaataccgtttttatgcagatcagctcacgttccgggttcggctacttctcttacggcatacgtttggctttaacgccaggcatacgtcggttcgttgttcttccgctactggctaacatcatcttagtcggcggtgctatgtactacttattcagccatttagacacttggatcagcgagtggataggacaattaccttcgtttctctcttggctaagttatgtactttggccgctgttagcattaaccattctcgctactttctcctatttttttagtaccttagccaactttattgcctcgccatttaatggtctattggccgaaaaggtggagcagcatctatcaggtgaacgcatcggtgaggaaggcgtctgggcactggtcaaagacgttcctcgaatccttagtcgagaatggcgtaaactgctttacgtgcttcccaaagcacttggcttattcctgctactactgatcccagcacttgggcaaaccctaggccctatcgcttggttcctgtttacggcttggatgctggctatacagtattgcgactatcccttcgataaccacaaaatcagcttccatgacatgcgtaacactttgaaacaaaatcaaagtaaggcctatggatttggtatgctggtcgcttttttcacaagcattccgattgtgaacctcttcatcgtcccagttgccgtgtgtggcgcgacggcgatgtgggtgatggaatttaagatacaacactcccctctgcgccaataacaagcaccacataagttataactttttaatccttttcgcttagtgaatatgaacttattctctgtccatattcactaagtattcacgcacactcactgcgtaacgaatgaaggaacatcgccatgagcaaaatctacgaagacaattcactgactattggtaacactccactagtgcgcttaaacaaagtctctaacggcaaagtgctggctaagattgaagcacgcaacccaagcttcagcgtaaaatgccgaatcggagccaatatgatttgggaagctgaaaagcaaggcaaactcaagcctggcgttgaattagtagagccaacaagtggtaatactggtgttgccctagcgtttgttgctgcagctcgtggatacaagttaactctgaccatgcctgaatcgatgagtttagagcgtcgtaagctactcaaagcacttggcgccaatttagaactgactgaagcagcaaaaggcatgaaaggcgcgattgcgaaagcagaagagattgttgccagcaacccagaaaaatatttgctcctccagcaattcaataacccagctaacccgcagatccatgaaaagaccacaggcccagagatttgggatgcaacagatggtcaaattgatgtgtttgttgctggtgtgggtactggcggtacattaacgggtaccagtcgctacatcaaaggcactcaaggtaaagctattctttctgttgcggttgaaccggctgaatcaccggtcattacacaagcgctggcgggagaagaaatcaaacctgctccacataaaattcaaggtatcggtgccggttttatccctggtaacttagatttaagcttgattgatcgtgttgagcgtgtcacctcagatgaagcgattgaaatggcgcgtcgcctaatggaagaagaaggcattctcgcggggatctcttctggtgctgcggttgttgccgctaaccgaatcgcacaattgcctgaatttgaaggaaaaactatagttactgtgttaccaagttcaggtgaacgttacttgagcacagctctattcgcaggcattttcactgataaagaaaaccagcagtaatacgtggttaaatcaaattttcgtttaaaaaagccccagtcaggggcttttttgttgatccctgcctcacctttggtaatatcggcatgttttatttttagcttcaaaataaagaagcagacggtttacgctcaattgctcaaattgcaaaaaatagcaaaggcgattgataaaattttgaccagtcttagttctaacacgaaaagcctgtgacagtgctagcacaaagcagtttatgcggttaagctaaatctggttaacaaacttacaaaaaataaactcattggggtataaaacatgtacgagaagcaagtagaaatcactgcagaaaacggccttcacactcgtcctgctgcacagtttgttaaagaagcaaaagccttcgatgcagacatcactgtgacttctaacggtaaaagtgcaagcgcgaaaagtctgttcaagctgcaaacgctaggtctggtaaaaggtactgtcgtgactatctctgccgaaggccctcaagcaaaagaagctgttgagcacctagttgctctgatggaccaacttcactaatccggtcttcctttcaaagccattttgttcacgcaaaatggctttgttggaaataacccgagaaatacgctaaacgttacggttagcgattgtccactctcccgtttacagttgaccagtttaaggtaaggctatgatttcaggcattctagcatctccaggtattgctattggtaaagcattacttcttcaagaagatgaaattgtcctaaacacaaacaccatttctgacgatcaagtagaagccgaagttgagcgcttttacactgcgcgtgacaaatcttctgcgcagttagaagtgatcaaacaaaaagcacttgaaacttttggtgaagaaaaagaagccatctttgaaggccatatcatgttgcttgaagatgaagagctagaagaagagattttagccctcatcaaaaaagaaaaaatgtctgccgataacgcgattcataccgttatcgaagagcaagccactgcgcttgaatctttagacgatgaatatctcaaagaacgtgcaacagatatccgtgatatcggtacacgttttgtaaaaaatgctctgggcatgcacatcgtatcgctgagcgaaatcgatcaagaagttgtccttgttgcctacgatttaacgccttctgaaactgcgcagattaacctgaactacgttctcggttttgcatgtgatattggcggccgtacctctcacacttctatcatggctcgctctctagagctgccagcgattgtcggtactaacgacatcactaagaaagtgaaaaatggcgacacattaattctggacgcaatgaacaacaagatcattgtgaatccaactcaagcacaaattgaagaagccaaagcggttaaagcggctttcttagcggaaaaagaagagctcgctaagctgaaagatcttccagcagaaacgctagacggccatcgcgttgaagtgtgtggcaacatcggtaccgtgaaagactgtgacggtatcatccgtaacggtggtgaaggtgtcggcctataccgtactgaattcctgttcatggatcgtgatgccctgccaacagaagaagaacagtaccaagcctacaaagaagtcgcggaagcgatgaatggccaagcggttatcatccgcaccatggacatcggcggcgacaaagatctaccgtacatggatctcccaaaagagatgaacccattcttgggttggcgtgccgtgcgtatcagcttagatcgccgtgaaattctacgtgaccagctacgcggtattctgcgagcctctgcacacggcaaacttcgcgttatgttcccaatgatcatttcagtagaagaaattcgtgagctgaaaaatgcgattgaagagtacaaagctgaactgcgcaccgaaggtcatgctttcgatgaaaacatcgaaatcggtgtgatggtagaaacaccagctgcagcagcgattgctcatcacttggcaaaagaagtctctttcttctctatcggtactaacgatttaactcagtacaccttagcggtagaccgtggtaacgagatgatctctcacctctacaacccactctctccagcggttctgaccgtgatcaagcaggtgattgatgcttctcacgcagaaggcaaatggactggtatgtgtggtgaattagcgggtgacgagcgtgcaacgctactcctactcggtatgggtctggatgagttctcaatgagcggcatctcgattccaaaagtgaagaaagtgatccgtaacgccaattatgcggaaatcaaagcgatggctgaagaggcgcttgccctgccaacggctgcagaaattgaagcttgcgtagataaattcatcgcagcgaaagcgtaattatcggttgataccaaggagataggcgatgaaaatagtcgtctatctttagcgattggtatactatacttcgacagaacaaatttaaaacgttaggagcatgacacaatgggtctgtttgacaaacttaagaagctagtctctgacgacagcgctaacgcaggtgcaatcgacatcatcgcacctctttctggtgaaattgtaaacatcgaagatgtaccagatgtggttttcgctgagaaaatcgttggcgacggtatcgcgatcaagcctgctggtaacaaaatggtagctcctgttaacggtactatcggcaaaatcttcgaaaccaaccacgcgttttctatcgaatcagatgacggcgttgagctgtttgttcacttcggtatcgacacggttgagctgaaaggtgaaggcttcaagcgtattgcagaagaaggccaatcagtgaaaatcggcgatactatcatcgaattcgatttggcactgctcgaagagaaagcgaaatcaactctgactcctgttgttatctctaacatggatgaaatcaaagagctgaacaaactttctggttcagtgaccgtaggtgaaacaccgatcctacgcgtgaccaagtaatcgcttggttcgatttaaaacgttcgatgtaaaaaacgctgcccagtgcagcgttttttgtttttacagtctagccttttgaaattgccaatacagcctaaatagggatggcttagtttgaaaagccgagagcgtaacgcagcacttgcgttttcaacggcccagagcgttcggctaaagcgagtgcaacattacgcacaaacctaactggcgtaaacgagttgctaaaggttttgtaaaacagatccatccccgtttgcatcagtaaattatcgggacgacggcagcgttcatagcgttcaaaagatgcctgatttaacgcctgctcttgagtttgcgccagcaacacggccacatctttaaagcccaaattgacgccctgccctgctaatgggtttatggtgtgtgctgcatccccaatcaaaatacagcgatttttcacatactgctgagcatgacggcgcgttaatgggaaagcaccgtgttgcaacactttaatattccccaactcggccgggaaatactgcagaatttcgctacgcaattgctccggattaagaccgctgagcttgcgaatacgctgcggtgtgtcataccacaccaaagacgcctgattgccgcccaaaggtaagtaggagcgcggccctgttggaaaaaattgctgccacgtggtttcttgttggatctgctccgtctgcacattaatcaacatacagtgttgacgataatcccacgccgttacgccgatacgcaccagattgcgcacctgggaatttgcgccatccgcaccgattacccaatcacactcaatttcagcgcccgattgcaaggtaacacggcatccctctgcactcacattcaactgcgccaattgttcgggacacattaaagtcaactgcggataagctgcaaattgctgccatagtgctaattgaatgactcggttttctaccatgtaacctaattgtggcaacccgagcgactcacaagaaaaacgcgttcgacattctgggtgttcccacgtttctaagtgacgataaggacaagcacgcataccaacaacacttgaccaagcacccagttcttctagcagtcctactgaagtttgcgaaatcgcagagacacgcacatccataggctgactcggctcaaaagcgtgcggcgcgccagaatcaattaccgcaaccttgcgtccttggcgtgcaaagcccagtgcagcagccgcgcccaccatgccgccccccaccacgaggatgtcaaatttgttgccactcataccttttcccacccagtattttctcttcacggcattgtacggagtaagggaaatattgcgacattttttacgttaaaaccttgctcgtaataaggtaaaaagccaatcacaacaagggttacaagagaattccgccaattactagtcagtcggtttttaaagcagtacaatacgccgcttaccgccgagagggcggctagaatgtgagctacagctcaaatgattgaagaactattgaacgagcgaaagtgagatgagtaagaaactgctaattaaaacttggggctgccagatgaacgagtacgattcatcgaaaatggctgacctgcttaatgctgcaaacggctatgagctgacagaaatacccgaggaagctgacgttttactcctaaacacctgttcgattcgtgaaaaggcgcaggaaaaagtcttccaccaactcggtcgttggaaaaccctgaaagacaagaagccaggtgtcgtgatcggtgtcggtggctgtgttgctactcaagaaggtgactcgattcgcgatcgtgcgccttatgtggatgtcatcttcggcccacagacgctgcatcgtctgccagaaatgattaaacaatcgcaaaccagcgacgcgcccgtgatggatatctctttccctgagattgaaaaattcgaccgcctgcctgagccacgtgcggaaggcccaacggcgttcgtttctatcatggaaggctgctcaaaatactgtacttactgcgtagtgccttacacacgcggtgaagaagtcagccgtcctatggacgatgtcctgttcgagatcgctcagcttgccgagcaaggggtgcgtgaagttaacctgctgggtcaaaacgtcaacgcttaccgtggtgccactcacgatggcggcatttgctctttcgctgaattactgcgtttggtcgccaccattgacggcatcgatcgtatccgctttaccactagccacccactcgaatttaccgatgacattattgcagtgtacgaagacacgcctgagctggtgagcttcctgcacttgccagtacaaagtgggagcgatcgcattctgactatgatgaagcgtccacatacggcgattgagtacaaatccatcatccgtaagctacgtaaagcacgcccagatattcaaatcagctctgattttatcgttggcttcccaggggaaaccgacaaagatttccaagacaccatgaagctgatccgcgatgtcgatttcgacatgagctttagctttattttctcacctcgtccaggcacacccgccgctgactatccttgcgatctgtcggaagaagtgaagaaagaacgtctgtatgaactgcaacagcagatcaacagccaagctatgcgttattcacgcctgatgctgggtactgaacagcgtattttggttgaaggcccctcgaaaaaagatctgatggagctgcgtggccgtactgaaaataaccgtgtagtgaacttcgaaggctcaccggatctgatcggtcaatttgttgatgtgaagatcgttgacgttttcccgaactcactgcgcggtgaactgctgcgtaccgaacaagagatgaatctgcgtatcgcgacctctccctctgaaatgaaagcgaagactcgccgcgaggatgagcttggggttgctacatttactccttaatctcgtatacactgtcaataagcgtccggtcacaatcggacgtttattgacatactgagaggcaaatttgagcaataaaatcataaccttagaaatcaatttagaaccatccgataaccaccgactcgccagcctatgcggtccttttgatgacaacatcaagcaccttgaacgtcgcttgggtgtcgaaatcaactaccgcggcaacttcttcactatcgtgggtcaacctcatactgccgctgctgcactcgacatcatcaaaacactttacgttgaaacggctccggtgcgtggtcagattaccgatattgaacctgagcaaattcaccttgccatcaaagaatccggcgtgcttgaacaacacagcgaatccagcattgctcacggcaaagaagtgtttgtcaaaaccaaaaaaggcgtgatcaaaccgcggacaccgaatcaagctcaatacttgatgaatatggtgacccatgacatcacctttggtgttggtcctgctggtaccggtaaaacttaccttgcggtcgcggctgctgtggatgcgcttgagcgccaagaaattcgccgaattctattgactcgtccagcggttgaagcgggcgaaaagctcggttttctgccgggcgatctaagccaaaaagtcgacccttatttgcgcccactttacgatgctctattcgaaatgcttggttttgagcgggtagaaaagctgattgagcgcaatgtgattgaggtcgctccgctggcgtacatgcgtggtcgtactttaaacgacgcgtttattattctcgatgaaagccaaaacactaccgttgaacagatgaaaatgttcctgacgcggattggttttaattcgcgcgccgtcattactggtgacgtgacgcaaatcgacttaccgcgcggcgcgaaatccggtctgcgccatgcgattgaagtgctcaatgaagtcgatgagatcagctttaacttcttccaagctgacgatgtggtgcgccacccagtggttgctcgtatcgttaacgcttatgaaaagtgggaagcgcaagatcaaaaagagcgcaaagagtatgagcagcgtcgtcgtgaagaacgtgaaaataaattactcgaaatgcagcgcgcggaaatgacgctgagccacaacaatgagtcgaatccctcatgagtattgaactggatttgcaattggcagtcgaaaatgaacatgggctaccaagcgaagcggagtttgctttgtggctcactcgaaccatcacaccgtttcaggcacaagctgaggtgacggttcggattgtcgatgaagcagaaagccatgcgctgaatttgaactaccgtggtaaagataaaccgaccaatgtgctgtcttttccatttgaagctccttcggggatggaaatggatctgcttggcgacttggtgatttgccgccaagtcgttgagcgtgaagcaattgagcaaaataagcctttgcaagcacattgggcgcatatggttgtacatggcagcctgcatctgctaggttatgaccacatcgaggatgatgaagccgaagagatggaatctctcgaaaccgaaattatgcaagagatgggttttaccgacccatatctggcagaaaaagagtaacccttatccttttagataaggcctatgtgagctatcacacatctgatagcgttagtgaattgagacataatgaacgaagacaattctcagaattcggaaggtccgagtagaaagtccttctttgaacgcctaagtcaactttttcagggagaaccgaaagatcgccaagagctggtcgatgtaattcgcgactctgaagtcaatgacttgattgaccatgacacccgcgacatgctcgaaggtgtgatggaaatcgccgaaatgcgcgtgcgcgatatcatgatcccacgctcacaaatggtcactatcgatcgtactcataacctagatgctttggttgccatcatgactgatgcgcagcactcacgttatccagtgatcagcgaagataaagaccatgtggaaggcattctgcttgcgaaggacttactcaaatatctaggctctaactgtgccccattcaacatccaagaagtgatccgtcctgcggtcgtggttccggaaagcaagcgggttgaccgtctgctcaaagaattccgtgaagaacgttaccacatggcaattgtggtggatgagtttggcggcgtatcaggcctagtcaccattgaagatattctggaagagatcgtcggcgacatcgaagatgaattcgacgacgaagagcaaaaagacattcgccaactgagcaaacacaccttttcggtgaaagcgctcaccacaattgaagactttaaccacactttcggcaccaaattcagtgatgaagaagtggatacggtcggtggtttggtgatgacggcattcggccacttacccgcgcgcggtgaagtcgtagacattgcaggctacaacttcaaagtgacagcggcggatagtcgccgagtggtggctcttcaagtgaccgttcccgatctggaagccctttcgcacgttgcggaagagtagtccccactctcttactaagtaagagtaaagaaaagagacgatgaacagcgtattatctcatcgcctaatgcggccgcttgcggccgcttttgttggcgtcataactcctctggcttttgccccgtatcaattttggcctttggctctactcagcccatttatcctactgcttctgctccaccaacaaagcgccaagcgagcggctttgattgcttatctctgggggattggtcaatttgcggtgggtatcagttgggtacacgtcagtattgatacgtttggcggcatgcccaaaatcgctagcctgtttttaatgactctattggtcggctatctggcgctttatccaagccttttcggctggctacttaatcgcttgtttccgaacaactcacgcagtaaatggttatgtgctgccccagctttgtggctgattaccgattggctacgtggttgggtgatgacgggttttccttggctgtggctcggttatagccaaattgatagccctctcgccaactttgcccctatcggtggcgtagagctcatcacgctgttattgctgttttgtgctggtagcttagcttatgccgtacttaatcgccgttggctgatggcttgcatccctcttgtggtttacgcaaccggttatggcctccaagccatgcagtgggtcaccccacaaactgagcgcacagcctcactggccttgattcaaggcaatatcgaacagggattgaaatggctgcctagccagcgctggccaaccatcatgaaatacaccgatcttactcgcgaaaactgggatgccgatgtgatcatttggccagaagcggcgatccccgcttttgaatatgaaatctcctcatttctgcataatcttgatgctgcggcacgtatgaaccaaagcgcggtgattactggcatcatcaatcaaagtgatgataagcagtacttcaatagcgtgctgaccgtcggtgatacgcctcatggcgaataccgttatgatctgactcagcgctaccataagtaccacttgttgccttttggcgaattcgtgccgtttgaagagatcctgcgtccattagctccattctttaatttgccgatgtcctcctttagccaaggggcttacgtgcaaccgaatttgattgcaaagggtttcgcatttgtcaccgcactctgctacgaaatcatcttcaatgagcaggtacgcgataatgtgacgccagacaccgacttcctactgacgctttcgaatgatgcttggtttggtcgttcgataggcccattgcaacacatggaaatcgctcgcatgcgcgccttagaattgggcaagccgctgatccgcgccaccaacaatggagtgacggccgtcaccgatgagcgtggacgcattatggctcagctgccacaattcgaaactggcgtgctaaaagcaacggtcaccccgactcgcggtagtacaccttacttcctatggggcacaacgccactctacctttgggtaggcttagcggctgggttcgctttctggcgccagcgccgggctagataagtaaaaacaaaacgggaagttatcttcccgttttttattgcagcgctttatccaactaaggtttcagtggttggcggctaaacgctttaccgccacattgcgaacaaggttcaatttccgttgggtgattaaattcggttttatgaccgcactgatcacagatcaacacgcccaaaccaatcatatctcccgcctgatacaagccttggtgttctaaatcagcaaacagctcgacccattccactttggtgcggtcggtaatatccagtagtccctgccagatggaattggtgatcatcagatagaatgggctgcttttgctttgctcaaaactttgcgagaactctttaaggtcagcttttacataagcggagatcagcgcaagctcatccttggtcaaatcattcgccgcatcgacgtatttcgcagaggattcaacgatctcattcacgccatctgggctgtgtttgagtgtttccactacctcttccagtaaggcttcataacttgctttctgttttggcatctctcacctctctcaagcctgatggctgccggattagctattgttgtaaccccctgctttctgtattctatgccgaaccgaaagacttcgttcctactgaactcacaaattccaagatggatgtcatcgatgcaagagcaatacaacccgcaagatattgaacacaaagttcaacagcactgggacaacaacaaaaccttcgttgtaagtgaagacccaaataaagaaaaattctactgtctttccatgttcccttatccaagtggccgactgcacatgggtcacgtgcgtaactacaccatcggtgatgtagtctctcgtttccaacgtctgcaaggcaaaaacgtactgcaacctattggttgggatgcttttggtctgcctgctgaaaacgcagcggtaaaaaacaatactgcgccagcaccttggacatacgaaaatatcgaatacatgaaaaaccagctcaagctactgggttttggttatgactggaatcgtgaattcgcgacttgtcgccctgagtactaccgctgggaacaagagtttttcactaagctgtttgcaaaaggcttagtgtacaaaaaaacctcatcagttaactggtgtccaaacgaccaaacggttctggctaacgaacaagtggaagatggttgctgctggcgttgtgacactccggttgagcaaaaagagatcccacagtggtttattaagatcaccgcctatgctcaagagctgcttgacgatctggataacctagacggttggcctgaaatggtcaaaaccatgcagcgcaactggattggccgctctgaaggtgtggaactgaaatttgccgttaaaggtgaaaacaccgatcttgaagtgtacaccacgcgtccagatactctgatgggggttacttatgtcggtatcgctgcaggccaccctctagcgacaaaagcggcagcgaataacccagcgctcgccgccttcatcgatgaatgtaaaaacaccaaggttgcagaagctgaaatcgcgaccatggaaaagaaaggcatggcgacaggcctgacggcgatccatcctctcaacggccgtgaagtacctatctatatcgcgaacttcgtgttgatggattacggtactggtgcggtaatggctgtgcctgcgcacgaccaacgtgactttgaattcgcgaccaaatatggcctagacatcatccctgtgattaagcctgccgatggcagcgagctggatgtgtctgaagcggcttacactgaaaaaggtgttcttttcgcttctggcgaatttgatggtttggatttccaagctgcctttaatgcgattgctgccaaattggaagcagaaggcaaaggtaagaaaaccgttaacttccgtctgcgtgactggggcgtgtctcgtcaacgttactggggtgctccaatcccaatggtgaccactgaagatggccaagtacacccagtaccagcagaccaactgcccgttatcctacctgaagatgtggtgatggatggcgtgactagcccaatcaaagccgataaagagtgggcaaaaaccacctttaacggtgagccagcactgcgtgaaaccgataccttcgacacctttatggagtcttcatggtactacgcgcgttactgctcaccacaagcggatgatattttagatccagaaaaagccaactactggctaccggttgatcagtacatcggtggtattgaacacgcgtgtatgcacttgctctattcacgcttcttccacaaactgctgcgtgacgcgggttatgtgaagagtgatgaaccgttcaaaaaactcttgtgtcaaggcatggtactggcagatgcgttctactacaccaatgacaaaggtggtaaagagtgggtgtcgccaactgaggttaaagtagaacgtgatggtaaaggccgcatcgtttctgcggtggatgccacaggccgtcaagttgaacactcaggcatgatcaaaatgtctaagtcgaaaaacaacggtatcgacccacaagagatggtcgataaatacggcgctgacacagtacgtctgttcatgatgtttgcttcaccagcggacatgacgttggaatggcaagagtctggtgtggaaggtgcaaaccgcttcctgcgccgcgtatggaaactggtgcgtgagcacactgagctcggccaagctcccgctttagatgcttcagcactgaatgcagaccaaaaagcgctgcgccgcgatgtgcacaaaaccatcgctaaagtgacggatgacgtagcacgtcgccaaacgttcaacacagcgattgcggcaatcatggagttgatgaacaagctgacgaaagcgccgatgaccgaagcgcaagatcgcgcgattctggatgaagcactcaaagccatcacgctcatgctttacccaatcacaccgcatatctgtttcgaaatgtgggtggcactgggtcaaagcaatatcgatacggcaagctggccgacgtacgatgaagccgcactggtcgaagatgaaaagctgatcgtgctgcaagtcaacggcaaactgcgcggtaaactcactgtcgctgccgatgctactcaacaacaggttgaagcgctcggtatgcaagatgaaaacgtacagaagttcattgatggcctcaccgtacgtaaagtgatttacgtaccgggcaaactgctgaacatcgttgccaactaactcacattttatcgatgagtcactaagccatgagaacactcgctgaactgatggcttattttactgtcagtaaacagggttcgccctgtttacttatctcagcttatcgcacagcaagctttcgcttttggtgagctgagataagtattttgcctaataacgagactgaagcatccatgcgtaacactcttttccctactttgaaatggtcactcttggttctgatgacaagcttactcacggcttgtggtttccacttgcgcggtgattacgatattccccaagaactctctcgtatgtcactgaccagctatgaccaatacagcacctttactcgtatggtgcaccgtcagttacgtttgaataaaatcgatctgcaagctccagctgaagatctacctaatctgcatctgctcagtgaaagtactggtgaacgcaccctatcgctttatcaaaacacgcgtgcagccgaaattgagctgacctttgtcgcaagctatcgcgtcaccgtacctgagctgggcagccgcacctttaccactagcgtaacgcgcagctacttagataaccctctaacagccctagcaaaatccgttgagcgcgacatgattgaagatgaaatgcgcaagctagctgccagccaaattgtgcgccagatggcacgtttaaaagcagactttgcacgtaaaacgttggatgatgaaagtattgaaggcaaagggatcactgactatcgcgttgatacgcaagaagtagccaacccagtgtcaacagaaggcagcagtgagtagtttcgatgcgcatttacgctgaaaaactggctgaatcactgcacaaaacgctctatccgatttacctcgtattcggtaatgagccactgctgctccaagaagccaaaaccgccatcgaaaaaacggcacaagcgcaaggttttttggaaaaacaccgatttagcgcggatgccgggctcgattggaacgcggtgtatgactgttgccaagcactgagtctgttttcatctcgccaacttatcgaaattgagatcccagaatctggggtcaatgctcaaacggcaaaggaacttagcgcactggtaggccaacttcaccaagacattctcttgctggtgattggccccaaactgactaaggcgcaagagaacgcagcttggttcaaaacgcttgcgcagcaagcctgttgggttaactgcctcacgccagaattgagccgtttacctcagtttgttcagcagcgctgttttgccctcggtttaaaaccggatgccgaagcggtacaaatgttggcgcagtggcatgaaggtaatctctttgcattagcccagagtctcgaaaaattagcgttactctaccccgatggtctactgactttagtgcgcttggaagagtcgctgagccgccataaccatttcacgccttatcactggatggatgcgctattagaaggcaaagccaaccgtgctcagcgtattttgcgccagcttatgctcgaagagagtgagccgattattctgatccgcaccgcgcaaaaagagctgacccaactgcttaaatggcaacaagagcgccaacagctgggtaatttggggagtctttttgatcgctatcgtgtctggcagaatcgaagaccactctactctgccgctttacagcgcttaccaagtcgcgccctacttcggttggttggaatattaactcaggctgaattactggcaaaaacgcaatacgaacagccagtatggccaatcttgcagcaactaagccttgaatgctgcaatcctcaggcaaacctacctttgcctcactaaaagcgtgatatactgcgcccttttaagcgaaagctgtattttattgatgattttcagaggacattctcttgcaaggtgaagcacttaaagactttcttttcgacaaagctgacgacatgaaggcggtcgatatcgtaactctagatgtaaaagagaaatccagcgttactgattacatgattgtctgtactggcacatccaaaagacatgtcgcctccatcgctgaacacgtagccaatgaagccaaactttctggcctgcaaccactgggtatgaacggcgaaaatgaaggtgaatgggtcgttctggatatgggtagcgtcatgttgcatgtgatgcaagaagcgccacgcgaactctatcaattggaaaaactctggggttaagtgtgaagattcaactgatcgccgtcggtactaagatgcctaaatgggtcgaagaaggcttccaagagtatcgtcgtcgcttccctcatgatatgcctttggaattggtagaaattaccgccggtaaacgcggtaaaaatgctgatattgcgcgtatcttacaaaaagagggcgaagcgatgctggccgcagtgcccaaaggcaatcgaatcgtcaccttagatattcccggcaaacgttgggatacggaagagctcgcagtacagttggaaagctggaaactggatgggcgtgacgtctcgatcctgattggtggaccagaaggccttgcgcccgcctgtaaagccgcggcagaccaaagttggtctctttctccactgaccttgcctcatccactagtgcgcgtggtgatggcagaaagtttataccgtgcgtggagcattactactaaccacccttaccaccgagaatagagtgacatgttacgccagcatacccctatccgcgaccatcaagccgaaacgcatctgtttcgtaatcgtgccatcgtctcttttgtcgggatcttgatctgcatgggtctgctggtgaccaacttgtacaatattcagatcaaccaatatcaagactacaaaacgcgatccaacgataaccgcatcaaagtcgttccgattgcgcctaaccgcgggctgatttttgaccgcaacggtgtgcttctggcggaaaaccgtccggtattcaacttagaagtgatccctgaaaaagtgccaaatatggaagagaccattgcgcgcttgcaacagctcattgagatcagcccagaaaagcttgccgcctttgaaaaggaacgcaaacagactcgccgctttaattctgtaccgctgctgactcagcttaccgacgatgaagtggcgaaattttccgttaatcaacataaattccccggcgtttcggtcaccgctaacctcaaacgctattacccctatggcgaagtgctgacccacgtgattgggtatgtatcgcggattaacgataaagatctcgaacgcttggacaaagaaggtaaaaaagccaactaccaagctacccgagatatcggcaaactggggattgaacgctactacgaagacttactgcacggtaccgctggttatcaggaagtcgaagtcaacagccgtggccgtgtcattcgtaccctaaaatacgtcccacccattccgggaaaagatatcgtgctcaatctcgatatcgaacttcagctctatgcctacaagctgctcgaaggtcgccgcggctcgattgtcgctctcgatcctaaagataatggcgtgctcgccatggcatcgagcccaagttacgaccctaatgcattcgtgcatggtatttcaggtaaagcctacagcgatttactcaatgacaaacgtcgtccattagtaaaccgcaccacgcttggcatttatccgccggggtcaactgtcaaaccgtttattgcggtgtccgcactgcaagatgggatcattacacctaatactacccgtaatgatccgggttactggcgcattcccaataccgatactcggcctttccgcgactggctacgttggggccacggccgggtagacatcattaaatctctcgaagaatcggtagataccttcttctatcaaatcgcctatgacatgggcatagataaactctccagttggatgatgcgctttggctttggggatctgacggggattgatatttacgaagagagtaaagccaatatgccaacacgcgagtggaaaatggcacgtcacaaagtgccttggtatcaaggtgacaccattccggttgggattggacaaggctattggactgccacaccgatgcaaattgctaaagcgacgtcggttttagttaaccacggtaaagtgattgccccgcatctgctgcgtgccaccatagataacggtgaacagttctcaacccaaaaagagaccgagtacaccacttacccaccgattgatggcgtgccgaaaaagtattgggacatggctatccatggcatgtatctggttaaccatggtgctaaaggaaccgcacgtcgcgccttccagaatatgccttacgaaagtgcgggaaaatcagggacagcgcaagtatttggtctggcggaaggccaaaaatataacgcaagtgagttagcagagcacttacatgaccatgctctgtttacaggctttgcccctgtcaaagatcccaaagttatcgtcacctttgtattggaaaatggcggcggcggctccagtaatggtgcgccagtcgtgcgacaaattttcgatcacgtgattttgggcaaaaaagaagaagagccaaaagcagaatcaaaagaagaggtaatacagccatgaagatggatcctgcaaccggacaaaaccgggcgctgtttgagcgttttcatattgacctgcctctactgcttggcgttcttgccctaatgggatttggcttagtagtgatgtacagcgccagtggtcagagcctagcgatgatggatcgccaagccatgcgcatggccatggctctcatcatcatggtgattctggcgcaaattccaccgcgtacctatgagagtgctgcgcctatcctatttttttgcggcgtcatattgttggtgtgtgtactgctgtttggggaaatctccaaaggcgcgcaacgttggctagatctcggttttgtccgttttcagccttcagaactgctcaaactcgccgtacctttgatggtggcacgttacatcggcaaacacgccctgccaccgtcgttcaaaaccttattcgcctcgttggtaatggtgttcgttccaaccattttaattgcgaaacagcccgaccttggcacctcaattttgattgcagcctcaggcatttttgtaatcttcttggcgggcattagctggaagctgattactgcagcggccgtggccatcggcgcttttgtgcctgtgctgtggttcttcctgatgcacgaataccaaaaaacccgcgtgcgtactttgttcgatcctgaatctgacccccttggcgctggctatcacatcatccaaagtaaaattgcgattggttcaggcggcttgtcaggaaaaggctggttacacggcacacaatcacaacttgaatttcttcctgaacgacatactgactttatctttgcagtcattgccgaagaatggggtatgatcggcatcttagtcctactcagcctctatttatttattattggtcgtggactttatctcgctagccatgcacaaacgtcctttgggcgtatgatggctggcagtatcgtattgagcttctttgtttatgtgtttgtgaacataggcatggtgagcggaattttacccgtggtgggtgttccactaccactgattagttatggtggaacgtcgatggtgacactgatggccggtttcggtattttgatgtccatccatacgcaccgcaaagcgttttcgaagacgatttaatgaaccgaatttatttatacttactgatcgttttaatcctcgctggatgtagctctcctggggggcgctatgatatgtctgacgatcaagcacccgacacaccactgtctgtcgaacatattgaagatgcacatccgcaatatgaaccgtacagcttcgggggtaataaagattacaatctgcgtggtaagagctatcgcatcattaaaaaccctaaagggtttaccgaaagtggcaaagcctcttggtacggcaaaaaattccatggccacctcacctcaaacggtgagatttacgacatgtactcgatgacggcagcgcataaaacgctaccgattccaagttatgtcaaagtgaccaatacggacaatggcaaatcgaccgtggtaagagtcaatgaccgtgggcctttccatgatggaagaatcatcgaccttagctatgcagccgcctataaaattggggtggtccaagcaggaaccgccaatgtgcgcattgaagtgattaccgtcgataaacccacgaaaccgcgcccgaaaagtaaaaacaacgccctcgaatatgtgattcaggtggtttcatcacaacatatcgaacgcgtgcgaactttagcgcaaaacctcggtcagaacttatcggcaccgagcttcgtcgagagtacaaataatacgcatcgcttattcctcgggccatttactgacgatgacctgacgcagactttacttgaacaagtaaaatccgcaggctatgacagcgcatttatcaagacgattaataaacgtgctaaatgaccactcaaacctgacctgagtctatctggtctggtttgagacgttatttttgttaagattacggacacttaagtagaactaagcattcaccatgaaaaaatcaatcctcaaatctgtgttagcgtcttctattacgctttctatcacgctaagcagcactgctttcgcctctcctatcgtgacaccagacgcaccacaaattgccgctaaaggctatgtactgatggattaccattcaggaaaagtgttggctgaaaaagagatggataccaaactctctcctgccagcctaaccaagatgatgaccagttacgtgatcggtcaagaagtaaagcgtggcaacatctcgctaaatgacgatgtcgtgatcagcaaaaatgcttgggcgaaaaacttccctgattcttcgaaaatgttcgttgaagtcggtaccacggttaaggtcagcgatctcaaccgcggcatcatcatccaatcgggtaatgatgcgtgtgtagcgatggcagagcacgtcgcagggacggaagatgcgtttgttgacctgatgaacgcttgggcaagctcacttgggatgaagaattcgcacttcactaactctcacggtttggacgatcctaatctttactctacgccatacgatctggctctacttggccaagctctgatccgtgatgtgcctgaagagtacgcgatctactccgagcaaaaattcacctacaacggcatcactcaatacaaccgtaacggtttgctttgggataaaagcatgaatgtggacggcattaaaaccggacatacgagtggtgctggctataacctcgtgagctctgctacagaaggcaacatgcgcttggttgcggtggtgatgggtactgacaacgaaaacgcgcgtaaagcggaaagtaagaagctactgagctacggtttccgcttctttgaaaccgtggcaccacacaaagcgggtgaaactttcgtgaatgaaaccatctggatgggcgataaagacacgattgcactcggtgttgataaagatacttacgtaactttgccacgcggacaggccaaagatctcaccgccagctttgtacttgaaaaacaattgaaagcaccgctgaagaaaggcgatatcgtcggcacactttactatcaattagctggtaacgatattgctcaatacccattgctcgcactggaagatgtgcaagaaggcagcctatttagccgcctatgggattacttggttctgctgttcaaaagctggttttaaaccgttcagccagtaaagccaatactgtctaaagagatttatctccccaaaagccgcttcgtgcggcttttttgtgagcttgagatcacgcccgaatggctgtagtatttcgtcccgtttttccaatgctcaaactggagtttcaccatgctgaacatcaactctgatgcgaaattaaaagatctgctcgaattcccatgctcctttacctacaaagtgatgggacacgctaagcctgagctgccagaacgtgtgttggaagtgattcaacgtcatgctcctggtgactacagcccgcgcgttaaacccagcgctaagggtaactaccattcggtctcggtgactattcacgcgacctcaattgaacaagtagagatcctttataaagagctcggtgaaatcgatatcgtgcgtatggttctgtaaaaccacgctattattttatttattcaaatatttttgaaagcagcttaggctgctttttctttatttttcaaaaaattaacaaaaccaccttgttatcagggtcaaaaagttccccctgatgtgtagttcattacaggtaagcagtttataatcgaaaaactttatatatctctggcggatgacaataatggaaaaccagctgttggtgagacgccttggcagacaggactacactcccgtttggcaggcaatgcatcaattcactgatcaacgtgactccacaacgcgtgatgaagtgtggcttgtcgaacacaaccccgtgtttactcaaggacaagccggcaaagctgagcacctcctcaatactggagatattcctgttgtacaaagtgatcggggtgggcaagtcacctaccacggaccggggcaattagtcgcctattttctgattgacctacgccgtaaaaagctcggcgtccgtgaattagtgacacacattgaaaatttggttattcacaccttaaaacattatcaaattgagtcagccgcacgacccgacgcccccggagtttacgtaaaaaatagaaaaatctgctctttaggtttgcgtatccgtaagggatgctctttccacggactcgcactcaatattcagatggatcttgctccatttttacgtattaacccttgtgggtatgctggaatggagatgattcaagtgagtgacctgcatccggtcagcatggaacaggttgaaaaagtattaatccaagaactcgttactctactggactacgagcaagtcgaattcagcacagaagcatacaatcatgagtaaaccaattcagatggaacgcggcgttaaatatcgtgacgccgacaaaatggctttgattcctatcaagaacatgccgacagagcagaaagaagttctgcgcaaaccagaatggatgaagataaagctacctgcggatagccagcgcattcaagacatcaaggccgccatgcgtaaaaataatcttcactcagtctgtgaagaagcctcctgccctaacttggctgagtgttttaaccatggtacggcgacctttatgattttaggtgctatctgtacccgtcgctgcccattctgtgacgttgcccatggccgccccaatgcaccagaagcggaagagccgaaaaagctcgcacaaaccattcatgatatgaagctcaagtacgtggtaattacttcggtggaccgcgatgacttgcgtgatggtggtgcacaacatttcgccgattgtaaccgtgaaattcgcgctttgaatccgcacatcaagattgaaaccttggtgcctgatttccgtggtcgcatggaagtggctcttgaggccttaaaagacaatccccccgatgtgtttaaccacaatttggaaaccgcgccacgcttgtatcgtaaagtgcgcccaggcgctaactataagtggtcgttagagctgctgcgtcaatttaaagagcagcatcctcatgtaccgactaaatccggtttgatgatgggcttgggtgaaactaaagaagagatcgtcgaagtattgaaagatctccgtgctcatggcgtcaccatgctgactcttggccaatatctcgcacccagtcgccaccatctgccggttgaacgctacgtgccccccgcagagtttgatgagctgaaagaggttgctctagaactcggctttactcatgcagcctgtggaccctttgtacgttcctcttaccatgctgacttacaagccaagggtttagaagtcaaataagcctcctcatcaagcctgcatctcgcaggcttgatgcttttcacggggatgagatccttcaccataatctcaaccaattccctgatttaaccttgaatcctacgcttggcttctataggcttaggctaaagtttcgattaattttcgctcgcccgatggtgcttttgagtgaatcctgaccacaaggaaataataatgaatcatatcggcttatttgccctcactgctgcagcgctattggctggttgttcatcgaatacccagcaagataactatcgtgaagcctcttttgagctgtgtaataccgaagtgaacatttactcagtcagcgatgatggccaagtacgcattgtgtgcgctgatggcgcgaagtttgccctgaaaactgagaaaactctcgatatcatgcgcgatatcaacgtggattattgtgatggagaaggcttaggtaagtttaccgaaagcaacaagtactacatgttcaagtgtaaatccggcaccatgatcagcgtcagtaagtaaatactgacgcgattgaccaaacaatcaccgccactaaaagcggtggtttagggatgacaaacaaaaaagcctgcgaacttcgcaggcttttttatcaggacaacctaaccaaagaaagttgcaaccatagcgttgcaacttcacatggctggggttttagcgcttaagcgtaaacaggcagacgttgacagatcgccaatactttttgtttcgtcgcttcaatcacaccttgatcattgatgttgtctagaacatcacacatccagttggcgagatcttttgcgtcttgctcggtaaaaccacggcgagtgattgctggtgtaccgacacggatacctgaagtcacaaacgggctgcgtgggtcatttggtaccgagttcttgttaaccgtgatattggcagcgcccagagcggcatcagcttctttacctgtgatgtttttatcaatcagatcaacaaggaacaaatggttttccgtgctgttagagacgatcttgtaaccacgttcttggaactgcgccaccatggctttggcgtttttcaccacacgcgcttgatactctttaaactcaggctccattgcttctttgaacgccaccgctttagccgcaatcacgtgcatcaaaggaccgccttggccgccagggaatactgcagagttcagcttcttgtacatctcctcaccggcatttgacaagatcaagccaccgcgtggacctgccagtgttttatgcgtggtggtcgtgacaacgtgtgcaaaaggcactgggcttgggtaaacacccgccgcaatcagacccgcaacgtgcgccatgtcaacaaacaggtaagcacccactttatcggcgatttcacgcatgcgtttccaatccacgatttgtgagtaagccgagaagccaccgatgatcatctttggcttatgctccagtgctaaggcttccatttcatcgtagttaatttgacccgcttcatcgataccgtaagggatcacattgtagtgcttacccgagaagttaaccggtgaaccgtgagtcaaatgaccaccgtgagcaaggctcatacctagcacggtgtcacctgggttgagcagcgccatgtacacagcgctgttcgcttgagatccagagtgcggctgaacgttcgcgtattcacagccaaacagttggcaagcacgatcaatcgctaaagcttctgctttgtccacgtactcacaaccaccatagtaacgcttacctggataaccttcggcgtacttgttggtcagttgagaaccttgtgcttgcattacacgcgggctggtgtagttttctgaagcaataagttcaatatgttcttcttgacgaagcgtctcttcctgaatggcagcgtatagctccggatcgtaatcagcgatgttcatatcacgcttaagcatctgtatctcctgactcagattgactgaaattgcaaaaaaaccacacaatgactccacgcaaacgttttcgtcatcactttatggcgcgcattctacataatttgatctttatcataaagcccaaattcatgaatttatcatgcagttttttcataaccactacgacagtattcatgctctaggtataaaacctatctaaacaacaaaactgtcaattttttgctttacaccctgtaaagcggatgtgacataggtttacctcaatttttcatccctagctaccgaaaatatccgcttttcattaacatccgcgccattctctctcctgataacggaatttatggaaaaacattcacataaagaagattggatcgcgattctgactgggacatttcttgtcgcacagggcgtctattttctacaagcgggacaactgctaaccggaggaaccacaggattagcgctgctaatgacccaatttttgccgctgacctttggcgtgctctattttctctcgaattgcccattttatctgttggcttggaagcgctttggtgctcgttttgcgtttaatagcgcgatttctggcgctttagtctcgatctttgccgatcacctggccatgttgattactcttgaaaaagtgaatgtagtttattgcgcggtagccggagggctattgatgggcttagggatgctgattttgtttcgtcatcgctcaagccttggcggctttaatgtgctgtgcctctttattcaagacagatttggcatctcagtcgggaaaagccagatggcgattgacggtttaatcttgctcgcctcgttcttttttgtttctccactgaccataggtttatcgattttgggggcgtttttactcaatatcgtgctggcaatgaatcacaaaccgagccgttatcgcgtcatctattagtctgttctgctagttataccaaaactacttggagttgcaggtaggcggcaagagagtgaatccccatcagcatagacagactatgtgattggggtgaacgaacgtagccaataccgctgcagcttcaagtaggtatagtaaaaagagagcctaataaggctctctttgcttacgttgcagtaaacccgcgagcatagtgttgatcacactcgccagtgtcaccccaatgaaactggctaagatgtcttgaatagaaaaagtgcgaagtggtgtgaaggcttgcataccttcatcaatcaaacagcaaatcgctaccaacaagccagtgaatacgaccagcttatagctgtggctcgtggcagaaagcactcgatacagcgccaacgtcagcaacatggctaataggccatgcaaatgggtatctccccccactgccctttctaattggtaaacataatcggcatgccagccggaagatttcaaccaagaagccaaagccgtcgacaaggctaacaagccaaacaacaccaaagaaactggacgctgttgatagatttgacggcctattttaagacgctgttgcaaatggaaatctctaatttgggctcacggcgtgaggctaaagtgcaagccagtttgaactgatgcgccgattttaggtaatccgccaaaaggtgtcgactgtttttgccgtctagtccgcgcgccagatgttcaatcaccaaccacttttgttcactatcccactgtttccagtgtgctaaccccacctgcgagatggcaatattcacggctggtgtatacggcccataccggtcagcattgcgcataaatttatcgagagagtccttgctcgaatgaggctgcgttgcatcatgagcagataactgagcttcaatctttaacaattcagcccaagtgtcaggccaagttgggcgccgctcggcactctccagaaacgcggttttagccgcatgcaacgcttgctgcgtatcttgctcctgagcaagatacgcttgccactgaaaaatccgtccctgtaaaaaataatactgcggatgttcagggctatactcaatcgcactctggatagccttgtgcgcatcatccacggccgagagcgtcgccggagaatgattccaagctagcagagccttctcagcggtaacaccgtataaggaggcgatcccttgctggaaggcgaaatagatcacccacaacgcagaactcgccaccccgacacgccatccaaactgaaaaaaagcgttcactttgccgcgcccgatttcgtctcttcgccatagtaagcttggtagtgataatagccgctgtagcgtgaagcctttttcgcattaagacgattgagtatcacaccatcaatacgactgccctgctgagtcaatttacccaccacttcccgcacgactggcgttcgagtatggttggcatcaatcaccaaaatcaccgagtccacgtattgcgccaacataaagctatcgctcactgcgagacagggtggtgtatcaatcacaatgcgttgatagcgagtacgtaaatcggccaacagttcactaaatttgcttgaagagagcagctctaacgggttggaggcataaacacccgcagtgagaatatcgagcccggattgctcatcatggtagacgcaatcttctaagctttgcgtgccattgagtaaattggtgacgcccggttgtgagccagaaatgccaaaacggtgcgcaatcgccggtttgcgtaaatcacagtcaatcagcaaggttttttccatttgcgccaacgacaaggccaagttcaggctagatgtcgtctttccctctccgggcagacaagatgtgagcatcacgacatgctgatcttgattgacatgcgcaagcaaatagctggtccgtatcgtacgcaccgcttcggttagctcacgcagtttctcatcaaaataggctttcgcatccagtttgccacgctgtttacgcaccacaggaacaacgcccaataaactcagtgccagctgtttctcgacctgtttgatgtcggcaaaggtatcagtcatcgcatcagcgataaacgccactacacaagcaaaaccaaacgacaccacaaaggcaagcaatacaatcaattttttattgggtttactcggcgttaatggtgcactggcttggtcagtaaagcgagcgatcgtggtattaaaatcccccgaagcactggtctctttttgacgcgctaaaaacaggtcaaacaattcacggttagtttgtacttcgcgcttcagctcagaatacttagcattttttaccgtcagggtctggaactcagatttacgctgattaaattccgtttgtaatgaccgctcagactgtttggccgcttgcagctcgttattgataccatttaacagctgtctcagctctgcacgcagatttttacgcaccgcttctaactgtgctgatgccgatttcaatttcgggtgtttagggccgtaacgcttagaaaactcagagactttccgctcagcatccacttcagcgactttcaaatcacggatggttgggtgattggaaatttcaggaatcgacgacaaagccgtcaagtcactgtcatttttactgtagctgttcgccacttgatacagggtttccgcggccacgcggcgatcacgcgctttgttcatctgcgaagtcagctcttccaactcttgcgttgctagcccttcaacaccttgcacatcaaccaagccttccgcttgcaaaaacgcttgtaacttagcttccgattctcgtaattgagtacgcagctcttccatacgggtatttagccaagtattcgcctttagctctacctctaacttggcttccaaatggctgtccatatacacccgcgcaatctcattcgcgattttcgccgccaacttaggatcacctgcggtgtagtagatattcaccaactgggttttgcggatcgggctaatctccattccgcgtttgaacttatacaagatcagtcgattttggcgatacgcttccaaatcaggatcggcgacggtctcttcctgcttaaatccctgtaggaatggcatccactctaccaagcgttcttttaagcttggagaagcgtcgctctctgggcttaagtcgaattctggatcggaggctaaatcaagtcgttcaatgacttcttgagcgatcgtgtcggatttgaggatctcaatttgggtcaggtaatactcctgacttttggtatcgagcccatacacttcttcaatggataccgctttcgcttgcgtcgattcaatcaaaatagtcgcacgcgctgtgtattctgagcgcattgagagtacgaacagtaaggtgatcgccgtcaccatcacggagaaaagtaagatgcgccacttatagttaagtagcacattaaaatactgacgaatatcgatcacttcttcttgagtgaattgtttgcctgtcatcttgtgtaccgttacaccctaaaattaaaagaagctttcggcgactgtcagtatgtcaccgggttgaagtttactcagcaatgtggctttggtcggtttggcttccggatcgtcactactggagataaacagattggtttttgaggcacgctcagtaaacccacctgcaatagtgatcgctttgttcaccgtcaaaccgggatgataaggataacttccaggcttcattacctgaccattcacaaagaaaggacggtattccaagatcgagacggagacattagggttgatcaaataaccatccagcaaaccatcgtgaatcgtggttttgacttcttccaaggttttacctttcaagcgaattcggccaaggaagggataatcaatgttgccgttgtcactcacccgcgtctcaaatgagagttcgggctcgtcatagacttgaatacggatctgatcgccaacaccgagacgataaaaatcgtcattggcgacagccaatgacggccataccaataggcacagcaaaaaagagagtaggtacttcatcatgggttacatcacgccctgaacagacaggtaatacacattttgactatagcttaacgagtcgatattggagtctttccgctcacgtcctacacccaactcaaaggtcagccaacggcgaaaatcatagctggcacgtaaactcgcattcgtcgtttcatcatcacgattcgatgccgtgtagtcttcctctaaacgcgttaatgcggcttcagtcgtccattgggtattccaattgtgtgaccagttgacttgataggtcgctgcgtcaatcgcgtcaccatcgccatcagagtcggtcgaacgtcgattggtcaccagttggagcgctgagtaggtgcgaaccagataagtcacatccacatcccatgagaaagagtcaaagtctttacggctggctgcatcaaaatctttttgctggtaaccaagctttgcgttgcctcgcaacttacctgtggcatcccaagaagcaccgagataaccaaagtagtgattattatctttgctgctggctcccggtgcgatcaggtcataacgacgagagttagcaatcacttgcgcgataaacgaggtgcgcggtaatgcctgataataaaaagtggagttaaagcgcagctcatcccaatcctgatattgagtaatggtgcggttattttgataagtaaaatcttgccaaccgatattggtttcaatccgaccaatcgcttctgttgaaccaaaaccatacccaagattggcactgtggctctcatattggttgtaatcaagcccgagtgtcgtatcgttctcgccacggccttcatgggctaaggctaagttatactcaaacccaatgcggtggcgggagttcaattcccaatcactggtcagatcaaggtagtgatcggtaaagttatcttgttgagaactaaaatacgttccgttgcgaaaacggtatcccaattgggttttactgctttgcggctcgactataaaaccgactcccgattcaatcaccgagaaggccgagctgtcttgctgctggtttgatttggccaagttatcgttatagcccgtcgaaagattaagaaacggcactaccgccatcccagattccgtcacgataggattcggcgttggcttcgcaacccctaatggcgcataagtcacacccagcgtgaccaagctggctgaaaaaagagaagtcagtttaatcggttccatttgcctgcacttatttaaatcgatatttattcaagagtagcactcgcacttacgacgcaagtgccctgtcttaatacgcgttttttccaacaaatcctttgaaaatagtcaggaagacgattttcagatcaaaccacagcgaccagcgatggatgtagtccagatcgaactgcactcgcttctccatcttgtcgagcgtatcggtttcaccacgccaaccattgatctgtgcccatccagtaatgccgggcttcactttgtgacgcagcatgtagcgattcactatggtgcgatattgctcgttgtgcgcaacggcatgtggccttggccccacgatcgacatacttccttgcaacacattgaaaaactgcggtaactcatccagcgatgttcgacgaatgaacgcaccaaatcgtgtaactcgtggatcgcctttggtggcttgctgcacatgactgccattatccatcactcgcatactgcgaaatttccaaacttggattggcttgccatctaaaccatagcggttttgtttaaaaatgatggggccaggcgagctcagcttaacgccaatagcgacggccaataacactgggctgatcaagagcaaaatcaagctgctcagcaccagatcttcaaagcgtttcacccagttgagcaaaccattaaagggggtatcaaaaatgctaaacgcgttgacatcaccaatcgtgtaccaacgtgagtgcagtaaattaaaagtaaaaaagtcaggcactatgtaggtattgaccgtactgtccgaaaacgcatccaaaatttggttgatacggcgctgcgcttgcatcggcaaagcaatatagacattttgcacctgcccagttttcgcaaggcttaatgcatcattgatattgcccagcacaggcgccccctctttaaggcgctcaggcgcacggtcatcataaaaaccttgcatcacaatccctagttcagggtttttgagcagattatttgataactcttgcccttgagtagtcataccgataatgaccgcgttcttggtatgcagaccctttttgtgcatgtagtgaatggtcgcaaatgccaatacacgccaaccaatcaagccaataaaagaaccgacaaaccaagcgcccatcaccatgcgagaaaactcgatccccgttttggagaagtaagccaatagggtcaagctagcgatggtcgcagcccaacagaatgccgtatgtaaagaaagtgaacgcagctttgctgttcgccaaccactgtaaatatctaaactttctgcaatgtaggagtaaaaaagcacccctagcaaggcaaccgaaatataagacatggtaacaacatgctgattcgacttaatcgatatatacataattactaatataaaaatgctatcaattaatcggtagaaaaatttaccgtgatagttagtaatgcgtattctgcttttttccttcatcactagacgctcctaaccgatgtaagatttcccgaagaataattggaatgtattaaattcttttttaaagactacatctttatcaatagaaatatctgcatcaattctaagactgaataaaaataaaaaacatgatgaaaccaattgaaaacaaccaagtttcatataatctagtgttggcattaaattaaaaaaataaatataaaacaaacacttaatcaaataaaaccttgagactcacttattaaccaccatgaaaataaactttagtttacttttatgatggttaataggttaatcaaaacagataaataaaaacgaaagaaccaatttaaataaaaataagatttgtattacattttggatttacattgaattatttttgagaaaagtaaaaaacaaattatttaacaagccacatagaccagccgtgatttaaaataccataaagaaataatatgtatcgtttatcgaaaggaaaaacagaacaatatgaaacccgtaccattaccactagtgctattgattgcattttttcctagcatgaatgcattcgcagaatctgaaataaacactaccgcttcatttgatcctgctctatgtacacaagagagtcagttgaacagcgctttaaatcaaactaccgatctactgacaacggtggcatcactcatggtgacatgtcctgagaatgccgtgcaaatcgcagcccttgcgagcaacctaaatccgtcactaacacgagaaatttatctcgtgctttttagtgatgttgtggatgaccaacgagtacaactcgccgttgacgcagtgcgcagtatcgttcaagaacaacgtgccgatgtggtacaagccgcgattgaaagtgcgccacaagagcttgctcaagcgatcgtagatgccgttgccgaagctgggttgatggacccaaccgagattatcatcgctgccatcgctggaggtgccgacccaggttcaatcactgaaccaaccgcggcaggtattgctacgccgccgccaattgcattggctccgggcttaaccaatacctttggtacaggtaacggtaatggtggtggtactgcatcaccgaactaacccagataactgacttgatattcctagcatacagcgcggaaacaccgaatcaacgtgaccgcgtgttataagccggccatggcatggcggagcaagttgaaggatttctctcattacccacttaaatcgatcaaatctttaagtgggtaaactgctattttgagccaccgaatttatgctttcgtttcacaaaactctatttttcgcttttttactgtttgttttctggttaccaatccctcttggcagtaatcgtccttgggcatggtcgctcaatgaaatttacgtagccttcttattattaggctgtttgtttctgctccccgcagcacagtgttggctagctatacaacgagcgaaagtcattctcatcccagtggcgctttttactctatggtcttggatgcaaagttggccaagtttggggctatcatccgatcaaactttggtgtttatctctgccgttaaatccttacattacctacaaatctgcttggttgccgcgttattggtcgatacccctcataagctcaaaatgctggcgaccactatgatcgcaagtggtatctgtcaggccttctatgctggcgtaatcctgctgctcgaattgcaaacctcaccgtttttttccttaccgttaaaccaacgagcctcgggaagttttgtctatcataaccatttagccaattttctaatgctcaatctctgtcttggttttggtttgttgattgctgagctcaatcaccaaacaacacaaggttggagaaacaccctaaaaaaattattggcgatactcctctctgacaaagcatttattcgtctgggcttggtcattatggtgatcgctctagtactcacccgctcaagaatgggcaatatcgccttttttgtcgcactcagtatcggaagcttgctcatccttctcttctataaatcgaagccgaaaagcctctatctgttgatcgtgagcttatttattgtggatgctttggttgtcagtaactggtttggcttagataaggttcgccaacgtttagctgaaaccagtttgcaaaatgaatcgcgggatgatgtggttcgtgatgccttgaacgccattcaagaacgtccccttaccggttttggcaatggcacgttttactccactttcccctcttacaatcaaggcgaagtggcgcttttttatgaccatgcacacaacgattatgtgcagttcaccttggagtcaggcctgattgccaccagcgtatttggcatcatggttttgttttgtgcatggcgggctttgtcagcctttcgcaatcgaaccaataaaactatgcgtggcattggccttggcagtttaatggcgatcatcgggatgctgttacacatgagtgtggattttccactgcaagccccagccacggcgctctactttctattttgtctattaatcgccaattggagcatgacgcttcctaccccgaaataccgctcatccagaacctgattgctcttcatctcctgcatgatcactgcgaaattgatgacttatagagtagaaacaatcacttacgttcaaagcggagtttagggatgacaataaaaaaacaccccgaagcatcggggtgtttttattcgcagttcagtaaagcgatgagtcgttagtagacaaactggaagccttcaactaaccaaccgccagtccatacattaatctgcttgatacgtttaccttgcggcacagtgtatgtttccactttcttattgctcgcatagtgggttgagcccaataacacgctagagccatccttcatcgtgaatttaatcgccacgatgtggtaaccaccccagttataaaggccagaggtgacctccactgattgcaattgatcaagtgcaatcggtgctcttaacacaccaccgttagtgccttgcaccggcccgccgactaagttgttgacggtagtaccaatggcatcgatcgcaaaacctgaacgcagatacatcaggttatccgccgtcacgacacgttgcgattgttgagtatttgagtaaccgaaaattggagactcaccacccactgcagcgcgtaatgtgcttgaacggtaggtattatggctcaaccaacttggctcaacaaaagtcggcaaagtaccatcttgattgatgttggtgagatggaaagcatgctggttccaaatacgagtcgcattcttccaaggtttcgaactgtccgctgattggtaaacataaaccccgtggttaatcgaatattggcgatcgaaatcgttcgctgccacgatcaactctgcgttgttatcaccttccagatcgaccacgatagggtattcccaaagtgttgccgtggagtgcgctagcgacgcacgttctttgcccgttttgccatctaatacacgcacgcgtgcatgatcttgcacgagtacttcatcgataccatcgttatcaaagtcatacgcagagacaccaattttaccgctgccagtgtcgtcattcgccacagaccaaacacgctcgcctttgctgttatacatatcgacagcggcatagcctgcgtaaacaatcccttttacatccagatcattggtaccattttgcgtagctaactcaaattgaacaccgtccaacaaccaacccgcggtccaagctttgatgcctttaatgcggctacctgctggcacagtaaagcgctcggtctgcttggagtaagcatagtttttagagcccatagaaatcacgctaccattgctcattctaaaatcgagcgctaatagatgataaccaccccaatagtatttaccccaagtcaggtcaatcgccttaatatctttgacgttaaccgcagcattaagattgcctcccgtaccaccgactaacgtcgaagcagaagcaccaatcgcatcaatcgcaaatcctgaacgaaccgagatcttgccatcgacggccaaagcaatcgaagcaggattgttattaggctgataaccatagacttttgagaactcactcgtttcaacggcttgagctttacctaaaaagttagataccgcctgcacaccaccaccagggtttgctgtgttgttgatttcccatttaatggtgccatcgtgttctagcacagcaaaacgtgcgttatcgcctgtcgcaaaagtggcaggtacagaggccacaatctcaggctcagcatcattatctaagttaactagcgaagagaaccaaaccgcatcgttcgcttgatactgccaattgatcgcaccgttattttgaaacagagtaccacccgaaaaaacttcttgttgctgatcgccatcgacatcaacgttgatcgaggacggcgcccaaggatgattaaagaccaatccgctgtggtagttatacacaccatctgcagccagaatttctacactgccatcgtggtctaaatccgccaacgtgatatcaccgacaatacgccagccactttctgtcgttgggatctgttttttaatgttgccttggttatccaaaatcgtgatgaattgatcgcgattgttggtagtcacaatctcaacgattccgtcaccgtccagatcgcctaccgctggcgaataacgcgcatccgcgatcacaccaccattcgcatagctccatagctcagaaccatccacaccacttaaagcacgcactaagccgccattggcgtatttgtttccttcaaacgtcactacgatcaaatctgcgacatctttttcatcaatcttgccatcaccattgtcatcgttcagttgcgcgacaataggcgttaccatcacttggttagagttaggttggaaagcactgccttgccaagaccacttaagcttcatattgagtgccgagctgtcaccgtcataagggacaacgcgcattgagcgtggctttgagaaatcaagcgtttcgccattgtaggctttgactgcacgcatttgctcgttctgggtgttaccaccaaacaccgcaagacggttgtatgaaaggttatcccaatcactcagcatgacccccaaacctagaggtgcttcaacatcaacctcatggccataaatgtacgctggtagcgagtaaccagagcgctcaccctcttttaaacagaaacgttcacccgtttgacgactcacaatacaagcctcaggataagtttcagaagccagtactcgcattgaacgtggtttagaaaaatctaaataagcaccgttgtaggctttgacattcttaagatcttcgttaccagtataacgatcgaacaccgccaaacggttataagacaggttatcccaatcacttagcatgacagagacaccactcggagcctgaacatctactggatgagcataaatccagctagggagggaatagcccgagcgctctcccacttttaaacaatatttttcgccattcaggcggctgataatacacccttcggcttcattcgttgtggcttgaaccacgttactactcaacgacaaaagaccgacagcaagtgcaatatagtgagacgtcatttgtaagactccctttaccttgtgttaattttattcaaagccagaaacaatatgcatccggttgatcgttgtaattattattttaaaacctaggaactggtatcgcggattgctaataacaacctgacggaattatcaatacctgaaagagccatttcaacacagcacacctattttcacgcctcagtaatgagacatctcaaagttgagaaataagccgactacaatgaatctctttctctttttcaagaagcattttctaggtgctgttatacttaaatcaattcaataaagagggtggcatcttgcgttacatatttatttcacttgttctgtttagcccagctattttttcagaggttaactctcacaatgtcatagaatatggcgccatcgcgaatgatggagaggatgattcgaacgcatttcaacatgcactcaatcaattaaacaatggtgatgccttaattatccctacaggagaatatcaaatttgcaaaacgctttatttaaaagaaaagaataacattgaaattattggttctataaacagtaaattaaagaagtgccgttcatttaatggggaatacttactccatatcacctacacacaaaatctgaagatacaaggcctcagttttgaaggactgaataatggtgacctcaaacctttgtggggagagcaaggtgtctaccttggcagcactaaaggtaccttagtggttcaaaatcaattcgctcgctttggtgacgccgcattgcgcatgacgacggcaagtcaggaccactcgataccaccaggctctatggcaataaaagtgagtcataatcacttcgaagactgcgctcaagtcactacaacacaagcgacagcaggaacagaaatgcacggtacacaggatattattattgataacaatcaatttaatgcttgtaaattaaaattatctgcacgcgcagatactagaggagctaaggtcattaataatcaatttgaaaatattaatggtacttcaaatgaagtcagttattattctgacgtttattactcaggaaacacatttttaaatatcaatgggttcgctatcaacatttacccaaactctagaacggaacaaaatgttcagtggggaaacatctccattataggtaacacttttgatgccatccaacaaggtatacgtttgcaaagctttagcatcaatgacccaaacaaccaatccatcaaaaacattcaaattagtgataacacatttgaaaatatttactttggaaatgaaattgaaagtcaatataaagccattattagaaccaatagccaagataatctcgtttctttcgaacatgtcaatataactggtaatcaatatcaattaacgccttatagtaaattcatttcaattgatcataaaagcaagttaatcaatattcaaaacaatgaaagaatttatagcgaccattattatatacagcactttattaaagattgatatatagctaatgacttggattgataggtagagagagagacagtgagtgaatggaagaagaatagatcatcggtatgattaatgaggaaagcggtaaactcccccccctaaaatgcctcatcacatcattcactataatttaaataagaaaataaaaaccgccataggcggttttttatacatacgactaagtgactaggtaaatttatttttttaccactgtcattgactgttccactcgctcaccagaaacaatgtctaccacttgagcattaattgtgtattcgcccgctggatagcttttatcaaaattaataccacgcacttttgaataagtatcacctgaagcaataacccatttctctctcgcattgacaggaataatcaaaccatcaggacctaccgcagtcatccagaactcgacgttagcttctccctcgcggccattatttaaatcaacggtgaatggaacaaaaccgccggtactttccacactattaatgccaaattgatttttgatatcaatagtcaaaccattgagttcaggtaggctatttaaatcgactcctttcacaaattcttggttggctttaaatacttttccattttctgcaacgacttgaagagaaacagtatatttaccatcagccatatactctggaacccagaaaccacgtgtaacgttcaacatacgaccatcagtaagagcatcagactcttgctgcgctgtatcaactccaactaccgctttggctgggaagtagataccttctggacctttaatcgatagccagtatttgaacttcactgtttcacagctttcattacggatccctagctgactagagatgtatccaccgttacttgccaactggttttgatttaatgaaagatttgcttcaatcactggctgtaactcacaatccacttccgcataagaagccgttgaaaataacaatgccaagcatgaggccagataataatgacgtttgttcatgatagatcctttaaagttagacaaccatttgtttttacaactggcgctaaggctaattcataactatagaaaatacatccgctttttattaaaggatctacctttatcaaatctaagacaattgcattggctaagcattaataatattaaaaaaacttgattcaacgaataaaaaccagaaagcnaaaataaaccnaagtttattttttcacccaaaggttaattctttggttttattttttcattgagcaataaccaagcatagcggctattagtaattaaataacgcttccacattcttccgggttcttgtaacacacgatatagccattccaatccggctttttgcatccataagggagcccgagaaacatgaccagcgacaacatcaaatgtcccgccaacccccatcacaaataacacccctaactgctcttgccagcggttgataaagttctcttttttcggggatgtgatcgccacaaacagaagttttgcacctgactgacggattttttcaactatcgcttgctcatcatcccaaaaataaccgtggtgataaccagcgatcactaattgtgggtgctttgcctgcatcactgctgccgttttttcaacaatctcctgctttgcaccgaggtagaatacgggcatttgttcttgtgcggccattgcattgagctcaagaaataagtcaacgcccgccactcgttcgggaacctggtgacctaaaaagcgtgccccccaaaccacccccataccatcgatattgataatgtcacactcggtcacggactgagccaattcaggatccttacgcatattgaccaacttagcgacattgaccaccacgtgctgggtaaactcttggcgcaaaatgcgatcgcggatcagcgcaaccgtttcactcatcgaagccacatccatcgggctacccagaaaattaatgcgtttcaatcggttattcctcattggtaattcttaaataaaaacgaaatgaaaggtacatccacgcctgtgtccagcgcgcgtagtgaattcggttaacccaacgtttgttacgttgatagacaaactgatcccgctcaggcatgtatagcgtttgaatagcacgctgaatgactcgtttaaccaaaacaacatcactctcctcaccaccaacactgagtaaggtaataatggcctgtgatactgagtgcggatccagtggataaggattgttgtggtaatacttcgccgttccatcggcttcaaatagatgctgcttgtaaaaatgaaaaccgcgtgcaatcgcctcatcaaattcgtttgtcgctaaagtcgttcgtataagatgtagcgcttctaagttgtagcccgtatgaaatccgtcaataaatccatgatgatgacgagtgccataggcccaactgccatcggcagcttgagcttgagcgctgttacgcgcaatgcgtaatgccaactcggtgtaatcagggcaagacgtttcgcggccaaccacagccagccatgcagccgcccacaaactggcgttgtgtacaaatgccgtttcaccggggatatacgcaaaaaattccccgctctcattttgagtcaataaatggccagcaataaaatcaccactgcgcagcgccaagtcgacccagtcagctcgccccgtcagttgccccaattggtgtaaggcacgactgacatagactgtcgtgatcacattcggcttccccttaggaacaaagaatgctcgcgctttccaatcaaaatgatatccccaacaggcaccatgccagatttgctcatcacaacgctgagtcactagccactgcgccagttgctccgcttctgtgagcaaagcgggatcttttgtcacttgatactcttcgattaatccgaggataaacagggccacgcctttagggtttcgcgctttgggcacacctagccatgggcgaagattaatcggtgagcgtttgaacaactggatccacgctaaaccaagagtcgaatctttgcttatcggtaagcgcttgaaccagcttgaattgagcccatcaaaaggatcgtatcctgcgaattgttctgtacgagctttattcaataagcattggctaatgtcagctacagtcgttgatttcatgattttaaaagctcatcgtaaagtgtttgtagacgcgggatcaccgcttgcaaagagaagttttcagcaaacttttgcttcgccgcggtcgcaatacgttgattttcggcacgctgttcaatcagatctccgagtgcttgcgctaaagcaaccacatcaccggcctcaattaaacgaccttgctcaccatcactgatcgcatcaggaattccgcccgctcgacttgcgacgacgggaatccctgccgacatagcttctataacgcccataggaaaaccttcgttataactgggtaagcagtaaatatcagtttgggtcaataatttgagcttagcttcgccagctatccagcctaaacagtgaacggacccgttcaagccaagctgctcagccatcgcttgataggtttcaatctcaccatcgccagcaagatacagctgtgcttctgggcagcgctgcttaactaacgcaaaggcttgaatcaaatcaccgactcctttgcgcgtccccaaacgaccaaggaaggcaatacggccaggttgagcaaggtggcgatctaaagccaaactgggtacggcgttatacagaacagaaacgccttgtgttctacctatgacctcttgtagccatgcgagccattgagttgaaagaaccagcacatgatccgccaaagcaaaagtgtgtcgaatatgcctttgctgaaccatattgcactcatctcgatagaaatcacgaaactcggcgccatgtaagtgcagaataacctttcctttcaaaagcttaactagacgaataatcacagacttacgtcgatagcttccccttgatgacatgtgaatatgtactatgccgactcggtaacgcataaagcagtacaacaattggcagagtgcaagcataaagcgcaatgtcattcgccatttctgcccgtggtccaaacttgagtgtgaggcaatcaacttgatgtggttttcttctagaaaaccacaatcagcgtaggttgagaccactgttgccacaccaccttgtcctttcagatctgtggcgatcattagattaatgttttttctcactgtacatccttgatggtacaaatcgcttggcgaatcttaccgtttgcagtgcgctcaagtgctgacactatgtctatcgtgacattgagcgagcttcctaagcgagcttgagtattgctgattaactgtttttgctgctcttgattaaattgctctgcatcagccaccactttcaccacaatctgccctcgttcactctgcacaaattggcatgccataatcccagcgatacctttgggtatatggttaagaatatgcactttttgaccatcttcaccgacgagataatcaccaatccttccctcaatacgctcgatcacaggaaagactcgaccacaaggacaagcctcgttttcagataaatgcacatgatcaccggtcttatagcggatcaaagggaaatattgattattaaagttagtgccgaccaactcgtaacgcccgtcgcctgcggctaacaattccacatgtgaatagtcggagagcaaatggtagcgaccatgctcacactgccctatcgcagccactcgctcaaataggccataccagtcaaaaactttgcagccaaagcgtgtctcaatcacctgtctatcttctgctgacaacgattctgatgaagtcataatcgatttgagcttcgccggataataactttggttggcttctaaatagcgggctaacgtagcaatcgaagaagggtatgcctgaatcacttcaaccccaaaatcgaccatggcttgcaggtaactcgacatcgttttcggtgtcagatggaaagaggacaacactatcatctgctcaaaccaagagtagcgccagaatggtccttgcttttgacttaatggcaccaccatatcgccacggatccacgctcgtttatcccctttacgatatcccgcccaagccaactgtcttgcgacaaaggcttgttcacgaataaccgaatgcctatcttgcaaaatagtcagaggtgtacccgttgtgccactggtcgcccctttcaccaccactgacggtttattttgtgagataaactgtttgtgatcacggcgtaatacggatttatccagataagggaaggcctcaagctcaagattaggcacctctaaatcctgataaaacggcacatggttacgagcattctccaaggttttttttagctgcttgtgttgataatccgctaaatgagtacgtgaaaactcgttagcttggatctcttgcaacaccgcacgcatctcaccattttctctgaccatttggcgtgacagcgcccgcacagaaagcatgacattttgcagccagattggtgctttaacataaagtgaactggtaaacatcagtaaaagtccttgggattaatatttgttttgatcactttggcgggcattccgactacaacgctgtaaggcgggacatcttcaagtaccacagcattcgcaccaatcacggctccatcaccgactcgaatatcacccagtacttttgccccagtggcgatatagacataattaccgatcactggaacattgtgtgaacgagaacggccaccaatagtcacattactcccaatcacacactctttaccgattacacagcgcttatgaattacaactgcaatccctccatagccaaagacagtccctttaccaatttcagactgactatagacggcacaattatgaaccaaacgaatcaaaccattacagacctgaggtaatagaggtatgcggcgcttatggaagaaatggccaacacggtacaaccacatttcttatctcctaatgactcttgctcgccaacgaacgatcagatgaacgataacgacaaactaaagcgacaacgaataacacgagtgcaggagtcttcaccgttagcgcattgttagtcagtgatatcaacataaaactgagtaaagcaacttgagcaggaagttcttgtcggtaaatcaagcgcactggaacagtgtaagttgccagtaataagccgatcgcccctagtaagccaaagttaagaacccagccaattaaataattttccacgacattgatcccgatataaaaggcaatatcactcagtaatccatgagaggctccaaatacccactccgaaggtgaaagctgttcaagcaaaataaaaacatcgaatcgcgcttcggcgcttttgtcgagatacaatttagacagtattcgctcacctataggacttaacaccagggtcaaaataacggcaattacagagaaatagactaaggcctgcagataagcgaatttcaacttatggtaacgaatgccttggcctaaaaagtcacgtaatttaggcaacagcatcagaaaattccccaataggaaaatccccaacgcagctcgccctccaaaagcaaacagggctagcacgataacagagacatacaaagccaccggaattcgtgtataacgcatcacaatcggcgttaatgacgccgtaatgagcgcattgttcagtggatgcgccaaaaaggcggtcgaacggaaagttgaaaaacttccaatctctaccgccacaatactctgcgccaatataagctcaataatagcaatacaagcattaagaaatagaagatagccgagtagagcaagtaatcgatttttagctgtatcggataacccgtatacaataggaaccaaaaccaaagggataaaaatcgtatcgataagataagcgagtcccgacgtaccgaatcgcataaagccgtataaaataacggccagcatcgataccatggccagccaccatgcctttttaagctcattcaaaggcttaataagattgaaaagtcctacccataatatcaacagggcaaaaatccccatagtcaaataggaatagacatgaattttgagtatggggcttccgccttctgaaacgtactgaatacccatattttcgagtaaaaaagcccccaacagaaacgcactgaggataatcagaatcatccatcgattgagattacgttcgctcaattaggcctccagattgagaataaacgctgacgtgcattaaaagcattcaagcaccacaaacagataccataaaacaacaatgaggtagtgacataaaaggctagagcgaataacgaatggatcgccaatggccactgtttcactaggtataagtagccacccatcagcagtgccgaaatgatcactttgatgccatccatgccgatagcataacgataccccgatcgccatgagctaataaaagagagtattgcgactaagccactcactataagcaaggtgatagccgcgccgaacatgccaaattgattgagcatcaaaggtagtaggaaaatgctcgcgattaagcccgagagagaaacccatagcagcttgcgagtctgtaatagaaactgtaaaccatgatcaaggtaatgacctttaaaattaatcagataaacagcgatcgctaacacccagaatagttcgctagaacgactcagatattgctcacccaaaaagagcctaatgatctcatcttgtaatatgccaagaccaagtaaagctggaaaagtaagggtaaccagtaaatgcagataggttttatgctgactcacaagagcgattttatcttccgcatgtttggctaagttagggtagagaggcatagaaatcaccataaaaacgagccccaaaacccccatcaataagttagcttgcgcagcataaacaccggtttcattcatcccaacaaaatgagcgataaataaacgatcgattcgtccacccagtacaccaattcccccagccaacatgatcggaataccataagcaagcaaacgctttaacattgcaatatgccatttaggccgctgaggtaaacccagacacaaagccccaatgccaaagctcaaggttaaagcaaataacgcagactcaatagtcgccgcccaagagagcgaaaggatggagagcactaccgctgaaattgactgcaatacggtcgcttgacgataaacgctcaatcgctcatttaagcgacttaattctaactggtattgaaatatcgatttaaccgacaataaagcactcagtaccaataatcgttcccaattcaattgctgataaataaataaagtcgcggcaataacaataaagccaagcaaagatccgatgatgaccagcagtgaaatgctttgaacgagttggacttgctccctatctgaatacccagggtaaagacgtaacatcgacgtgttgagccactgagcactaaaagcacgcacgagttcgagcaccaccatcgctaccgccaacacaccataatgttccggagagagaaagcgagtttgtacagcgatcagagcaaagacactcagagcggaaaagacctgaacaggagcatatttgagtagactagcaatcaactcagtacctctcgatatagattctggtaatgttcaatcacattttctactgcgaattgatcgcgcaaataggtttgaatcgcttgagtatccgttatttttatctgactgattcgctcagcaatcatcgcttcctgcccttcttgcataaaaaccacccctaactggtcaaacgttgcttgccgttcacctaaaatcccgacaggagtactaattaatggcaagcccgccgccatcatttccaatggcgctaagccgaacgtttcttgttgtgacgtaaatattccaatattcgcttgttggtactgttgtacaatttcacgctgattaagtttgccaagaaaaatgacatcttgttcaagctcatactctttgatcaattgctgcaattgcgcgtaataagcagaatccatattgggtccgataatacgtaaagtagccgcttgccctcgctgttttagctcacgcagtaatacaatggctcgatcaatacgcttgcgtcgagtaatcaatgcacaagtgactaaattgacttcattctggggcagattctggttcgcagagttggcagagaaatagtcaggatcgactggattgccaatcacttgaattgacttattcgtctccagagataacgcttgacgcaactcttcgccaacacaagtataaaaatcgacggaaaaatgacttacccatggaatgatttgttcataaacaaaatcattgagttttgaaactggcttacgcccaatcttgcgataagaatgcaaggtcaacacattacgagttttctgcccaagtcccatcatccaactgttgagatgagagtgaaccaaatctggctgatagtctttcagttgctcttggatgcggagccaattggataataagctaggcaaaggcagcccaaatcgcttttcccgcaacggacaaatcaccacttccagatgttttgacaactggataatctcgcctgaataagagtgattgttgagcggatcaaacgctaacactcggtaatggtatggacgctcttgctgagcgagttgacgtaccaacatttggcatactgaatccacaccaccaagatttttctccccccaattgagcgtagagagtggcatgataagcaatattttactcatgacttactttccaatggcgcggggtggcgaatataggttttatggcttggtcttgttagtacgcgtccggggttacccacgactaccgagtttgggggaacatcacgaatgacgacgctccccgcaccaatgatagaaccatcgccaatcgtgatatcttcaacgatcgagacatgcggaccaatatatacacagtcccctaccgttgcggcttgtccttgatttgagccaatcacagtaaagggactcaaattacaattggcaccaatcttagcggtactattaacaatgaccccagtggcatgcccgaggtataaccccgggccgacttgagtctcttttgggagttggatctgataacgcactgacagaatgcgatgcataagacgagctacagtgcggatcaacacattcttactacgacataaccgaaaccagaacatgtaggcgaaacccgcattgagtagtaggtgctttacgactaacccaatacttacctgcccagtatgccgataaagatcagctttaatcagctcccaaggtgaactcatgccaccactccgcgagtatcaatcaccactttcttagcaaactcggttttatccgccgctttaaattctttgtgatcgaccagcacgacaacgatattggcgagctcaagcgcgcgctctagagaaaccaactcgataccttgcttcgcaagtttgctaggtagttcagtaatatttggttcaaccgccaacaactgacccactttgctttcagccagatgtttagtgatatccaaggctggactttcacgcagatcatcaatatccgctttaaacgctaagcctaggcaagcaatgattggctttttgaattggtcagccgcttgtttaacttgatccacaacccaatgaggtttgccatcattgacttcacgtgcagtacggatcaattgcgcttcatctggacaactattaacgataaaccacggatcaaccgcaatacagtggccaccgacaccaggacctgggttaagaatactcacacgaggatggcggttggctaagcggatcaattcccatacattgattttcaatttgttgcacaccaaagagagttcattggcaaaggcaatgttgacatcacggaatgagttttcggttaatttagccatttccgccgtacgcgcattggtgacaatgcactcaccttttacaaaggttttgtacagggcaacagccttttcgctacaagccttactcacgccaccaatcacgcggtcattactcacaagctcttgtaggacataacccggcaacacacgctctgggcagtacgcaatcttcacatccgcagcgatgcctttttgctgaggaaacgtcagatccggacgcgcttctgcaagccattgcgccaatttttcggttgtgcctactggggaagtactctctagaaccaccaagttccctttagcaagaacgggagcgatggtttttgccgccgcttcaatgtagctaagatcaggttcgtggttatcccctttaaaaggtgtaggaacggccaccaaaaacgcatcggcaggctcagctgttaatgtcgctttgagtttcccggtcatgacagcactgcgtaccacgatatcaagatccggctccacaatgtgaatctcgcctttgttgatggtatccactgcatgggcgttgacatcaacaccgaccacatccaaaccacgagaggccaaaacggctgctgttggcagaccaatataacctaggccaatcactgaaactttattaaacatctgtcatcccctgatgagtctatttcgctaaaatgtccgcaatacgttgacaggctttaccatccccataagggttgtgtgcctgactcatggcttgataagcctgtgggtcagtcagtagtaagcttaacgcatcacaaatttgttgttggttggtaccgactaatttcaccgtgcccgcagccaccgcttcagggcgctcagtcgtttcacgcatcaccagcactggcttacccagcgagggcgcctcttcttgaatgccgccagagtcagtcaaaataatgtgtgcgcgatccatcaagtaaacgaaaggcaaatactgctgcggttcaatcaagacaatattgctgacaccttttaggagcttattgaccggttcacgcacattcggattgagatgcacgggatacaaaatttggcattcgggatgctgctctgcggtagtgatcagcgcttggcaaatacgctcaaagccaccaccaaaactttcacggcggtgtcctgttaccagaatcagctttttgctcgcatcaagcattggaaactgactctctagagtggcttgcagatccatatcggtatggatcttttcacgcacagccaacaacgcatcaatcaccgtattaccagtgacgaaaatattctctgcgttgtagttttcttgcagcagattggcacgcgaagtatctgtaggtgcaaagtggtactgcgtgagtgcggccgtgagtttgcggttgccctcttcaggccaaggggaatagatattgcccgttctcaaacccgcttcaacatgacctaccggaatttgttgataatacgcggctaaagaggcagcaaacgtggtagcggtatcaccatgcactaaaaccacatctggctgttcactactcaacacttgctgcataccgagcaaaattttgctggtcacgccattgagtgtttgcccaggctccatgatgttgagatcaaaatcaggcgtaatcgaaaacagctctaatacctgatctaacatctcacggtgttggcccgttacacataccttggcgacaaaacgattgtcttgacagagttgctgcaccagaggtgccattttgattgcctctgggcgcgtaccaaatacgatgagaacttttttcacttccccacatcctctttaaaaaagaaatttcacaaaattcaagcaataaagtcccactgctccttaaatgaggaacatatacataagcgaacactgaattatttcgtgttgttgtattaaatctcaacgagggagattacccatgtatgtcagcttattatttaaattcgtcgttataaacaatcttatttacttgaaaatttatggccttcttaaaggaacagaaaaataaacatatagtttaagcgcgatataaactttagtttattttcattccaacttatcttttagacacacccaaaagcgactaagttattgagataaattttcgttgcacgcatttatcccctgctcttgccaagaatcaaccaaagccaccgctccagattcaatcaacaaagctgtacgttggaaaaattcactactacgccgataaggatcgggtacttctttttcttgtcgattcgccttgctaagaaaaagagccagcttgtttttatgctcagcaggacaaatatcgagtaaatcagcaagattggtcctatccattgcatagataaaatcatgctcgataaagtcttgttgagtcacttgctggactgggttgaccatagggtgatacccataatcctgtaacgcttgtaacgctttatcatcaggcattgtttttcctgtctttagcgtgccagcactacgcacttggatattcaagcgtttttgccgaatcttatcgcgtaaaataatctctgccattggcgaacgacacaaattacctgtacacacgactaatactgataaacctttaaccttcataccctaactacgcacatgatttaatattgttaaagtaatacgcaatctactcattatcagagtatcccaagcttaccaataatgtctgtctcataattgagctggatattaattagaactaaagcagtaaaatgaaagtagttttatttattgtattagtattaaaagccatcgatttgaatcaataatacgacagggcatatttactaataaatgaaggttgacatcttcgttaaatgcccaaaagacttaaagttgcagctaggtggtcatcgagtgcataatcatcaacgtaaataacacggctgcatcaataggataaggataggaaaacaaaaaatggatggatattgctaatacaacaatatccatccattgcagcagatataaatcttcccaccgtacaaagcgatgggataaccaattttagtgttgagcgcggcctttcacatcttgttgcagctcatggttgagctctgcttcaacatgaccgggggcttgggttgaaccggaaatcaagcgatacatggcaggaatcaccaacaaggtcactaaggttgcaaaccccatcccaaagaaaatcaccgtaccgaccgcaattcggctctcatagcctgcacctgttgagacgatcaaaggaatagagccagccagtgtcgtaaaagccgtcatcaggattggacgcaaacggcgcgccgatgcatcaatgatcgccttttcaaactcaacaccgcgatcacgcagttggttagcaaattcgacaatcaaaatgccatttttggtgaccataccaatcagcatgatcatgccaatctggctgtaaatgttcatcccttgtcccataacaaacagcccaaggaaaccgccaaatactcccataggtaccgtcagcattaccaccagcgggttgataaagctttcaaactgagcagccagcaccaaataagcaaccagcagcgccagagcaaacacaatggctacgcttgattggttctctttgaaatctttcgactcccccgagtagctaacggagatatcatttggcagtatctcttgcgctttttggtcaagaaaatcgagcgcttgccctaacgtgtacccagcttctaggtttgcggtaatggtaacggatttctgtttattgtagtgcgccaaacgaatcgctgacgccacttcatcaatacgcgtcaccgtatccagtgtcaccagttcaccggttgcggttcgcatatagatttggcttaaatccgccgcattgttgaagctgttttcatccccacgcagatacacatcatactcttcaccacgctcaacgaaggtcgtcacttttttgccacccagcatcacctctagtgtatcggagatcgattttacgctgattcctaattccgccgcgcgctgcttatcaatcgtcaccaccaactctggcgttttttctgagtaatcgatatcagcccccgtcataaacggtgacttctccgcttcctcttctaacttctcagcccacgttttgagctcgctataatccgagccaccaagcacaaactgtacaggctcattagagcccccacgaaaaccgggcatgaatgggaatacccgcacatcaggaatgcccgctaaggctttacgtacttggcttaatgcttcctgagcagtaacggtgcgatcattccaatcctcaaggatcatgatcacgaaaccggtttggtcaccggcgttaccaccaaaagcaggtgattgaatactaaacgatttcaaaaagccttgacccaataagggcatcaaccgctgctcaaccaaatccatattagccgccatgcggttataactggtggcatcagcaccacgcacaaaagagaaaatcacaccgcgatcttcggaaggggttagctgagctggcaccagttgcatcaaaccataactaccaccaatacaagccgcaatcacaaccggcgccgcccaacgccaacgaatggctcggcttaccacttggcgatagcccgattccagtcgtgcgaacagcctatcaatcaactgattaaagcgtcccggttttacattggcttttaaaagcttactgccaagcactggcgtcagcgttaacgcgatcagagaagagaaaatcactgccatcgccagtagtacggagaattcagtaaacaggagtccgaccatcccgtccataaacgagatcggcagaaacaccatcaccagtaccaaagtcgtggctatcacggcaaagccaacttctcgtgtacctttgtaggcggctaaaagaggtttttcgccccgttcaatgtggtgaaaaatattttcaacgaccacgatggcatcatcgaccaccagaccaatcgataagatcagcgccattaaggtgatgaggttaatagaaaatccgaagtagtacgcagccataaaggccgagatcagcgaaaccggaaccgttaccgcaggaattaaggtggctcgcaactggccgataaaaatgtacaacaccaaaatcactaagccacccgtgataaagagtgtgctatacacctcgcttattgagcgctcaataaacaccgttgagtcatagtcaatggctaaacgggtacccttgggtaaaaactgctgaaccttatccacttcttcatgcacgcgcttcgccacttccagcgggttcgcgtcggattgcggcacaatccccatgctcacgttgacgatgccatcacttttaaaggtcgagttttcgttttccgccccaataaacacatccgcgacatctttgaggtagatgggggtaccatcactggcacgtttcaccaccagatactcaaaatcttcagcagattgataaccgcgcgcggtacgcaccgacatcacggtcgaatcgttgcgaacctgacctccgggactttcgaggttctctttgttgagtgcatcagaaatatcgctggtcgcaacgccgcgccccgccatcagttctggcttgatgcgtacatacatcactttatagaggccgccagagacatccaccgaactcacaccggagatcaagctaaaccgatcgagcaacacccgctcgatgtaatcggtcaactgagtgcgatccatttctgaggagctgagattgatatagaccgacgcctgaccagagccattattcttgaacacctgcggatcgtccgcttcttcaggcagtgaacgctgcgcccgagccaccgcatcacgaatgtcactcacaccggtattgagatcataaccaagctcgaaggtcaccgtgatacgagacattccgttgcggctaactgaggtaatctcatcaatcccactgatgcccgctaattgatcctctagcacgctggtgatctgactttcaataatggtggccgaagcgccttgataacgggtggaaaccgataccacagggctttcaatatccggcatttcacgtactgcaagtttagtgaaagagaccacaccaaacacgcacagcaacatactcagtactaacgctgcgacagggcgctttaccgatacatctgacaaccacattatttgtcatccttcttcagcggacgcccttctacggtgacttcgctaacacgcgcgttgtcacgcatattgactatgccttgaacgacaattttctcgccaatctgtaagcctttctcaatcacgacctgattttcaacccgagcgcccaggctcacttcacgtcgtttggctacattgtcttcaccaatcacgtaaacaaaacgtttggtgccggagtactcaagggcctgcacaggaataatcggcgcactaatagcggggaaatggatgcgtgccgacatcaacatgcccggcttgaggcgctgatctggattggggaaatgcacgcgcactcgtaaatttaaggtttcttgattgatacgcgaatccacagccaccaccgaaccttcaaactgcacgtttggccacgcttcgctactgccttgcaccttcatgcccttgcttaactgtggcagataacgttctggaatttgcaggtcgagccgcatcaaggaaagattatccagcgtcagtaattcagagcccgcactcacccacttaccgcggctaaaatcgataaacccaaccgtgccatcaaaaggagcagtaatgtgtaaatcggccaaattggcctgagcggcattcaatctcgcttgaccaatctccactcgggcgcgctgtgcatcaatttccgtgggcgtaatcgcattacgttttagcaagcgctcgtattccgtcagtttacgctgctcatcttgtaaataagctttagcttccaccaaggccgcttgagctttgtcatcatccaatttgatcagaatctgaccttttttaacttgctgattggcttgcaccgcaatcatgtccactttacccgccacttcagcggcaatgtcgaccgattgctcggctttaagcttacccacaacagaaagagattgagaaatttgctgagattgaaccgactctgtcacaacagaaatcgcgggcggctggttcggctctttggccgatagcacagcgctgttcattagcagggtcagtaaggtcaatgaaagtacagtgtttttgttcatgatttggcttagtgtctaaaaaatccgtttatattgtagcgagttatacgcaactgaaacgtcaaggaacgtaaagattgccagtaaaagtgtaaggttcgctgtgacttaagcagctaaaatggtcaattatttgcgtctttgcccaaaaagccatcattcgattcaatttgctaaaaaaacagtttacagagagagcgagtttgataagatgcgctccgcacttgagcgatgtgttgggaaaacatcacttaagcttttcagaaaatgaaaagaaaacaccctggaggggttcccgagtggccaaagggagcagactgtaaatctgccggctccgccttcgatggttcgaatccgtccccctccaccatattattctcgtaagagaaacccttgattgatggcgttgggaaaacgtcagttaagtcttttcaaaattgaaaagaaaacaccctggaggggttcccgagtggccaaaggagcagactgtaaatctgccggctccgccttcggatggttcgaaatccgtccctccacccatattctctcgtaagagaaacccttgattgatgcgttggggaaaaacgtcagttaagtcttttcaaaattggaaaagaaaaaccaccctggagggtcccgagtggccaaagggaagcagactgtaaatctgccggctccgccttcgatggttcgaatccgtccccctccaccatattctctcgtaagagaaacccttgattgatgcgttgggaaaacgtcarttaagtcttttcaaaaytgaaaagaaaaayaccctggaggggttcccgagtggccaaagggagcagactgtaaatctgccggctccgccttcgatggttcgaatccgtccccctccaccatatacagaaagccagctcatcgagctggcttttttgttagctaagcattttgctgaccaaactcaaggttgagaaaataatccatcccttgtcacccaccctgtctattttcactacctatattttccactctccataaaaaagccccgacgatgcggggctgaaaagtgattgaatcctataggggtgactcaatcaggatgatgcgtgtttcgtatggacgtaacacttggtgcgccaacacgcgctgtaattcaatacccggatagttgcctagcaagtagagcgcatcatcgagcggtaattctggcagaacgcattcggcttcgtgaccgtaatagttattcaaacagatcaacacttgtttctgattacgacgctgataagcaaaaatctctttatgctcaggcaacaagtcggtgtaatcaccgtccgtaatcaccgccactttcttacgtagcgatagcaaacgacggtagaaatagaacaccgaatgcgggtcttctaacgcggcctgtgcattgatttcaggatagttatgcgccacttcaatccaaggttctccacgagtaaatccagcgttgagactggcatcccactgcattggcgtgcgtgaattatcacgagatttttgcgccaaaatcgccagcatgtcactttcagagacaccttgttgctgcaccatgatttggtgaatgttgatgctttccacatcgcgatactgcttgatcgacgtaaagccagggttggtcattccaatctcttcaccttggtagatataaggtgtgccttgcattaggtgaatggtggccgccagcattttggctgactcaactcggtactgctgatcatcacctaaacggctcacaattcgcggctgatcatggttacaccaaaacagcgcgccccatcctttgccattcagccccgtttgccaatgattgaaaatttgcttgagttgcagaaaatcaaacggcgctttcgtccacttttcgccattcggataatcgactttcaaatgatggaaattaaacaccatagaaagctctcgaccatcgagcgcagaatattgttggcaatgttctaaggtggttgaagacatttcgccgacggttacgctgccataacgctggaaaacatcacggctgatctcttgcagatactcatgcactcttgggccatcggtgtaaaaacgacgaccatcaccgatgtcatcattggtaaaatcttgttgcttggaaatgaggttaatcacgtcaagtcggaagccatcgacacctttttcagcccaaaatccgatgatgttttttacttcttctcgaacttgcggattttcccagttcaaatcggcctgctctttggcaaacagatgcaaataatactcaccggtcgcttcatccagcgcccacgcactcccgccaaatttggattgccagttgttcggcacaccaccgttaaccggcttacgccaaatatagtaatcacggtaagggctattgcgatcgcccaatgcagattggaaccaagcgtgttcggttgaggtgtggttaaccacgatatccatgatgatgcgcataccacgacgatgggcttctttcagcagttgttcgaaatcttgcatcgtgccaaagtctggattaatcgcgtaataatcggcaatgtcatacccattatcgaccataggcgattgataaatcggcgtcagccaaatcgcttcaatcccaagcttttgcaaataatcgagcttgctgataatgccttgcagatcgcccacgcccttcgcgccactatcgcaaaaacttttcggataaatttgataaattgcagcggttttccaccaaggcatggattgggttgagctactcatactactctcacttactcaaaaaaattgactcaaaaacagagaaaggagtggcgtaaaccactcctcaatcgggtagagattaggcagccgaaacggccagtttgcctgaactctgtgcgcgcttgtacatcagcagagtcaatgctgcgggtaccaaaatcgcaattagcatggcgacgaggtaaatactccaaaactgcggctgaatcgagagaatacccggcaagccgccgacaccgataccattggccattacacctgcgctaccacagactgcggcagccaaagcactgccgatcattgcgctcagcatagggaatttgtatttaaggttgataccgtacatcgcaggttcagttacaccaaggtaagcggaaatcgccgccggtacagaaatgtcccgttcgccctgctttttactgatgataatgatgcccactactgccgatgcttgcgcaatgttagatagcgcgatcaatggccaaatcggcgtaccaccaagctcttgcatcagctgcagatccaccgcgttagtggtgtggtgaatgccggtaatcacgagaggagcatacatgaagccaaacagcgtcgaaccaatcaccgcgaaatcacccgtcattgccgctttcgctgcaaatgccacaccatcaccaatcacgcgaccaaatgggccgatgaaggcgtgagcaagcaccactgacacaatgattgatacaaacggcaccactaccagatagaggtaagaaggcaccacacgtcttaaattattttcaataaaggctaatgccacaccagccaagatagcggggataacctgagcttggtaacccactttttcaatcgcaaacagcccgaaatcccatacttctggcacttctttaccgatcaggtaagcgttcatcaattgcggagaaaccagtgttaccccaagggtaataccgaggattggggtaccgccaagttttttcacggttgaccagcagacaccgacaggtaagaagaagaaaatcgcttcgccaatcagccacaagaacgcatgaaccgatgcccaaaactgactgatttcagtcagcgttttgccatcaaacatgcgaatgtcacctatcacattacgaaaaccgaggatcaaaccaccggtgatgatcgcaggcagcagtggcacaaaaatttcagccaaatgggaaataccacgctctagcacattcatgttttgacgcgctgcgactttggcatcgtctttggaaacggcttgtttcccggtttgttccagcagcattttgtacacttgatcaacttcagtgccaatgactacctgaaattgccccgcattggtaaagcagccctttaccatgctcagcgcttccaaacccgccttgtcagcctgctctggctgattcagcacaaagcgtaagcgtgtcaaacagtgagtaacgctcgcaatattgctttcgcctcccaccaattcgataagacgcgtcacgtcttgtttcgctatcttgctcatatcctcgtccaccctattgaattattatcattgcagcaattgggaacagtcccaaatcaattggtgcgatattgacacaatgcataacagataaaaatgggaacaatcccattaattgaatgggatcacactgtgcgttatttatgcgtcaatttagtgtagtaaaaagagaggcaaaatcacgaaagtggcgaaaaagccactgatgaggagccgaatgaaagcaccgaattaaagaaagaataggcttagcgtgacactggcatttgggtcaaatgcacacagccatggtcagagccgcatagctgctcaatcagcagatctgccgccagttttccggcctcacgataaccaggatcgacactgaatatgttcggaaacaggaaagagagcaactcattaccacccacccccgtcaccactacgtcatctcgctgcagctcttgcaaacgcttaatcacaccgagcgccaaagtatcactcgcgcacacaatcgcttgggtttgctcagtcagcactttatctaccagcagataagcactttcatgatgcagttgtccggtttggtaattcgccacaatctcatgctcaacacaccaattgagataggcgttgagccgctgctcacccgtggttttgtcacgtgggtcgaccccaatgaaggcaatatcgcgtaactgtttttgtgccaaatgctgcagcgcacgctcaatcaccccagcattgtcataattgatagaggaaatctcatcactgtgcatggccaagagtacacagcggtgctgccaactgagcaaggcatcatgatcgatatcggtaaagccaaacacaatgacgccatccacttgccgcttggcgagcacttttaagtgagcattggttttttcgcggctaaattggctttccatgatcaccacatcgtagccgtgagcatagaaagcttgcagcatagtactgactgctttgttttcagaaggggaatccagacgtgaaataatgatgcccacgactttctgactaccaccacgcatggtttgtgccgatttagagggcacataccccgactctgcaatcacctgctctactttagcgcgggtttcaggcttcactttaggatcattggttaacacgcgcgaaacggtagatttaccgacgcctgagagtctagcaatgtctaaaatagtcagttttcgattcatgcgtttgtattggtattcattgataagaaaagaatgagcggtcaataaggccactgacgcgaccttattttttcactcgcagtagataatgaggcacatcgcgaatgctatcgagcaccacggtcgctaaggcttcaccttgctctgtgattggcttaccggtgcgcaccaaaatcttagtgcctacacccgccgcttcagctgccatcatatcttcggctttatcaccgaccatcaccgaattggccatgtcgatgttcaggaaatcgcgcgccgagagaaacatgcccggcttaggtttgcggcaatcacactcttctttgtattgcccaatgccatgttcagcatggtgcggacaataatagataccatcaaactcaacgccattatcggcaaagttccagtccatccactgggtgagagaaatgaaacgctcttcgctaaatttgccacgcgcaataccggattggttggtaaccagcaccaacaaataccccatacgctgcaaagccgcagtcgcttcaaatacaccttcaataaattggaaatcgtgctcatcatgcacgtaaccatgatcgacgttgatcacgccatcacgatcaagaaatacggcgggtttggccaaaatgctgtctctttcaagtcactttgcgcgaattattgcacgctttatttttttcatcactatctatatttttttcgtcactatctaataactttctcttctaattacctgcaaccatttagacgtctagacgtaaaaatatctattgacttaaactcagcaagcccatagcatcgactaccaattgaggaagaggccaacagattattctgcctctagcagtacagggttgcacatgattgagattaaaagcgtaaataaggtgttctatcagggggataaacaaatccacgccctgaaagacatcaatttattcattccacagggtacgatttttggggtgattggctcatccggtgccggaaaaagtacgctgatccgttgtgtcaacatgctagaaaaaccgaccagcggccaagtgattgtcgatggtgtggatctcaccacgctcagtaatccacaactgtgcgcggctcgccgtaacataggtatgattttccagcattttaatctgctttcatcacgcactgtgtttgaaaacgtagctctgccacttgagttagcgggccaatcacaacagcatatcgaaacgaaagtgactgaattgctggccctggttggtctctctgagaaaagagagagctacccggcgaatctttctggcggccagaagcaacgtgtcgcgattgcccgcgctttggcaagcgatcccaaagtcttgctgtgcgatgaagccaccagcgcgctggatccagcaacaacgcagtcgattttagaactgcttaaagagattaaccgtcagcttaacctgaccattttgctgattacccatgaaatggatgtggtgaaaagcatctgtcatgaagtggcgatcattggtggcggtgagctggttgagaaaggcacggtcggcgatatttttgcccacccgaaaaccgagctggcacatcaattcatccgctcaacgttggatttatcgattcctgaagattaccaagtgcgcttacagccaactcgcgtggcaggcagctacccactggtgcgtttggaatttaccggcgccaccgtggatgcgccattgatgacgcaaattgctcgcaaatacaacattgatgtcagcattcttagctcagatctggattacgccggcggcgtgaagtttggcatgatggtcgctgaaatttttggtaatgccgacgatgatgaagccgcgattcgttatctgcgcgaaaacaacgtaaaagtagaggtgctgggttatgtcctttaatacgattgcacaatggtttgcactcaatagcgacctactgttaaccgccacatggcaaacactgtatatggtcgcgattgccggtgcggtgggttttgcgctcgggattccgctaggtgtgattctccataccaccaaaaaagagggcttactggaaaacctaccgctgaaccgtgcgctcggcgccgtggttaacatcggtcgctcggtgccctttttggtgttgatggtcgccatcattcctgtcaccaaactgattgtcggcacttttatcggtaccactgcggccattgtgccactcacgattggggcgattccgtttgtagcgcgcctgattgagagtgcgctgcttgaagtgccaaccggcttagtggaagcggcgcaatctatgggtgcgacgccactgcaaatcattcgtaaggtactgctccctgaagcgctgccgacgattttaaactcagtcacgattactctcgtgacactggtcagctactcagccatggcaggtaccgttggcggtggtggtctgggcgatgtggcgatccgctatggattccaccgttacgacatcaccatcatggcggtcactgtggtcatgctgattgtgctggtacaaattattcaatccatcggcgatgcgttggtacgccgcgtcgatcatcgataagcaaaacaaaagccttttttgaacaaggagttcatcatgaagtttagcctgaaaagtttactgactatcgctgctgcagcctcaaccctaattttggccggctgcggtgaaaaagccgtagataacaacaaagtgaaaattggtgttatggcgggtgcggaagcacaagtggcggaagtggcggccaaagtggctaaagaaaaatacaatctggatgtcgaactggtgacttttaccgattacgtaacaccaaacgcagcattggatgacggttctatcgatgcgaacgcattccaacacaaaccttatctggataagcaaatcgccgatcgtggttacaagctagcgatcgtcggtaacacctttgtttacccgatcgcgggctactcaaaacagatcaaatcggttgatgaactacaagatggcgcgcgcattgcggttccaaacgatccaactaacctaggtcgctcactgctgctgttgcaacaacaaggtctgctcaaactgcgtgaagacgtcggtctattggcaaccgtacgtgacatcgttgaaaatccaaagaaacttgagatcctcgagttagatgcagcccagctaccacgctcactggatgatgtggctctgtctatcatcaataccacttacgcgagctcaatcaacctgaccccagaaaaagatggcatcttcgttgaaaacaaagagtcaccttacgtcaatattttggttgcccgtgaagcaaacgtgaacgccgaaaacgtacaaaacttcaagaaagcctaccaaaccgatgaagtcgctaaagccgcgtctgaaatcttccaaggtggcgcagtaaaaggttggtaatcgccatttctaatggtcttcccgctttaaaacagaaaaggttggcactacgccaaccttttttattactgagtgctttgaatacgaatagagaaaagatgaatgcgggggaatgaaggtgcatccagcactctatttcaagtgatcccaagagatattggagacaattcggcacggctcacaacggaaatggaagatgtcgtgcagtggctcatccaataaccactctccgccgcacttagggcaagggcgcgctttttcttgcgcaaggctactgccaccgacccgatactgatagtaataggttggcacttgagtcaaaaattcaatccgaccacgtaaatcccaacctcggcggaacaaatcactgtccacatcacaaatctcatgcagtgcggcatgctcagctttgcacgctccggccatttgcaattcatcacacgcttgccattcagtttgccatttgatcaccgctttgtggtcaccattaaaggtcggcggattacgatacagaggaataggcaacagactttcaccgctgcgcaatggtgaacacgtatgcacataggtggtgtacagcacctgccagctcggcatttcctcttccgcggcttgttctgagttgatgtctaaccccagaatgcgaactttcggcgcgagcaaactggcctcacttaaacggctcacacaagcttcaacgtattcggaatgaaatttcgggtgcaagctctctttttcagggcagacggcgcgcacgtaaaataccccatcacccagcacaatcgggaactcacgccccaatacttgtccgttatagcgcagcgcatccatcaagccgttgatggctttatccacggcgctgatggtggtgttatcaaaacactcaaactccaactcaaccacgtacatctcaattcacctttggttcaagctgttctaaaaacgtctcaagatcggcagtcaatacttcacgctgcgctgtccctaatttctcgaggatcacattaccactcaggttacacactgaaaccactgccatttcatcctcggttgtggcgataaatacggttggcttttgctttaagcggcgctgcatcaccaaatgccccaagatgttttcctgcaggcgggtgaaatcgtcttcactccatacttgcagcaaagtcagctctcggcctcgccactgcgcaggcatatcagcactaaactggctggcgtaaaatgctttaatatcctcgtgcagcgtgagctcaatcgcccgctcgacattactgaaatccgcccaaacctcacgattgacgggacgccagcgcaccacatcggtcagctcttcgaccacacaaggcgaagccagtcccaataattcatcattttccggtaattggccggtttgctgggcacaatgttgtagaaaacgctgactgaatgcactcaaggcttgcactacgctttgcgtcataatcatctccatgttgagtttgcgccgcctcgttaatgacactggcactgggattgcgtaaaattctgcacattctaattgaatcgactgaaaaacatgagcaaatattccgatgccaaagagctggcaagcttaactctgggtaaaaaaaccgagtatgccaaccagtatgacccaagcttactgcaacctgtgccacgcagcttgaaccgcaatgatctgcatcttagcgcgactctgccttttcaaggctgcgatatttggacgctgtatgagctctcttggctcaatcagaaaggcctgccccaagtggcgatcggagaagtgtcgattccagcgacaagtgccaatttgatcgaatccaaatcgttcaagctctatctcaacagctacaatcagactcgttttgcgtcttgggatgaagtgcaaacgcgcttagtgcacgatctttcggcctgcgccggtgaaaccgtcaccgttaacgtaaagtctctgaacgaatacaccgcagagccgatagtgaccatgcaaggcgagtgcattgatgatcaagatattgaaatcgctaactacgagtttgacgatgccttgctgcaaggtgcagcacagggtgaagaagtcagcgaagtactgcacagccatttgctaaaatccaactgcctaatcaccaatcaacccgactgggggagcgtcgaaattgcgtatcacggcgctaagatgaatcgtgaagccttactgcgttatcttgtctctttccgtgagcataatgagtttcatgagcagtgtgttgagcgtattttcaccgacattatgcgctactgccagccacagagtttgaccgtgtatgcgcgttatactcgacgcggtggcttagacattaacccattccgctccagccaccagtcagcaccgaaccataatcaacgcatggcgcgacaataaggataagacttaggatgagatttctgcgctggataaccatagcgaccttacttctggcttcaagttgggctcaggccacgatttactcttcacctatgctcaatgaagctagcggcttggtcgaggtctcacccttacaagcaaaaaaaatggcgcagcagtaccttaatgagcgccatttagccgagaaacaggaaaaacaccccgccacaattgctcgagatgaagccgacagccgaacacgcacacccggcagtacggtcgatgccttgatgattttggcgctcgccttggataatcttggtgaacatgaacaagcgcaacagattttgcgcgatgccaatgcactgactgaacaataccaactcccctatctacacctcgatgtgcaaatccttagcactcgtcttatttggcagaaagagggtgatgcacaggccgcgcgcgaaagaatacagaagatcaatgagcagtatcaggtgatcgaaaatgccgatcaaatcgccaaaggcattgattacaaacttacgttactcagtgccgaaatcgcctcaaaagccaatgagcttgaattggccgataagctgtttgccaaggccaaaccctatcttgacaccttacaaaacgaaaaaccggccattgagtatcacctaaccttaggtgagcacaatcttagccatggacgttataacctggcgctttccgaattgctgatcgcctactggagtgctattgagaacaacgccggcgtgctgttagcgcaagcaaacacactgctaggcaaactgtttttcaatcgccaagtgttagataaagcactcgatcacttctcacaagcggcagacttttatggccgctacgaacaatcgccatttttatctgctgttctcaaacaaatgggtgatgtctactaccagcaaggcaaatataacttagcgttagtgcattatttcaatgtgattgaccatcaaaataatcaatcgtcactcagtgatgaaattgaaattcgcatcaatctctccgctacctatttacaactctacaactaccccgttgctgagcagtatttaaccagcgctgaagagctattaggaatggctgatattcctcgtttaaatgggcacgccgccttactgcattcagggttggcttattatcaagaaataaatcaggatatcgttcgttatgcagaaatggcactgcatattggtcaatcgattcaagatgacgaacttcaagagcaagcttaccgtttactttctctcggttatgaaagaaccggctcagccgccaaagcgctagacaattttaaaaagagtcaggttctcgcccaaaaacgacaaaataagcttaaccaaatcagtgaagatgcatttcgtcagcaacgggagtttattgaacagaccttgcatttagttggacaagaaaaacagctgcaagagaccaacaatcaattcagccaattacgtaaagtggctttgtttttactgagcattagcttagtactttttctgattactttgcgacgcggttatcttattcaaggctttcaagatcaaatctctgagttacatgacactttatttactcactcaagatcgcgcctaagcaatctacgcatgctgaatgcgaagttacccagttcattagaaaacagtaaccgtaactatgaacagtggcagctaggggagctcattcgtcaaccgctcaacgatagactgcgttttgtgctgatcgacattcctttcatgcgcaacatgtatctgcaaaatggttataccgccggtttagaattagagcgcgcttttggtaaatttcttaaaactaaaataaaagaacccgatcggttgtaccatttttcagatgcaagcttgttgtatatcgaaaaaaatggcagcgagcgaagtgaaccagaaatattattcaaccagattcaatcttggctgaatgattttgcaccagaaagaaaaataaaccgaatagttcgaattggtattgccgattacccatttttaccgcgggcttataccgccatcaatgataaagaattgttggatattttgttgatggcaaccaatatcgccagagagttaagcttgagtgaaggccaaagtcattgggtctattttaaagcgattgataatgccccagccgccagctttgcttcggaaaatattcgactttcttgtaaacaagcaataaatcaagggctgatcaaagttcactcttcttataagaatgaggacaacatcaaaaaactcttaaaagatggataaatgctgcccagtcggcataaacactgagtgacgccagcaaaatatttgttattatcgacaaatcaataaataggatcaggattgatcctcaactatccagtttgttgtacatgggcgttctagaacaagatatccaagcagagcttcaaaaactgaaatctcagttagaacaagtacgtttgacacaaagggatacttcgttcaaatttaaccgagagcagcaagttcttaaacgaatggtcacttccttggctacgacttgccgcggcagtagctctcgactaaaccaaagtttagaagaactctgttttgcattagaacaacaaaaagacatcagtacgctgatcccgaaattagccgtactggaacgcatgttgaaacaacagtcattggccatggacaaacaaacgagtcatctggatagccagctacagcacagtggtgaaacgctactgcgcgtccccggcttacccgccaagatcaaacgcgatcttcgagatctgctgagttttagcgccgcacagccgctggaaaaaactcagcaagctttgcgtttgctggaaatttatgaacgcgcggtcaaaattcaatgtgccaatcccaatttggcgctcaatgagcttactcaacaagcggatcgagaactgctgcatcgacttgccgttgatttacaacacttgattactgagttggatttcaatggtgaatcgggtgatcaactgaccgatatccgaaccaagcttctgcttggcgtcaatacccataccctgcttgagctcacccttgaagtactgcgtttagtcgtcgatggaagccatgctgagcgcaaagcagccgaagcctttctcgagcaagtgaatctctcgattggcaataacctaaaaagcgcgactcaaaatcttgagcaaagccagagttacatggcacaccgccaagagatgaatggcgagctgagcagtttagtggctcgtagccagaccgcgctcaaagaacagacggagctagaacagctcaagctgaaaatggcgcctttactgcgcgagatgtcttcactttctgaacgcttactcttagcggagcaacgtgagcaagccctacttgagcgtatgcgctatagcaaagatcagatggaagccctgtctgatttggcacaagattatcgtcgccgccttgaagatcaagcattgcgcgcacaactcgatcctctgaccaaagtgtacaaccgcagcagctttactgagcgacttgaacatgagtatcgccgctggatccgtacgcaacacaatttgcgggtagtgctgtttgatattgataaattcaaatcgatcaacgacagctttggctacaccgcaggcgataaggccttaagtatcattgctcgcaccatcaaaaaagaattacgagacagtgacaccgtggctcgcttctctggtgaagagttcattctgttactgcctgaacgctccgataatgagagttaccagattattcaccagatccagctcaacgtgtcgaaactaccgttcaagttccgcgataagagcctaaccatcacgctgtctgcggcgagtatccgcttcatggattcagatacccccgaaacggttcttgatcgtttaaatctgacgctaagtgaagccaaacatatcggtccaagtcagttagtttggaaataactgattaatatttaagctaattaactattaatttgtgctcaatttcacaattaccccctcactctattttcttacctaactagatacctctagattgaagccagatatatcaagaggttatcccccccttctctgggtatctctgctactcttgttttataacaaatgctcaacatcatgctctagcatggcctcaacctcaggttgaaggaggacactatgattattcaagtcagcccagccggcagtatggatctactgtcacaactcgaagtcgaacgtctgaaaaagaccgcctcgagtgatctctaccaactttatcgcaattgcagccttgccgtgttgaactcaggtagccacacggataactcgaaagagttgctcgataaatataagaatttcgatatcaccgtcatgcgccgtgaacgcggcatcaaacttgagctggcgaatccccccgaacatgcctttgtcgatggacagatcattaaagggatccaagaacacctcttttctgtgctgcgcgatattgtttacgtcaatatgcatttagccgatagccagcgccttaacctgactaacgcgacgcacattactaacctcgtgtttggtattttgcgcaatgccggagcactgattcccggagcgacacccaatctcgttgtgtgctggggtggacactcgattaatgaagttgagtaccaatacactcgtgaagtcggccatgagctcggtttacgtgaactgaacatctgtactggttgtggccccggtgcgatggaaggcccaatgaaaggtgcggcggtcggccacgccaaacagcgttattcggaataccgctacctcggattgaccgaaccttcgattattgccgccgagccgcccaaccctatcgttaatgagctggtgatcatgccagatatcgaaaaacgtttggaagcgttcgtgcgtatggcacatggcatcatcattttccccggaggtccaggtacggcagaagagctactgtatatcttgggcattatgatgcacccagaaaacgccgatcagccaatgcctattgtgctgacagggccaaaacagagtgaagcgtatttccgctctttggataaattcattaccgataccttgggtgaagccgctcgtaagcattacagcatcgccatcgataatccagcggaagcggcacgtattatgagtaatgctatgccactggtgcgtcaacatcgtaaagataaagaagatgcgtacagttttaactggtcactcaaaattgagccggaattccaactgccgtttgagcctaaccacgagagtatggcgaaccttgatttgcacttaaaccaacgcccagaagtgcttgccgccaatctgcgtcgagccttctctggcgttgtggcaggcaacgtcaaagcggaagggatccgtgaaattgaacgccacggtccctttgaaatgcatggtgacccagtgttaatgaaaaaaatggatcagctactcaatgatttcgtcgcccaaaaccggatgaaacttccaggcggcagcgcatacgagccttgctataagatagtgacttaaacctaaagccaatgtctgctcaagcatgaactcgtcgcttgggtagtaatcttgacggatttgattacaataagggcctcacaagcccttattttttatggtttttggttatgtctcttcatcttgtcattattgatgcgcttaatttgatccgccgcgttcactccgcgcagcccgatcccaacgacatcaccagaaccgcggaaaccacaacacgcactctgcagcgcatcattaatgaagcgcagcccagtcatatgattgcggtgtttgatcatcatttatctgatcgtggctggcgcgctgagttactcccaacttacaaagccaatcgcaaacccatgccagacgttttgcagcaagggatagacgccattcaagatgcgtggtggcaactggggattgattcgctgttatcggaaggcgatgaagcggacgatctggttgcaacactggcttgtaaagtggcggctcatcaagaaaaagtgacgattatctcgaccgataagggctactgtcagttactttctccgaccttacaaatccgcgactactttcagcaacgttggttagatgagccttttatcgctcaggagtttggcgttactcccgcacaattaaccgactattggggattaacgggggtcagctcaagccaaattcccggcgtggccggtattggcccgaaagcggcgaaagagattttaaaccagttctcgagcattgaagaggcgtatgccagccctgaactaccggcaaagtatcgcaaaaaactcgatcctcacattgaaatggcgcgcatctgtaaacaagtcagtgccttgaaaacggacatcgagcttgggtttaacttgcaagatatccgttttaactcatcctccgcggactaaatcccctctgattagcatcacaacacagactactgacttttccacgccgcgtaactaaaccagatccagcctaagatgaacatcacgccaccaaaaggcgtgataggaccaaaccacttcacacccgtgagtgcgagcgcatacaagctaccgctaaaacagacgatcccgaccaagaaaaactgtgccgcgcggcgaaagcctttatgcgcggcttcatggagaggcagcaacaataatacgccgcacacgagcagagccaatgcatggataaattgatactgcacccccgtctcaaacacatcgagtaaatacgggcttaacatcttttttaaaccgtgcgccgcaaaggcgcctaaacccaccgcaacacccgatagcaagcccccgagagcgagtaaatacttactgttcatcctttacctcataacccgaatttactggttgtgcttatgttgcaaaatatccacttgctcactgcgcgcctttttcagcatccaatcgcggaaagtggcgatccgtcccatatccgcctgcttttcatggcacaccacatagaaggcgttattggtcatcaatacctcatcaaaaggggcaatcaagcgaccagcatcaatttctggttgcgctaacacgttattgcctaacgcaacaccttgcccatgcgcagccgcttgcaacaccatggttgagtgactgaagatcggcccatggttaacattaacgttatcaaggccgttctctttggcaaattgtttccagtctttacgcgaggtatcgtgcaacaaggtgtgataagccaaatcgcttaacttctccattggcttgttacccagcaacaacgccggagaacagagtgggatcaaaaactcctgatacaatttatcggcacgcaagcccggccaactacctcggccataataaatcgccacatccacatcatcagtcagcgaaccttcatccatatcgacggccttaatgcgcacgtcaatatccggctcttgctggttaaaatccgccaaacgtggcactaaccattgaatcgcaaaactcggcggcaaactaatggtcagcgcccctttttcactgcgctcaagtaatttatcggtcgcttcagctaatgaactaaaaatatcttttatgtcgaggaagtaactttgcccttcttcggtcagcaataaagagcgattacgacgacgaaagagtttcaagcctaaaaactcttctaatgctttgatttggtggctaactgcggcctgtgtcacaaataattcttcagcagctcgggtaaaactcaagtggcgagcggccgcttcaaacacttttaacgaattaaggggaggcaatcttctggacatagcggtactcggttaaagattagtttttttaatctgaaacattataaattgtccgttgctaaccgaccagagaaaatctatatttcaccgcgcaacggcggcctgaacggcttgatttccttgtaaatcaataggcttagttgttgcgatgttgtgtttgcaaactcgaaattcgagttaggtagtttctaccacccgttttgtgcagttatccctgccacaaaacaaatacttcctgtatttatttttgacctgtctgtcaaatttttagcaccgcctttgggcggtgtttttttatctgcatttttagctccaaccagtaaatactgagcttatataccctaacagcttggaattgcaggtaggcggcaagagagtgacaaatttgtctggaacaaatttgcacagccatcggctggcctttggtgagagccaaggatggctctcataatccccatgagcataggcaaactatgtgattggggtgaacgagcgtagccaacatcgctgcagcttaaagtaggaaggggataaagcgaaaaaaagcagagcctgctgagcaaactctgcgttttatccattcatgatcgcgttatgggcaatgaactatcgaccatgaactatgggcgataaactttcacattgttaaacccttgctcttgcaggtacagcgcttgtaagcggctcatcacgccacgtgagcagtacagcaagtaggtttttgactgatcgaggtcaccaaattgagtcgcaagcttatagaaaggcagatgcttcacttccacccccacaatctctagcgggctttcgtcctcttcgtctgggctacgaatatccagtacgacggcgttaccctcttctgcgctgttaaccaactccacttcaggggctttttccagcgactctttaccaatatcacgaatgtcgatttggcgcgcgttgtacaccacttgatcaagcagagcaaaatcgaatttggcttcttcttcttccaatttctcttttaccgcttttacggttgggctttttgaaatcaccccgcagaattcaggcatggttttggcgaaatcttccgtaccaatttcacgcgccagacggatgatgtcttctttatcccagttgatgagcggacgcagaatcaaagtatcggtcacgttatcgatatggcgcaggttagtcagggtttggctagaaacctggcctagcgcttcacccgtaaccaaagcttgaatgccaaacttctcagccaccataccggcggtgcgcataaacatacgcttgagcaccacgcccatttgaccatcatcgatcttctcgaggatctcagccaccacaggagcaaaatcgatcgcgataaatcgcactttggccgatgaaccgtatttttgccacaggtagtaagcggtttgcttcacaccaatttcgtgggcgggtccccccagattaaagaagcagtaatgcacttttgaaccacgtttaatgtgcagatagctcgacacaccggagtcgaagccaccagaaatcaggctcaatacatcttcttgggtacccagagggaaaccacctaaacctttatgacgcgcaatcacttggttgagcagctcatcgaccacttccacttgcacggtcacgtcagggttaatcaattttaccttggcactggcgatggcttgattgaggccacccccaacataacgttcgagttcaatagaggtaaaatcatgcttaccacggcgtttcgcgcgcacgacaaaggttttgttttcgaggttagcgcgatttagctccagcacttgctcgtagatgttgtgcagatcggtaaagcttgattgctgcacttccaacacttgctggatacccggtgtggtcgtcagaatctccaacacttcagcgtaataagtatcgctgtttgacgtcacttcaatatgatcacgacgattgaataccgccaccccttgtgtgcgggctttcacaataattcgaatattgctctcaaggatctttgtgaaacgcttacgtaccgattcacttttcacaaaaatttccggatggggtttaacgataaatttcatacagttattcgcaatctgagttagacaatctggcgagcagcaggtaaaccttggcaaggcgcttaccgctaaaggggcgcgattatacacgatcacactttattgagaaaagcccataaaaaagacaagcccaatggcttgccttttttagtttacagacggtgtgtatatacccaaactacttggagttgcaggtaggcggcaagtgagtgagtccccatgagcatagatagactatgtgattggggtgaacgaacgtagccaacaccgctgcagcttcaagtaggaagggtataccttcggttattgttgtccaccgcctagtgaaggaacctcgtcactgtagactggatcgccttgcaagatactgatctcaacgcggcggttggttgcccgttgcgcttcggtatcattgggccctaacggttgggtatcagccaatccacgcacttgcagtcgtagatggtcaaaatctttgaccttttccatctcttgcgccaccgaaactgcgcgctgtgcagagagatcccagttcgagcgatacagttcagagtccaatttctggttatcagtgtgccctgtcacccgcactttaccgggaatgtctttgaccaactcagcaatttggcgtaccagagggcggaacttaggttgtaagaatgccgaaccttcagggaacgcgcctttttcgcggatccgaatgtcaatctgctgccccaagttttctacttcaatggctccttgctcaatctctctagacagcgcttttttgatgctttccgccacggtttccatctgctctgacatcgcttgtgcttgctgctgttgcatttcagattgagtgttttggttatcttgcaccgaagtttctgccgattgaccgccagtaagctgaccggaatcacgttgattaccgcctgctcggtctgattcaccctcttggaattccaaggtttgttgggtgatatcgatggtttgctgcatgatcacatcaatcggcgtcggctctgggcgaccgggacgaaattcttgggcaataatactggtccctttgggaatatctttcacttccaaacggttttgcacaccaaaggcaaacttcattgagccagcgatctgcttaaatttcagtacgtccatctccgaaaacgagagcaagagtacgaagaagcacatcagcagtgacatcaagtccgcaaacgtccccagccatgcgggcaaaccgggagggggacatttacattgttgttcgtcatccatagtcggctccgctactctttatcaacatcaagaatacgtttacttgcgttgaggtagttcttcaaataactatcgataacccttgggttctgcccatcttgaatcgctaaaacaccgtccatgatcagacgacggttgagggtttcctgatcacgacgcagcgcgagcttatcggcaatcgggaagaaaatcatattggaaagtaccgcaccgtacagagtcgtcagcaaagcaaccgccattgcaggaccgattgacttggggtcgtccatgttagataacatggcaaccagaccaaccagtgtcccgatcatccccatcgcgggtgcaacgtcaccaaaggcgcgaaaaacttgggttcctttgctgtggcgctcatcggtcaagacaatatctttttgcaaggtggcacgcaccacatccgcatcatggccgtccaccaaaaggtcgatccctttttgcatgaaaggattggggatctccatctcttccaacgctaaaaagccacctttacgtgcggcatccgccatctcgacgattttggcaatcagatcttcgggagcatcagctttaaacataaaggctttaccagcgattttggccgcaccaaaaaactgtcccatctcgaacttcatgagtacgacgaagaccgaaccgccgaccacgataagaactgataccacgtcaacgaacatcatgatgctgccgcctagcaccatcgccatgataacgaaagccatgccaccaataagaccaaccagtgttgctaaatccacgaagcactcctcaggctacacattcgcgataatgaaaatcttaccttcattatcggcaacagaataaattctttaacgaaattgtcagaatagacggtgaaaaccttagtcaagtgtatacgtaaaactggcagagatgcacctgtcacgcgcagagtttttagccttcgaattatgactttgtggacttttttccatttcgttatctggcgcggtaaaaaagccttctatttctgacaaaatcgcttggttaaatttgaccagccaagccccctgaggtaactttcgtgcatcttaagtaaggcataaaaaatatggcgagcaagaaaccggaaaacatgtccttcgagtcaaccatcgaagagctggaacagttggtcgaacagctagaaagtggcgatctggcactggacgaagcactgcgcaaattcgagcgtggcatctctttagccagagctggccagctcaaactagacgatgctgagcagcgtgtgcggattttgctcagtaacagtgatgatgccccgctcagcgattttagcgatgtagcagagtaactcgctccacagccagaacaaccgacaaagatgagtgtcctatgattgaggcgttatcctcataccaacagcgaaataaccagcaactggatcagtggctgaaccgtattccctttcaaaccttgcctttaatcgaggcgatgcgttacgggctactgctcggcggcaaacgggcacggccatatttggtgtacatcacggggcaaatgctcggctgtgagcttagcgacttagacactcctgcctcagccgtggagtgtattcacgcctattcgctgatccatgatgatttgcccgccatggatgatgatgagctgcgccgcggcaagcccacttgccatatccagtttgatgaggccaccgccattttgaccggcgacgccctgcaaaccttggcgtttactattttggcggaaggcgatctttctgctgcaggcgaaacacagcgcgtcgccatgctccaagctcttgccgaagcttctggcgcacaaggcatgtgccttggtcaagcgttagatctggcggcggaaaatcgcttaatttcgctagaggaattggaaaccattcatcgcaataaaaccggcgctttaatgcgctgcgcgatccgtttaggtgctttagccgcaggtgaaaaaggccgcgccatgctaccgcatcttgatcgctatgcagaagcggttggcctcgcgtttcaggttcaagatgacattctcgatatcattagcgataccgaaacccttggtaaaccacagggttctgaccaagaattaaataaaagtacctaccctgctcttttaggcttagaaggagcacaacaaaaagcacacactctgttacaagaagcgcttctggctttagaagcaattccctacaatacggagcatctggaagagttcgcccgatatgtcgtcgagcgcaagaactaaacaataagcgcgcatacttatgactcttgatatctcaaaatacccaacactggctctggcgaatacgccagacgaactgcgcagccttccaaaagaagtactgcctaagctgtgtgacgagttacgtacctatttgctcaactcggtgagccaatccagcggtcatttggcctcaggattaggcaccgttgagctgacggttgcgctgcattacgtctaccacaccccatttgatcatctgatctgggatgtgggtcatcaggcttacccacataaaattttgactggtcgtcgtgatcagatgcccaccattcgccagaaagatggattacaccctttcccatggcgtgaagagagtgaatacgacaccctctcggtgggtcactcctccacctcgatcagtgccgcactcggcatggcaatctgtgctggtaaagaaggtaaagaccgtaaagtggtcagtgtgattggcgatggcgcgatcaccgccggtatggcgtttgaagcgatgaaccacgcgggggatgtgcaccctgatatgctggtcgtactcaatgacaatgaaatgtcgatttcagagaatgtcggcgcactgaacaaccatttggcgcaagtgctgtctggcagtctctacacctctattcgcgaaggtggcaagaaagtgctgtctggcattccgccaatcaaagagctggttcgtcgcaccgaagagcatctcaaaggcatggtggttcccggaacgctatttgaagagctcggctttaactacattggccctgtggatggccatgacgtactggaactgatcaaaaccctgaaaaacatgcgtgagctaaaagggccacagttcctccacgtgatgaccaaaaaaggcaaaggctatgcgcctgcggaaaaagatccgattggctatcacggcgtgcctaagtttgatccaagccaccacagcttgcccaaaagcagcaatactaagcccaccttttcgaaaatctttggcgattttctgtgtgatatggcggcgcaagatcccaagttgatggcgattaccccagccatgcgtgaaggctctggcatggtacgtttctccaaagagtacccaagccaatactttgatgtggcgattgccgaacagcacgcagtcacgctggcgaccggtatggctattgcggggtatcacccgattgtggcgatttactccaccttcttacagcgtggttacgatcaactgatccacgatgtggcgatcatgaacttgccggtgatgtttgccatcgaccgcgcggggattgtcggagccgatggtcaaactcaccaaggtgcgtttgatttaagctacatgcgctgcattcccaacatgctgatcatggctccggcggatgaaaatgaatgtcgccaaatgctctacacgggtcatcaacatcaagggccaagtgccgtgcgttacccacgcggtaatggcatgggcgttgagctagagagcagctttaccgcgttggaaatcggcaaaggccgcttaatgcgtgaaagcacggcatgcgaaggtgagaaagtcgcgattttgagtttcggtactctgctgcctaacgctttacaagccgctgaaaaactcaacgcgacagtggctgacatgcgctttgttaaaccactggatgaagccctcatcaagcaactcgcccaaactcatgatgtcctcgtgacattggaagaaaatgcgattgccggtggcgcaggggctggcgtgattgagtttctgatgaaagagaagcagctcaagccggttctcaatctcggcctaccagatcagttcatcgtgcaaggcacgcaagaagagatgcatgcagaacttggacttgatggtgcaggcattgagcgagcaattcgcgactatctggccaaatagtcctttccacccgccgcttaacgtcgctgaggtagaaatcagaaagagaaaagccttcatgatgaaggcttttttattgggctgattgagaaaatcatcaagcgttgattaacagcgactcttgccaaccaaactcactaagcaagccttgccacacttcatctagtccagcgcgaatcactaacggctgctgggtataaggatgcataaaacgtaactcgctggcatgcagcatcaaacgttgcgcggaaaagtgttcacgaaacagtcggttatgaactccatcgccatgggtggtatcacccactatcggatgacgcagatgtgccatatgacgacgcagctgatgtttgcgcccggtcttcggttgcatctccatcaagcaatagcgggtagtggcaaactttcccgtagcaatgggcagttccactttggcgagtggccgataagctgtcaccgccgactgcgcttctttatcttgcttggcaaatttatcggcaattttgtcgagctcttctttgagtggataatcgagcacatttgcctcttcaatccagccgcgcacaatggcgtggtaggttttctccatctcatgattggcaaacatcggcatcacttcagaggcaatctgactcgaaagcgcaaacaccaacacaccggatgtcgggcgatccagacggtgtagcgggaaaacgtgctgaccaatttgatcgcgcagggtctgcatcacaaactcggtttcatgcttgtcgagccatgaacggtgcaccaacatgccagccggtttattgaccgccaccaaatattcatcttgataaacaatctcgagcatctattggcacaccttgtcgatttgttgaatgaccgcaagcaccgcttgataacgggcctcaccttgccacacttctgagaaatacggctccagcgcgaaaccacgcggtaccgcattttgggcgatcgcctgttgcattttgggcagaaaaatccactgcagccactcatggggcaacagagtatccactgcaaagggctcttggctgacgagagcttgtgaagaaggcggtgtcgcttgccacaattgcgcagcacgcaatctgacttccaactcatcgagtaacttcaccaatacggcgttgaactgcataattcgtccggtttatttctatgatgaccttgaaaaagtgccatagagtaccatttattggagaaagaaagttaggatcaatttccgcatggacactattcgtaccctcacggctctgctgcaaaatagcggctgccagtaccaaatttttgatctcggacgccgcgtgcaagcgatggataaccgccaatttgctcaagtggagttaggtcaacaagcttacccgtttccgctacaacgtcatgcacaattcgctatcgtgtattggaatgaacagcgtcaaccttggatctggatgctcaaatttgcacttgatgaacgtggcttactgcaacaagccgatgttgggcaatttattcaatatctgctcgaagcaatgggcagccgactccatcaatctttgacggaagagcagcaacagaagctcgccaataatccttacactttcaaacccagtgaagacaaactcgcgatgctgcatagccatattcgcatgcagcttggtctagcctgcagccaatactacgaacacgctcagcactatttttcaggcggtttaggctgggataagtggcatacggtgggtttgcaagggattaccgatctttgtgcccgtttagagcaagaacaaaacggcgtattgctccgtaaagccctgactcatttgcctgcccagccactttacgctgtgctcggggcattagagcatgtcaccttaccggaaaaactggcgaaacgcttaagtgagcttgcggaggcggaagtcaaagccagcgatccagatctgtttttgctcgcggctctagtgagagccttggccggagcgcctgccaatatccttgatgcgacttgcgatgcgattctcgcctctcccgcaatttgccatccagaagtgctgattgcgcttgcaggacgcagttggatgagcttagaaaatagcggccgtgcgcaacgctttttgatccgcttagcgcaaactcaaaatcaacccttatttaatcaattgttcgcggacgtggtcatgctgcccgcactacggggagtgatgctgcctctattgcacgccagcccatcaccagagttggcgcaggctctagagcagttacagcagatgacacgaggataattcatgattggcgatttgctcttgatactggcgctctgttttgcgggatttctgttttggcagcagcgccatcaagcggaaatcgccaaacaagcgattcaacgccactgtgacaagcttgatttgcaactgctcaacgtcgcttttggccagcataaattcaaaacgccctctggccagtggcgttggcacaccatttatttgtttgagttttcctcacttggcgacgattgttaccaaggtcagttagaaatgcgaggatttagaacggtaggttttgctctgccaccgcaccggatgggctaagcctatccgcttcagccgtccagacaaattggctacatgggccataaaattcatccacatccatggcgtggataaaaccgagcttttgcaaaatagtacgcgcagcttcatgttgcgctttaatagttgcgaccacacgctgtaaaccaaaacgctgacacatattggggaaaaaggcattcaacgcttcactggcgaatccttgtccccagtaggctttatcaaatagaaagcccaactcagcgcgcccttcactctcaaattcgatgaagacatgccccatgtactcacggttatagttatccagcacggccatcgcgtacagtgaagaatcatgcaatacccgctgaaaaagctgtttcgctgccgctacggtcgtcggcccgttcatcagggcacggtttttcgcacaataattgagcaccagaaaatctgactcaaacgcctcagtgtaagggataagtagcgttcttcgggtcgctatggtcacggacattccttgtatagcagaaaaatcaaacggaaatagcgccttcccagatagaaaggcgctatttttattaacaatgacctcgtccatatcaaggatcgaatgacacgaggtaaagcctgctgacgttgttatttttatggtttatcaagaacctgatatgcgcttatttttttgttagccaatattgtgaccaatttggcctgattaacgcaggttcttttgctcgaaagggagattaaggaaagccccgacacaggtgtcggggcttaatcttagtcgcagcatccggctacttgaatgtgctccatgcatcatccttaacgggctgatcctttcagcgaactccgagcatcgccatcctagcggtgtcctatttatcctgatgccgaataatcctattcagccttcatcacttgttccttgagcggtgtccttgccatcgtcctgatggggttccctctcacatccctagagtatcctgaatcatccttgcagctcacctcactgtgcgctgacgcattccttatgcgtgtccggcttcctgcttgtggtcatcctcaccacttctcatcctgagaatcaccgttcctaggtcatttccttcgacaagagataatttacccgttttgctttttcgtacaagcggctgctggcctacaggctaagcccccaaacccaaccaataaaatagacattaaaaatcaaacagataagtaagccccctcgttattcctgcatcaattcactgtttttgcttacacaaggtgtaagcgatctctcacaaacgattgccccttttgctcgcgagtgtttctcagtaagatggcggcaaacccgaataaggaaagattatgctgaccaaagacgtgtctcaagagctggaagagatcctcaatagcctgcagcagcaaggcaaagagccttctgtcgcactggtcaaagcgcgtttaaaaacgccagtgccaatgcctgcgattattgccacgataaaaagttggaaaagtacccaacgcatccccaaagtcgaggtcgccacgacaaatactgccccgagccttgagcagcgcattgaacaattagaacagacgattttacagcttacagcgcgtattgaagcgctcgaaagcacaaacaaaggagggcaagcatgaagatttgggtagacgccgatgcgtgtccgaaagtgatccgtgaaacgctgatccgcgccgctgagcgtacaggcgttgaatgtacctttgtcgccaaccatctgatcccactgcccaaacgcgacaatattcgcgcgctacaagtctcttcagggtttgatattgccgacaatgagatagtcagacgcaccgaagcgggcgatttggtcataacggcagatatccccctcgcggatgaagtgatcagcaaaggtggtttggcgctcaatccacgcggtgagctctacaccaaagagaccatcaaagcgcgcctgaatattcgcgattttatggataccatgcgcgccagcggcattcaaaccggtggccctgccgccctttcgcagaccgaacggcgcgagtttgccaatcatctggacagaattttggctaagcgcactgggtaatgagattttctgatgtgtaaaaaagcctgcgatatgcgcaggctttttcgtatgcagaacaaacactatggcgtgtagtaagtggcggcgccagggccaaccggcagacctaacacaaatacccacacgtagaacagtaagctccaacccaccataaacaccaccgaatacggcaacatggttgcgatcaaagtaccgataccgaggtttttcatataacgcgtcgccaccgccagaatcaagccaaagtagctcatcatcggggtgatgatgttagtgaccgagtcaccgatacgataggccgcttgaatcacttctggagcatagcccaccaacatcagcataggcacgaaaatcggcgcggtgactgcccattgcgcagaggcagagccaatcatcaggttgatgtaaccacacatcaaaatgaaggcgaagaacagcatgggtcccgtcagtccgatgtctttcaggaaatccgcgccgagtaccgccaatacttgaccaaactttgtccaactaaagaaggcaacgaactgcgccgcaaaaaataccagcacaatgtacatgcccatagaagacatcgatttcgccatcgcattaatcacatcacgatcggttttcatcgtgccaaccacacggccatagacatagccgggaatagcaaaaaagataaagataaaggcgacgatgctctttaaaaatggcgaaccagaaacgaggccatcctctccacgcagcacgccatccgccggtacaattgtccaagccaataatgcgctcaccacaacaaccgctaatccagcataggccagcgcttttttctctagcgccgtcagagaacccattttgtcttggcttaagtcatcgctggcttctgatacatcatatttgcccagtttgggctcaacgattttctcggtcacgaatgcacctaaaatcgcaatcacaaaggtagaagccgccataaagtaccagttgacttcaggaccaacgctgtaagtaggatcaatcatacgagcggcggtttcggtaatccctgaaagcaaaggatcgacggtgccaattaacaggtttgccgaataaccaccagaaacacctgcaaacgccgcagcgagtcccgcgagcgggtgacgacctagcgaatggaacagcatggctgccagtggaataagaaccacgtagcctaattcagatgccgtgttagaaataataccggcaaacacgacagtgaaagtgaccatgcgctttgaagcgcccatcaccagaccacgcattgccgcagagagcaacccagagtgctccgcaatggcgacacccagcatggccaccaacacggtgcctaaaggagcaaagccgacaaagtttttcactaagttggttacgataagctctaatccatcggcattgagtaagctgacaacatggatcatgccatctgcagcacgacctttcgcgccttcaggacgagggtccacaactgacagctcgaagtacccagcgatacccgaagcaaccagtagtacaacacagaaaatggcaaataatgtgatgggatggggtaataggttccccaaatattccacaccatcaagaaaacgggtaattaaaggtttcttaggtgcgttttgatttattgaagcagatgaactcatctgttccctccttgtcatgattcctatgcatttgtgacagaaatgtcaaaagcgcgcgcagagtactcgacaaaaaaggtaaattaaaaagcaaaaatgttacaaaatttatccaaatgaataacttctaacctgaaaataaaaaataaccagatgatcatgagcatgaataaccatctggttagataaaaatcttgctactagcgctgaacggctttaaagcgaggatttgatttgcagatcacatacaaacggccacggcgtttgacgatttgacaatctgggtgacgatttttagcgctttttagcgagctgagcactttcattttgactccttagcaaactgaccgaaacgacgagtgaagttcgcaacgcgaccttctttttgtaccacacgttgtttaccggtatagaacgggtgagattctgacgaaacctcgatggtaatgtaggggtaagttttgccttcccactcaatagtgcgatcggtttgcaaagtagaaccaaccacaaaatagtgatcaaccgtggtatcgtggaacaccactttacggtaatcgggatgaatgcctgctttcatcttaaactcaaaacctcaaattgttatgttataacattttaattaataattattctcaaggtgatttgcaagcgatttttacgtctagctatgctatttttttcctcaacatcgtgtgaatatcgataaaaaacatgtatcccattgaacctattgcaattattgaaagcccataccaagaaaaatttgccgtacctcgtcaaccacgtttggtgccaagcgcgaccgcaagagtcaaattgctcggtgagtgcaactgcgcggaatccattcgtggcatagagcaatttagccatgtctggctgctatttttgttcgaccaaaacctcgccgcaggttggaaaccgaccgtacgtccacctcgtcttggtggtaatgaacgagtgggtgttttcgcttcacgagcaacttttcgccctaatggaattggcatgtcagcggtcgagttaaaaggggtaagcaaagaaggcgatcaatattatttagagctcggaagcgtcgacttggtcaatggcacaccgatcattgatatcaagccttatatcccctactccgattccattaccgacgcgcaaggtggctatgccgagcaagagccacaacgcatggcggttaccttcagtgatgcagcgcggcaaatgctccaggcacatcctgaaggtaagattcgccaagcagtgatccgtgaagtgttagcgcaagatccgcgcccagcttacaaaaaacatcgcgctgacgataagttatatgcggtgaatttgtacgattggaacgtgaaatttacggttaacgctgaagcaatcgttgtcaacgcaattgaacccttttgacaaaaccatttggctgatattattagcgcccaaattcgctttagatccccaaaccacttccagtggcagatagatgacaagtgagtgaatcaccataagcatagagagactatgtgattgggctgcacccacttagccaacacgcctgccgcttgcagtaagaagggaatgacgtcactcctgttaaagcgatcctttaaactttgatgaaacggataccatagaatgcgtaccagtaactatcttctttccactctgaaggagactccaaacgacgcagaagttgtgagccataagctcatgctccgtgcaggtatgatccgtaagctggcttcaggtctctatacttggctgcctactggtctgcgtgtactgcgtaaagtcgaaaacatcgttcgccaagagatcgataatgccggtgcaatcgaaaccttgatgccggtggtgcagccgtttgaattgtgggaagagactggtcgctctgaaaaaatgggcccagagctactgcgctttactgaccgccatgagcgtccgtttgttttaagcccaactgcggaagaagtgatcacggcgctggtgcgtaatgaggtgagctcttacaagcagttgccactgaacttgtatcaaattcaaaccaaattccgtgatgaacgccgtccacgttttggtgtgatgcgtgcccgtgaattctgcatgatggatgcgtacagctttgatatcgacaaagcgggcctagaaaaatcctacgaagccatgcacgttgcgtattgcaaagcgtttgaccgtatgggcctcgattaccgcccagtgctagcggatactggtgctatcggtggtaacggctcacacgaattccacgtactggcagaaagtggcgaagatctgatcgccttctcaaccgaatcggattacgcagccaacatcgaaaaagccgaagcggttgcaccggcgattgagcgcccagcgcctacgcaagcgatgaccttggttgatacccctaacgcaaaaaccatcgcagaattggttgagcagcacggtctgcctatcgaaaaaacggtgaaaaccttatttgtcaaagcctcagatgaaatcgatgcgcctatcgttgcgctgatcatccgtggtgaccatgaactgaacgaaatcaaagccgagaaactggccgaagtggcctcgccgctggaaatggccagcgaagaagagattcgcgcgctgatcggtgcaggccctggctcattaggccctgtcggcctgaaactgccatttattgttgaccgcaccgttgctgtgatgaacgatttcggcgctggcgcaaacatcgatggtaaacactacttcggtatcaactggggtcgtgatgttgaactgggtaaagtcgaagatctgcgtaatgtggttgaaggcgatccaagcccatgtggcaaaggcacactgatgctcaagcgcggtatcgaagtgggtcacatcttccaattgggtaccaactactctgaaaagatgaactgtggcgtactcgattcgaacggtaaaaacgtcattcttgagatgggttgctacggtatcggcgtctctcgcgtcgtcgcggcagccatcgaacaaaaccatgacgattacggcatcatttggcctgatgcgattgcacctttccaagtggctattgtgccgatgaacatgcacaaatctgagcgtgttcagcaagccgctgaaaaattgtatgcagaattgacagctgcaggcatcgaagtgctgtttgatgatcgtaaagagcgtccgggcgtcatgttctcagatatggagctgatcggcgtgccacacaccatcatcattggtgatcgcagcatggatgaaggccacttcgaatacaaaaatcgccgtcaaggtgagaaagaagccgtggcaatggagtcaatcatcgactttatccaagccaaactggcctaattttcggtcacattcacttaaaaaggctgccatcgagcagcctttttattaccagttttccccaaacgacttggatttgcaggtaggcggcaagtgagttcatcccatgagcatagagaggctatgtgattggggtgaacgaacgcggccaacaccgctgcaacttcaagaaggaaggagatattaatattagattcatttttcatcatctacactgagtcaaaaccagaggagatagcccatggatctaaaatcattacttaaccaagcactgagttctgacttagtgaaaaaaggcagtgaacagcttaaaaacctaggtcaagataaaagccagctcggtgctttgggggctggcgcgttaggtggcggcttattgggcatgctgcttggctcaaagaaaagtgccaaatggggcaaaagcgcgctaaaagtcggcggtgctgctgcacttggcgcactggcgtataaggtctacaacgattggaacgccaaacaaaatggtcaatccgcaccgactccgtttgatgaaagcaatcctcgtcatgagctgatcattttaaaagccatgattgccgccgcgaaagccgatgggcatgtggatgagcaagagatggcgcgaatccaacaagcgattgaagagctaggcgcagataaccaagtacaacaattggttgaacaagaactgcgcaagccattggatccttctgaaatcgctcggtttgcgcaaaacccagctcaagcatctgagctgtatctggcgtcattgctgattgccgatgaacagaactttatggaaaaagcttatctcaatgaacttgctaaacaactaggcttggatgatcaattggtcgcacagctgaatttacaagtcactggccaataattcaccactcatgaggcttcattgagccagcgcaagtagtaggtttggtatttctctgctctcaaggtatattgagagcagttatcatttgaggacaccctgatgaaagtttatgactgttgtgaactggtacgcgagctttatgcgcaaattggtagtggtgatcaaggctatattccgcaagctatcagctgcgctgtacgtgcattaaacgagattgcggctgataccgccctgccactggcggcacgagaaaaagcggcgtttgcggcagcgaatttactgatttccgattttgaggattaatcaccatgaatctcgcgaattttgccactatggatccgatcatgctgatgagcatcattaacatgaaactgcgtgacgactttggtggcgatttggataaattggttaactatttcgatattgatcgcagcgcgttagaagctaagttagcgagcgctggttttgaatttttaccgcaagtcggccaattccgctaaatcaacggttatcgcaaagcgccctttcaaatcggggctgaaaaaataaaaatccgccttcttagaaggcggttttaatataagccccctaaaagggggccacggcgctgttagtctctcaataactctaactgctgctcttgctcaagctcttttttgtcttgatgccgtacataccgtctaatgatttcttcatttacacctaccgtatccacaaaatagcctcgcgcccaaaaatgatttccccataactttttcctgatatgtggaaacttgttgaatagcctaattgcactcctaccctttaaaactcccatcaacgtcgaaatcgatactttgggcggaattatcgcaactaagtggacatgatctggctgaacattgagttccaaaacttcacaatctttcatattacaaagaatgtagatcgaacgatttagctctttggctacattaccttttaagatcttaaaacgaaattttggtgtccaaacgatatgatatttgcaacgccaatagacgtgtgatgaacttctgtagtcgcccatgttatttgaatcctcttacttatggtgaataagagtttgtcttctaacatgggcgcattttcgggcaaaagcccctagggacaatcaccaccgctaaaagcggtggtttagggatgacaacgaaaaaagcgcagaagttctctgcgctttttgttgtgcttaagcttaaatcaattagccaaaatatttacgagcattctggaacatacgcatccaagcgccattctcaccccagttatcagggtgccacgagttggcgacggtacggaatacacgctcagggtgcggcatcataatcgtcacacggccatcttgagtggttaaaccggtaatcgcattcggtgaaccgttcgggttgcttgggtaagcttgggttggctgaccaaagttatccacgaaacgaatcgctacggtgccagattgctcaattgccgccagatgctgagcatcacgcacttccacacgaccttcaccatgagaaaccgcaatcggcattcttgagcccgccatctcgctaaagaacagcgatggcgatttttgcacttcgactaagctaaagcgcgcttcaaaacgatccgattcgttacgcacaaaacgtggccatagctcagcacccgggatcaaatcacgcaggttagacagcatttgacagccgttacacaccccaagtgagaaagtatctttacgttggaagaactgctcaaactgctcacgcgcttgggcgttaaacagaatcgatttcgcccaaccttcgcccgcacccagtacgtcgccgtaagagaagccaccacaagccaccagaccttggtaagcatcgagcacggtttgcccagtcagaatgtcgctcatatgcacatcaaccgcatcaaaaccagcgcggtcaaacgctgccgccatctcaacgtgtgagttgacgccttgctcacgcaaaatcgccattttcggacgcacacctttggcgatgtacggcgcagcaacgtcggcttgcacatcgtaagttaacttcgcattcaagcccgggtcacggttatcttgtttggccgcaaactcttgatcagcacacgccgagttatcacgcagcgcttgcatcttatgggtcatttccgcccagatggtgcgaagctcagtacgagagcgctcaatcaagacttcctcaccacaagtgatcagcagacgatcggatgcttctacttcaccaatcacgtgagcacacgcttctaaaccatgggcggcaagtgttgccagaacagcattcagctcatcatttttcacttgaaccacggcgccaagctcttcattgaacagtgccgccagtgcatcatcacccaaggtttcaatattggctttaataccacagtgacccgcgaaagccatttctgccaacgtcaccaataaaccgccgtcacctttgtcgtggtaagccaccagcttgtcgttacgcaccagcgtttgtactgcatcaaaaaagcctttgagctgcgccgcgttatccacatcagccggcttatcacccaactgtttgtacacttgcgccaatgcggttgcgccaagacgattttgaccattccccaagtcaatcaagattaagcttgtctcaccaaggtcagtacgcagttgtggggtcacggtcttgcgaatgtcttccacacgtgcaaaggcggtgatgatgagtgacagcggcgaagtcacttctttctgctcgccattttcctgccacttggttttcatcgacatcgagtctttaccgactgggatagtgatacccagtgcaggacaaagctcttcaccgaccgctttcaccgcttcatacagaccggcatcttcacccggatggcccgctggagacatccagttcgccgaaagtttgatgcgtttcagctcgccaatatcggttgcggctatgttggtaatagcttcaccgaccgctaaacgtgcagaggcaccgaaatccaacagcgcaacaggggtacgctcacccatagacatcgcttcgccgtggtaagaatcaaaactcgcggccgttactgcgcagtttgcgacgggaacttgccatgggccgaccatttgatcccgcgcgactaagccagtcactgagcggtcaccaatggtgatcaggaacgttttttctgcgactgccggtaaacgcagtacgcgatccaccgcttcattaagctcaatgcctgaacgctctagcgctgggcttgaaactttcagcgtgctcgcttcacgatgcattttcggcggcttacccaacagaatatccattggcatatcaatcggcgtgttagcaaagtggctgtcttccagcgtcaaatggcgctcttcggtcgcttcacctaccacggcataaggggcgcgttcacgctggcaaatcgcatcaaacagcggcatatcttccgcagcaaccgccagcacataacgctcttgtgattcattacaccagatttccaatgggctcatgcccggctcatcattcggcacgttgcgcaactggaatttaccaccgcgatcgccgtcattcaccagctcaggcagagcgttagagataccacccgcgcccacatcgtggataaaggcgatcgggtttttgtcaccgagctgccaacaacggtcaatcacttcctgacagcggcgctccatctctgggttttcacgctgcacagaagcaaaatccagatcttcagcagactggccagaagccatcgaagaggctgcgccaccaccgagaccgatgttcatcgcagggcctccgagtacgatcagttttgcccccactgggatctctttcttctgaatatgctcggcgcgaatgttacccataccgccggcaatcatgatcggcttgtgataaccacgcacctcttcaccagcatgtgacgtcactttttcttcataagtgcggaaatacccaagtaggttcgggcgaccaaattcgttgttgaacgccgcgccgccgagtggcccttccagcatgatatccagcgcattcacaatgcggcttggcttaccaaaatcgctttcccatggctgttcaaaaccgggaatacgcaagttcgaggtggtaaagcccaccaatcccgctttaggcttgccgccaataccggttgcgccctcatcacgaatttcaccgccagaaccagtcgaagcccccggccaaggcgaaatcgccgttgggtggttatgcgtttccactttcatcagaatgtgggcatcttcatggtgataagtgtactgacggctctcggggtcggggaagaaacggccaacggtcgagcccgtcattactgcggcattatctttataagccgaaagcacataatccggcgtctgttcaaaggtgtttttgatcattttgaacagtgacttgtcttgcttaaccccatcaatggtccaatcggcgttgaaaatcttgtggcggcagtgctctgagttcgcctgtgcaaacatcatcagttcaatgtcgttaggattacgacccagtttagtgaagctctcaaccagataatcaatttcatcttcagccaatgccagaccaagggaaacgtttgcctcttcaagcgcacgacgaccgcccgctaatacatcgacctgactcataggcgcaggctctgctacgctgaacagttgctgggcatcggtgagttctgcgaacacgacttccatcattcgatcatgcagcagcgcctcaagtgttgcgatttgtgctgcggtcagcgccgtttctgcttcaacataataagccgtaccgcgctcaaggcgcttgatgccatgcaggccacagttgtgtgcaatatcggtggcttttgaggaccaaggtgagatggttccggggcgcggcgtcaccaacagcagtaaaccttgcggttcatgctcttgaatggttggaccataagtgagcagtttttcgagcttttccaactcttgcggattgagctctgccttgagatcggcaaagtgcataaactcggcgtaaataccggttacaggcagttgctgttcacgacacgcggtcaggagcttgttaacacgaaactctgaaagagctggggagccacgcaaaattctcatgtgcttaggtctctatgtccaattgattgaggtgtaattggcataaactctttcgaatacagcacattaaactctatttgttgaatgtatgccgatttcacctctactgatggctgcgcattatagaggaattctttttgtgacgtaacaccaaaagcaaccgtttgcgtcatttttttcgttaattttgagttacgacccatttgcacaaatcttcgagcaaaatgacagcttactcagtgaggactttgccaaaaccagcgcctttgatataaaggcatctgtcttgatgagagaaaacccaaattgatgactccttttgcctataaactccccattcgcgcactctggctaggcttattaagcctgctcttagtcggttgccaaatcgattccgagcccaaaagcgagctagaaaaaattcgtgaacgtggtgttttacgcgttggtacgctcaacaatcccctctcctactacatcggccctgatggcccaacgggattggattacgagttagcccgcgaatttgccaaagagcttggcgtaaagctggaaatgaagccagcataccgcctatctagcctgtttcctgccttaaaaaacggtgaagtggacatcattgccgcaggcttaagccaatccgaagagcgactcaaagattttcgcgcaggtcctgcttattattacgtttcgcagcaagtggtctataaaaaaggtgactggcgaccacgcagcttcaaacagttggtcgaacgccagcaaaccttattaaaggacaatcctgagctcgcctttttcagcgtggtggatgactcccattttgagcacaccttgctagccaaacagcagaaataccccgattttcaatttcatgtcgacagcaattccgatgtgaatgacttactgaaaaaagtctcacaaggagagttactgtttacgatggccgactctgttgaggtgtcgctttctcaacgcatctatcctgaactggcggcggcatttgaattaaccgaagatcagccgatctcatggtttatccgccgttccgacgatgaaagtctgtatgccttaatgattgaattctttggcaatctcaagcaatcgggctatttggcgtctttggaagaaaaatacatcggccatattggtgcctttgattatgtcgatacccgcgcctttattcgcgcgctggatacacgattacctcgatggacgcctctctttcaaaagtactcggcagagtttgattggcgtttagtcgccgcacttgcgtatcaggagtcgcactggaatccgtatgccaaatcgcccacgggtgtccgtggtttgatgatgttgacactaccaaccgcgcgcagtgtaggggtaagcgatcgcctcgatccagaacagtcgattcgtggtggggtggaatacttgcgacgtatgatggagcgtgtccctgactcgatttccgaacatgaaaaaatttggtttgccttagcctcttacaacattggctacgggcatatgatggatgcgcgacgcttaaccaaaagccaaggcgcagatcctgactcatgggcggatgtcaaagatcgcctaccacagctacagcagaaaaaatatttcacccagacccgctatggctatgcgcgtggcgacgaagcacgtaattatgtggaaaatattcgccgttactatcaaagcatcatcggccatcttgagcagcgtcaattggcgacaggcgatgaaagtattgaagatctcaccgtgattgcgcttgatgaagaatttttcaatgaagaagcaaaccgtgaaatcttggatgaagaagcggaagcactcgaatcagagtcactcgaaaacagtgaatcgagcgccgagccatctgccaaaccatccactgagagcaaaaattagccacttgatttttgggaagaaaacacgtaaatcaatgtgtgaattaaatcgctttcctgttgtcagaaacaggtaacattccaatgcaataataaagcagatcgataagcgatttattaggttccctgacgttaagtagtcagggtttttatgtcagtcagtcgtaggagggtgttttatgttgagacgtaaacgtcaatcaaaactcctgaataaaaccgtatccgctaaccgcagacgccgtatgctggccaatagcaagaaaaaagtcttggctcgtcatcgtgcatttgtccagttaagtagctagatacctctcgaatggcaaacatctgtatcgatgtttgccaaaaattcaccgctcattctttctctcagcattctttcgctctgcatcgcgtttggctttaatttcttttcttcggcgctgaaaaaacgcttgtaactgagctcgacactcctcttccaacagccctttttcaaccgtcgcgtagtgataagcagcttggctgctaaacagatccatcacagttcctgccgcacccgctttcaaatctggcgcgccatacacaatacgttttactcgactatgcaacagggcgcctgcacacattgggcaaggttccagtgtcacatacaaggtggtatcgagtagtcgataattactcagtgctttgccagcttttcgaatcacttcaatttctgcatgcgcagtcgcatcatggttcgtaatcgaaccattccagccttccgcaatgatttcgccatctcgaactaataccgctccaacagggacttctccctgcgcttcggcttgggctgctaacacgatggctcggcgcataaattgttcatcttgagcagaaaatagagacgctgacaaaatcacactccacggattcttgaaaacggtgattctagcggagatcgcggacaaaacaaaagccagcctaagaaaaagcccactcgaaggagtgggctgacgatgtttatcggtttaatcacttacatggtgtaagtgtacggagcttgaatacccagcgggatacccagtgcccagtaaaccagcaggaacagtgaccaaccaatcagcatagcgattgagtacggcatcatcatcgaagccaaagtgccgataccggttgatttcacatagcgttggcaatacaccaccaccagtgggaagaacaccatcaatggagaaataatgttagacacagaatcccccacacgatatgccgcttgagacagttcaggagaaatacccactgccatcaacattggcaccaaaattggaccaatcaacgcccacttagccgatgctgaaccgactaataagttgaccatcgcagtgagtagaatcatgcccacaatcgtggcttgccccggcaaattcatcgcttttagaccttctgcaccatacagagccaacatagtaccaatgttagattgaccaaaagcagacaagaattgcgcacagaaaaacgacatcacaatgtacgcgcccatggtagacatggtggccgacattgctttgatcacatcgttactgtttttgaaggttcctgcgacacggccgtagacaatccccgggataataaacaggagaaaaatcagtggcacaattgatttcatgatcggcgcagtgaaggcggtaatttcaccgtcaggcgaacgcagcgcagaattttcaggccacacggcagccactaacagtgcgatacccgcaaccattgcccagcctgcgtaacggaaagcttttgattcaatcgcagtgaaagagcccaaatcgggtgctgattctgcatcctcatccactttcgtcgccgccaaacgtggctcaatcactttatctgtcacataccaaccaatcgcgacgatgatgattgaggaaaggcccgtgaagtaaatgttggctaatgggttaacttgataagactgatccaacacttgcgctgccgtttgcgtaaagcccgccaacagcggatcgatacctgacggaataaagtttgccgagaaaccaccagatacgccagcaaacgcggcagcaatacctgcgagcggatgacgacctgctgcgtggaaaatgataccgcccagaggaatcaccaacacataaccagcatcggctgcggtgtgcgaaataatcgccaccaaaatcagcataggcgtcagcaatttcgctggcgtgacattaagcattttctttaggccagtagtgataaagcctgaagagtcagccacgccaaccccgagcatagcgacaagaacaatgcccaatggcgcaaaactggtaaatgtggtcaccatattggccagaaaatgagccagtgattcgccggtcagtaagtttttgatttctaatgcttcattagtacgagggttagtcaaatcaaaactgacgttagagagtagagcggaagaaacccaaacgataactaatgcccaaaagaaaagaatcgcgggatctgggatcttgttccctgcccgttcaataaagttgagaaagcgatccatcccacttggtttggccgatggcgcttgattgatagcttggttactcatagtaaattccgtaatgtgatgttgctgcgtgaggccttgttagtgtggccttctgtgtccgtttcgagtttccctgtgaaccattgaaattggtcacaatgaaacggcgatttgtcgtttggcattgtatagaaacgcctaaaccaaagcacagcgttcgtcctttttttacatatttagagacatattttgcaaaaatagaaaaccaaagacacacactcgaaacattatcaataacgaagcatatacatttaagaaaccaatttgcaaagcatgagtttgcacttatcagcgccgacaaaagcaaaagtgaagcaaatggatgggaaaagagcataaagaagcgaaaatcacagcacaataaagcgagaaaaatcgcgtggcaagaaggactcgttcagtcaaattcgctgtatttagagatcatggttttcaactccaccgactgagtttcaccatggcgatccttccatgacgcttggatatgaatggttttgagagcccccgacaaggttgcagcgggtacagaccaagacaaagtatagaaaggatgtgaaacatcattcccagagacaatatcggtcgcgaaatttgcagttggtatggcagggttagctgaagaagcgccacgagaacgaaaccactccaatttttgctcggcaagatttaacgcttcaatactgtgcatcgcgtaatcagcgcgttgctcgatataagcttgtaatttcaccaaaccaagcgcaccaacgccaatcagtacaaacgagatcatcacttcgattaagctaaaaccagattgcttattgcgcattccagcttccttctttccaacgcggttttacaaaattactcgcaatatgatcgatcacatctttattaaaattaaatactaaggagttattaaatgccgcggcctgacctgcgctgtcaagaaactgcccaccagtcacagtaaatgaaccgtgttgataataagaggcaattgttctgaatgagtctggtatgacacttggattatgatttaaataggcattcgcttcaaaagaggcccaatgttgagttgatggaacatagtccttattgaaatgaaacaatactccttttaactctccatttcccataacggaaaaaatcccttcgtgaaccaaaatcaatacaccaggtgttttttgagaggcttcagaaaccttttgtgtataaatagcattaagttcacaccctccttcaatccagaggtaataatgtttattttctatttgttccaatatttccttcccgcaatcaggaacaatactaggttgaccattcgtattttctggagcaagaatttgcgtgaacttcggattgttctttattttttcatgctgttcttcactaacatcaaagaactcttcaaataagctcatttctggttgcttaacaaaatcactaccagtgggcagacttcccgacgcactcgatttatgtgtggtttggcaatccttacccgttggatttacgaatccagtatagggcggtttgttaggaattaagactccatcattttgtatagcaccagatgcatcaaaaatatttttataacgtagcgcaatacattcccacccctctgaattaaaagcacctgggtctggaacaatattcacactccctcgaacataaatatcagaagctgattgaattgcaccatgagccatattgcctgagataagaatatctttaactaatgaagcataaccatagtgggaggttactttataccctgaactgattaaactaaattgaggtataatacctaagccactaccacaatcagtaatcgtacccgggagtccattggcaaataaaaactgtgagtagccacactccaacccaccctcagcaagccagtgctcctgcctagcttttacttcattttgtgcacgtttaatctgataaaaaagatttttatacgaaccgagcgtcacaaccaatgcaattgaaagcagaatagcggtaatcagtaaagtcgcgacacctttttgatattgaatcattatttccaattcctttgctgaacctgtaatgagatagcattagagatattagggtcatcttttaacttcgccataatagaaatcgtcatcaatgaactattgaccgcttgaccagataaaggcgtttctgatatttcaaattgatcaattttgatttgtttcgggtcaaataaatcaaaacatcctgtcgcagcagagacaacactgagtggagaagctgaatccttttgacaatactccaacatatcattatttaattgataggtcgtattgctcaccttggtggatgattttcgataaacataaccaattttattcgatgctcgatagatcacaccgacagcaccagatagccgcatagattggttacccacatcgtcaaaaccagcacgctggatatcctctttcatctgctgcataacgctgctgacttgctgaagcagcataatttctttactgcgttgcgctgccgctttttggttagacaaaaagacagtcccgacaatagctaaagccatcgcccccaccaaagcggcaaccataaattcaatcagcgtattaccttgctggttagcacttttcaaagccatattttgcctcattttcggtgcaaactttgattcgtccagcccgattgtgcacagtcactttgattgaatctgcagcagattccgacggtttaataaaaaggctacctgcttcctgaggattgcccattacatgatcaaatttgacctctgttagtgtattggtcttcgatacaaatacattttgatatcgctgaccttgcaacagagcaaccgtattacttgcatcgatcgctgccacatccgatacgctggatagcaccagttgccattgacccgttatagaaggcaatccttgaatatgcacccataagtcctgatttcgaaaaacagcttcagatttagcttgaataaggaatccctgtaattcattggctaaattggtcatcttcgtttgctggctcacctttgagaaattgggggcagcaaaaagcaacattgtggttaataccgcaacggtgatcaaaagctccagcaaagtaaagccgcgatgcatttcccaaaatcctttgcaaaccgtgagaggatgatgaatcaacttgcatagatgctaacagctatcaaaaatggcgttgttttataaagagaagtaatggaaatgattcgaaaaattttctgcaagccaagtgtgagtcagcaacaaggtatgacattgatcgaattaatgatcgcggtagtgatcgtgggagtgttagcgagcatcgcttatccagcctataccaactatgtcaaagaaggtcatcgtaaacaggcgatggcagatatggccaaaattcagctctatttagaggaaaagtatcagaatggctatacggcgacaggcatcgtcgatgctcaaaaggtatgtaattccttttgtagcgtagacagtgatcgttacaagattgtggtcgaaactgcagccactagttatgcgattacagccactccgcaatctagtaaaggacaaaatagtgatcaatgcgacggtagcgcctacacctctctcaccttgaatgagaaaggtgtgacatcaccgattgggtgctggaaataagaaaagaccagcaagctggtcttttcgatagtgactcattgaatcttgattaactggttaagtcatcaaaaaacttcttcacaccattaaagaagccttcggctttcggcttgtgtttcgtcgccgcttcgccgccacaagactcttcaaactctttcagcagctctttctgacgagcactcaaattgactggggtttcgaccacaagtttgacaatcagatcgcccagtgctgcagagcgaacgcctttcacacctttaccgcgcatgcggaacatgcgacccgtttgggtttccgcaggcactttcaagctcacgcgaccatcgagtgtcggtacttctacttcaccgcccagagccgccattgcgaagctcactggtacttcacagtacaagttattgccatcacgctcgaaaatgtggtgctctttgacatgcacttgtacgtacaaatcccctgctggcgcgcccatttctcccgcttctccttcaccggaaagacgaatgcgatcgccggtatccacacccgctggaattttcacattgagtgtcttggtcttttgcttgcgaccttggccatgacagacgttacaaggatctttgatgatcttgcctttaccatgacaagttggacaggtttgctgcaccgcaaagaagccctgacgcatctggacttggccatgaccgtgacaggttccacaagtttgtgctgaggtgccttttttcgcacctgatccatcgcaagcgtcacagtgtactaatgtcggtacttcaatctctttcgagcagccgcgaaccgcttcttcaaggctcagttccatgttgtaacgtagatcggagccacgctgtgctcttggaccgccgccacggcgaccaccaccgaaaatatcaccaaacacgtcaccgaaaatatcgccaaaatcagcaccgccaccgccgaagccgccgccaccaaaaccacccgcgccttgctcaaatgccgcatggccgtattggtcataagctgctttcttctgcgcatcggtcagaatttcatacgcttctttgacttctttaaacttttccgccgcaccagcatctcccgagttgcggtccgggtggtatttcatcgcaaggcgtttgtatgcctttttaatatcacgctcggaggcgtcacggcctacgcctaatacttcgtaaaaatcacgttttgacatgttctcagtcaccaatttattactgccaacggctacgccgctcggtgggtatcgatatagataagggggatcccgttgcctttatctgtagcgacacgcttcaaacagacgggcgtaagagtttcctcaaacgcccgctgcttcaaagttcaataagaactcagcaaaccgcacgcatgatttcgtgcggtatcactcaattacttcttatcgtcgttaacttcttcaaactcagcgtccactacgtcatcttctttagctgaagattgacccgcgtttgcaccttgtgcttgagcttgttgctgtgcgatttccatcagcttctgtgccgccgccatcagtgcttgcactttggcatcgatttccgctttgtcttcgccttttttcgctgtttctagctcgttgatcgccgtttcgatcttcgctttctcatccgctggcagtgcttcgcctgcttctgtgatttgtttgcgagttgcgtggatcatctggtctgcttggttacgcgcagtcgctaactcttcgaactttttgtccgcttctttgttcgcttcagcttcttgaaccattttttcgatttcagcatcgctcagaccgccagaagcttggatagtgatcttctgctctttaccagtctgtttgtctttggctgaaacgtgcaggataccgtctgcatccaagtcaaagataacttcgatttgtggcataccacgtggcgcagggttgatgccctctaggttaaattgacccagagatttgttgtacatcgcttgcttacgctcaccttgcagtacgtggatggttactgcgctttggttatcttccgccgtagagaacacttggttcgctttggttgggatagtggtgtttttctcgatgagtttagtcatcacaccgcccatggtttcaatacccagagacagaggcgttacgtctagcagcagaacgtcttttacttcacccgctagaacaccgccttgaaccgcagcacctaccgctaccgcttcgtctgggttcacgtctttacgtggctctttaccaaagaattcagctactttcttctgaaccattggcatacgagtttgaccaccgactaggataacgtcagtaatgtcgttcacagacagatcagcatccgccagagcaactttcagtggttccagagaacgttgaaccagatcttcaaccagcgcttccagtttcgcacgagtcactttgatgttcatgtgcttaggaccggtcgcatctgcggtgatgtatggcaggttaacgtcagtttgctgcgcagaagaaagttcgattttcgctttctcagccgcttctttcagacgttgcattgccagcgggtcgttacgcaggtcgatgccttggtctttcttgaactcgtcaactaggtagttgatcatgcggttgtcaaaatcttcaccacctaggtgagtgtcaccgttggtagacagaacttcgaaggttttctcgccttcaacttcatcgatctcaatgatagagatatcgaatgtaccaccaccaaggtcatacaccgcgatagtgcgatcaccgccttgcttgtctaggccataagccagagctgctgcggttggctcgttgatgatacgtttcacttctagacctgcgatacggccagcatctttggttgcttgacgctgagcatcgttaaagtaagcaggtacagtgataactgctgcagtaacgggttcgccgaggaaatcttccgcggttttcttcattttcttcagcacttcagcagacacttgaggagcggccattttttggcctttcgcttcaacccaagcatcaccgttgtcagccttaacaattttgtaaggcatgattttgatatcgcgctgaacttcttcgtcttcaaaacgacgaccgatcagacgcttgattgcaaatagcgtgttttgtgggttagtgactgcttgacgtttcgcaggttgacccaccagagtttcaccgtctgtgtatgcaattacagaaggagtagtacgctcaccctctgcgttttcaattacgcgaggcttgtcgccgtccagcacagcaacacatgagtttgtagtacctaagtcaataccaatgattttacccatcaggctatctccaaaaaaattctatgttcgagtttgtatacccctaatgtggggatggagaatcgggtttcaacccctactcacaaaccaaaacgggcttgtttgcttctcgtatgccccttaaataaggtcttcaaaaaccatttcaagggtaaaagtgaaaaaaattcagatttattgtgtttttgcgcataaatcggttttagaacataaaaaagcgaagccaatcggcttcgcttcttctgtcgctcagggtctaggaattacttagacaccatcaccatagcagggcgtaatacacgaccattcagttcatagcctttttgcatcacaaacatcaccgtgtttggctcatgctcagcgctttcttgaatcgacatggcttggtggaattcagggttaaacacttcaccgtgcgggttaatctctttcaagccgaacttcgcaatcgtatcaacgaaagttttgtgcgtcagttctacaccttccagcagaggtttgatcgcttcaacttcaccatcggcggcttgaatcgcacgctcaaggttatcaatcactggcagtagctcttcagcaaagcggctcagcgcaaatttacgtgctttatccacttcctgctcgctacggcgacgcatgttttcgacttccgcacgggcacgcagtacgctgtcttgctgctctttcacgcgctcttcgctcacaagcagcgccgcttctaactgagcaattttcgcttctttctcatcgatttcgtcagcggcttggttccagtcgatatcggcatctgttcctacaacttcagcttcagtctcaaccgcgtcttgttgcagctgctcgtctttgttcttgatctcttcgttgctcatgatatctccaaaattcacttcatactggtcaggagaaatcgtctaatcgtcgatttcccaacacaaaaattcgcataaaagcacaacttgcccttattatggggacgatgaattctgattcaagcctaaatcggttggaaaccttatgaaaaagccgttcaacgttcttgccatcattggaaaaccgcgcgatcaacaagccattcaaactcataaagagatttaccactggctaagatcgctcggatataccgtgtttatcgatgatcgtttacgggaaattctgaccgatttacccaccgaacattttgcaagcctgattgaactgggcaaaaaagccgatttggcgattgtggtcggtggcgatggcaacatgcttggtgctgcgcgcgtgttgtcccgctttgatatcagtgtgatcggggttaatcgtggcaatttaggctttttgaccgatttaaacccagaagatttccaacagcgcttacaagaagtgttggatggtcactatttgcaagaaactcgctttttgcttgaagcggaaatccatcgccacggtcaagtgaaaagccataatgccgccttgaatgaagccgtgcttcatccaggaaaaatagcgcatatgattgaatttgaagtctatattgatgataacttcgctttctctcagcgctccgatgggttaattgtctcaaccccaaccggctcgactgcttattcactttccggcggaggcccgatcctctcgccaagcctgaatgccattactttagtgcctatgtttccgcataccctctcctgccgcccattagtggtgggcggaaatcaacgcattaaactggtggtttctcctgaaaatcgcggcactcaagaagtgagctgtgatggacaagtctcattacctgtgtcgcctggtgatgaaatccacatctatcaaagccctaatgtgctgaaactgatccatcctcaagactacagttactaccacgtattgcgtactaagcttggctggtcgagcaaactgttttgatttcgttcacagattttgctcatagagcgtaaaagtgaccaaaaaattttacctgagtgactttactgtataaagaaacagtataaactgtttaaacatacagtattggttaatcatacaggtgcaaacatgctggctcacttaagtatcaataacttcgctatcgtaaagtcactacaactcgaattatcaaaaggaatgaccaccatcaccggtgaaactggtgctggtaaatccattgcgattgatgctttaggtttatgtctcggtggtcgagccgaagccagcatggtgcgtcaaggtgaagataaaaccgaagtcagcgccgcctttcatctggataacaatctgctcgctagccgttggttagaagataatgaactgcttgaaggcaaagagtgcattctgcgccgaatcatcaccaaagatgggcgctctaaagcctttattaatggcagcccagttccgctctctcaactcaaaacattggggcaactgctgatcaatgtgcatggtcaacacgcacatcagcaactgatgaaaccggaatatcagctcagcatgcttgatcaatacgcaggtcatgcagacttgctcaaagccacgcgtcacgcctatcaaaattggcgtcaagcgagcaatcagctcaaacagctgcgcgaaaatagccaacaaaatcaggcacaattacaacttttggaataccaaatcaaagagctcaacgaattggctctcggtgaggatgagtttgtcgagctagaacaagagcaaaaacgcttagccaatagcggcgatctggcactcaactgccaacgcgcgattgaactgctcaatgaaggggaagaagtaaacgccttaggccttttacaaagtgttagccatacgctgattgatctggctgaaatggatagcaaactgacagcgctcccttcaatggtggccgaagcgctgatccaacttgaagagacttaccatgaactgcgcaattacttggattcgattgatgtcgacccagaacgcatggcgtatgtagaagagcgctactccaaagtcatgtcgctcgcgcgtaaacatcatgtactgccagaagagctgtatcagcatcaccaagcactcttacagcaaattgctcagctagattgttctgatgagaaaatgtcagcactcgcgagtgaagtcgacgtgctctaccaaacgtttgttgcggccgctgacaaactgcacaaatctcgtgttcgctatgccaaagaattggataaattgattagccaaagcatgcatgagctgagcatggaaaaagcgcaattcaaaatcgaagtgcagcaagacagcgcgcactcatcgccattaggttttgatgccgtgactttcttagtctcgacgaacccgggtcaaccgctgcaacccatcgccaaagtggcctctggtggtgaactgtcacggatgtcattggcgatccaagtgattactgcgcagaaagtcgatactccaagcctgatttttgatgaagttgacgtgggtatttcagggccaacagcagccgtagttggcaaactactgcgcaaattgggcgagtcgactcaagtactgtgtgtcacccacttaccgcaagtggcaggttgcggacaccatcaactgtttgtcgccaaacagaccaaagcaggcaaaaccgaaacgcaaatgctcaaactggatcaagaacagcgcattgctgaacttgcacgcttgctcggaggcagccaaattaccgaatccacgctcgcgaatgctaaagagctattaatcgcagcctaatttcatatcgcatcactggattttttgttcagctttgcaaccaaactcaaaattcacagtctcaataggctcagagcacgatcgaggtttttacatctgctctgagcttgtttattatcagccaagtttttagccctgagggacagagagttttaacaatgcagtttactaagtggttcatcgcccttccccttgccgtcaccgccttatccggctgctctttattagagcgcttggtgtatcgaatcgatatcaatcagggtaactatgttgatcaacaatccgtcgatcagctcaagtttggcatgagcaaagatcaagttcgttttgttctcggctcacctatgttggttgaaaatggctacccagatacttggtattacatttaccaccacacccaaggccataacgatccggtacaaaagaacctgatcgtgaaatttaacgatggtggcaagctagtcaatgtcgcgggagatttccctgctggcgattctttcttcgaaggcgtcaactaagcgcactttgctgattaaaaaagaaaaggctttcacaagccttttctttttttggtgttgattcttcagccgtcacattaactttgattagcggccgctttggcttgctccgcacgtttacggcgaatctctttcgggtcagccaataatgggcgataaatctcaatccgatctttatctcgcaccctagcatccaacttcacattccggctgaaaatgcccaccttattgaccgtcagatcaatctcaggatacatctgcaaaatgcctgaggtacggatgatctcttccaccgttgccgattgctcaaccaccagcttgagtacacgttgctcatgcggtagcgcatacaccacttcaacatgaatcatttcactgctcatcatcactctccatacacctgttttgctcggcgagtaaacgcattcaccatattgctggtcaattcattaaaaattttgccaaacgccaactcaatcattttgctggaaaactcaaactccaaacgcagctcaactttacacgcggcttcatccaacggagtgaaaaaccatccaccgcgcagcgttttaaaaggcccatccaccaagctcatggcaatcgacaccccgggcgtcaattgattcgaggtggtaaacgtcttactgatccccgcttttgaaacatccaccgatgccaccatatgtgcctcactctgctccagcacacaagaacccgaacaaccgggcaaaaactcaggataacgcgccacatcattgaccaaatgaaacatctgctctgcactaaacgagaccaaggcagaacgactcacttgtttcattttcactccttaccacgactcaaacagcttgggaaaacggattgtactttcatccccccagcacctcaagccatcaggctcgcacaacacaatacagcgcttgagtcatcgcgcagataaccgtatgctacggcaaacaaaagcgtttcctaaccgctgaccaatccgtataatgcgcccactatgacaaaaaagaaaaccaataccaaagcgggtagcaacactatcgcgctgaacaaaaaagctcgccacgaatacttcatcgaagatgaatttgaagccggcatggagctacaaggctgggaagtcaaatcacttcgccaaggtaaagccaacattgcagaaagctacgtctacatcaaagatggcgaagcgttcatttccggtatgaccatcattccgttgcagcaagcctccactcacgtggtagccaaccctacccgtatccgcaagctgctactttcacgccgcgagctggacaacctgtttggccgcatcaaccgtgaagggatgacactaaccgcattgtcactctactggtctcgttcgtgggtcaaaatcaaaattggcgttgcgaaaggtaagaaactgcacgacaaacgtgaagatctgaaagaaaaagagtggcaacgccaaaaagatcgagtgatgaagagcgcgttgcgctaatagtaaccacttgaaaaatgggagctagacagaagcacttattctggtactatgcacccgttacctctggggctgattcaggattcgacgggaattttgcagtctgaggtgcatgccgaggtgcggtaggcctcgttaacaaaccgcaaaaaaatagtcgcaaacgacgaaaactacgcactagcagcttaataccctgctcagagcccttcctccctagcttccgcttgtaagacggggaaatcaggaaggtcaaaccaaatcaagctggcgtggattcccccacctgagggatgaagcgcgagatctaattcaggttagccattcgttagcgtgtcggttcgcaggcggtggtgaaattaaagatcgactaagcatgtagtaccaaagatgaatggttttcggacgggggttcaactccccccagctccaccaaatcatagtttaaagacgtctccgggcgtcttttttcttatataaaacaattaaaaaatcaataacttagcattcatagctattccacaagattccatagcagctttgatttttaggtacactacaaggtacactgattttatcgtgttaatctggtgtacccatcatggcaaaaaacacagtaaagctgacagataaagagatcaaagcctccaaacctagagagaaagaatataatcttttcgatggtgatggcttgcgacttagaatcaaacctaacggttcaaagcagtggatcttcaactactatcgccccacaaacggtaaacgagctaacttaagctttggaatgtacccagacatctcccttttacaagcaagaaaaagcttactttctgccaaagagctgatcgcacaaggcatcgatccacaagacgatcgaaaacgccaacaacaagtacataaagagatccatgagcacacctttgagaacgtcacaaaggattggtttgccatcaaacagaatgatgtgacaccggattacgcccttgatatctggcgttcattagagctacatatcttcccgcacatttccgacaaaccggtaaaagcgatcaccgctccggagatcatagaactactcaaaccgattgaagccaaaggtagcctagaaaccgtcaaacgtttaacacagcgactcaatgaagtgatgaacttcgccactaactgcggtcttatccaggccaatccattaactggcatcaaagccgccttcaagaaaccaaaaaaagaaaacatggcagcactgacaccagcagaactgcccgaactcatgagcgcaatcgctaatgccagtatcaaacgcactacccgttgtttacttgagtggcaactacacaccatgacgcgcccagcggaagcatctggtgcacgttgggatgaaattaattgggaagaaaaggtttggaccattcctgctgaaagaatgaaaaaaagaagagaacaccgcatcccgctcacagagcagatgctggcgctattggaagtaatgaaaccgataagtggccatcgtgattttatttttccgtcggatagagccccgaaaaagccctgcaacagccaaacggcaaatatggcattgaaacgtatggggtttgctggaaggctggttagtcacggtttgcgctctctagcgagtaccacactcaacgaacaaggctttgatccagacttggttgagtcggcattggctcacgtggacgataaccaagtacgcagtgcctataaccgcactgactacttagaacgcagaaaaccaatgatgtgctggtggagcgagcatatagaagaggcagccagaggtagcctatctgtgactggtacaaagcaattgaaaaataaacttccaccgccccccacatggaagcagatgtgatcctaacggcattctttttgttctaagaactggttgtcagtggaatacgcttaacgcggcgagtatttttacctctagctctgcacatcgtcgctttcaaaagcgtcgagatgcaagtgtatttgaactaatttggcaaaatggaatgattaacaaaggtattgattggcgttctatattaatggatggctgccaaactaaggttcctttagctagctcaaaaaaggcaagaacccaacagacagagtaaaacaagacgtaaaacgcagtttgttgacggatgaaaatggatcgccacgtgctgttgtcagtgacggagccaacgttcacgacatcaaatttgtactcaaaactttagaagcattagagtgctgtcgtctgctggtacgtatcccgatatctcttcggcagaagctcgagagaaagccttgaggatcgcaaacagttagcggatatcatggatcctcaactcgctaaagaagaacaaaaggcgaaaaccattactgacatttaagtttgttgtagaacagtggaaagctagtaaacaagggcaaatataagaaacactggaaggtaattggagaaaacttgaactttattcctttcccaaattgagttcgatacccgttagtaaacttacagcacaaattgccatcgcaacatgacgcccaattgagtatcaaggattactagaaaccgtaaaacacactgcccaacttatgaatgaaatcattaactatgtggtgaatagcggtgtcattcatgccaacccattggcagggatccgtgatgtgtttaaaaaacacaaagttgtacatattaaagcgctacaactgcatgaaatgcattatcttatatgtacaatatccagcacgtgacgcgatttttaattgaatggcagactcacaccatggttcggcctagcaaagtctcaggcgctcgttgggaataaatcgacagagttaataagctttgcacttagtatatgaatccaaagagcaaatgaagatgaaccgtgaacacgtagtgccaatgacagcataaacattggttattcttgaagtgattaagcctatcattggtcatagaacattcattttcccatctagccgcaatccaaaggtacccactaatacagaaacagccaataaatcacttagtagaataggatttaaagatagagtgatcgcgcacggtgttcgggctttggcaagtaccacttttaatgaacagggctttaaacctgatgttattgaacccgcattggctcatacaaataagtaaagcatacaaccgtaccgactatttagagaaacgtcgaaaactcatgggttggtaaagcgagcacatagaaaaatctagctatggatgttacagtatggctggtgataaatatttgcacttagtgaaagcctaaagaggccaagttcagcgtatcactaaattcataagcttaaatagaaacaagagcgttaaaaaaatattttccacttaaaaaaaacaaaatcatctttcataacagctatgatactggcactataaacatacatgagcggttacctcatgtattgttacaagctgacgattaagcactttttggcgcactgcggtgcgccttttttttgttttaaaaaaacacacacaaacctatctctataatattattatagcaatgtaaccaacctcaatattaacccttaggatattcaatagtaactaaatgtttttcatcatatatatgacgtcaaatataatactccagaacatatagatgttgttttctatatgaaataaaaactattcattcctaatttatgagagtgaaacaaaaaatatttaacataaaatctgagtaggattttatgttaggaagcaaactagatccccctagctaagctagggggaataactgtactaatgttgtgtaacactgtttatagaaaggggatttttttggggaagattcaattttaaagatttgactctctgaatcccagaaggagttattcctccttcgtaatatggctgaggatcatctggatagagaaatgccttacttcccggattccatgctttaaaaaattctgacaaatccgtctgagcggcatatgatgcacaaagcattaatagatcacttttaccaataccagatatcttacattgattttctcccttcatattgatttggtcatcgttctcatttctcattaaccgatgcatcagtttaaacaagttccaaccttttattccgctttcttcaatataaaaaccaggtagcttatcattataccagtcatttatatcaaactcagtttctgcccactctttaagttgcgcaaacataactaaacgttcaccagcaccaccggctccccaagcatgcccatgctcagcattaacaaaatcgaaagcataacggatatcctgttctacacgagacatttttccttgatgacgatcttgcatatataaggcaagtaagttgtttacaacttctgtggccccatcaacattaaaaggagcttctgctgaattatgcccgacctcatgccaaagcagccagctgttcagcggcatagtgttcaaactacggctactggtaataaaactatcattcatgaccggatagccagagtgtgcagcaccaacacttattgcgacatcattgacgaaatggtgacgattattaggcattgacttatcagtagctttgcgatttttgtcaccgtccgcaccttcatcacgggcataaaaatcgtttaaatccgctgagaattgatcaagatcttttgcaaactgttcgatcccccccaaataaccatcggcatttaaatttgctttaggtgcagtaaatatgaaggtgtctgacactacttcaccaattggtgcgccagataaaagagggtttctccacttaccgtcaatatagagcggtgcatctatagttcctgaaaatgttagtttgacctgttgagaatttcccccttgtgcatatattaacccaccatagggtacggtaaaagtctgcattttcggactatcgccgccaataacaaatgatttgctcatgcgaggaggacgctttaaaccaagctcatgcttctctcggccagttaaatcatcagccaatgcaatggtgatggtgacaggcgatgtttctcctgagactgaaacactaaaaggctgatgagcttcggcccactgccctgtcggctgcctattacccgcaaaccaagctgccgtattattacgcatgtcaagagtaatatcccctccacctgatcttgttgtgacttcaccggggtactttctgacatcaactttgatatcaagatcccagaatgagcgccctaacattaaacgggtcagtggcttttccatataattaagtgggtaacttggatccatttgacctgcatagcttcctgatttttcgtcataaatcatacctagctgagtaagttcatctttcaattcttctgggcaagttgtattaccaccagcgttgttactagtgtaacaattcaaatactgtgtaaaaactttaaatccaagctcatcggattgcttatcatcataacgataatcaaggtcgttccaaagccatactgacatattttgataaattcgattcaaatcaacactatttaaacgggctcccgactttcctttagttcggaaataacgttcatgctgatataaagcatgaatatttgtaccaagattagccgcctttaccatagcattggcttcagactctcctaacttaatatcagtatatcggggtacatacaaaccaccagtaataggaattgaattacctggacgatattctaagcaattaatctcataatgaaactcagaatttttacattcagagtaggctctctggccactactgtttttaaaagcatcaagtactttatttttagccaaagataatgatgcattatctacttccggcttccctgccacgttatagattattttacctgaaatatcttttttccagtgctgagactcatcaataaatgcatagtgagtaattaatttatctccagcttcagattcaacccaactcgcgacttcaagtttaggtttatcatcgggcctattctctacaatatacttccactcaattgaaccatcactattaatcacataaggtagcgtctgttgaccagaagactcgtcttcaacagctgcatatcgctcaataacccaaataccgtgctctcgctgactacgtgggcgatctgggtggcctccactcgggccattaccgtcagcaactacactgtttccaatgccaaaagcaataccagcactgtccaataaacgagaaatctcactgttatttgtattaatgatagtctccatcattaatacactaccaccgttgtttatataatcaattaaatcagtgacatcagaacgagacaatttcggactgcctacatcagcacttaatggaatatcatacggactatttatgttttttcctttatagtcgtatgcattgataataataagaggtatagtattaacatctaaatcatggaaactagtcaactgttgagtttgcttagagaatcttgaatcgagttcaaaattggcttttgaccccatagtttggccagatgatttaaagtaaacttctggaatattagttccaacaataacatcattggaagtacttcccgtaagatagcggatgacattactaaaaaaattagccatatcatcacgatcactacttaagctacaagtaccatttttaacagttccgccccaactaaatccattaggacagactaagacactgttatatcgcgcatttcctagtaccatcagcttgcctttaccaatttcgcccaaactaataaaaggtaaattaaaggttgatgtatcttcagatactttatcaggcacaactgtagaaggtgcttcagtaataaatgccagactattcgaatcccatgctttaggtttaccaaaatcaatccagtaattattgtcattacgagccattaagactggaaatgcactattagcaatattcaccgctgcttgtgctcgggcacttcctgtactaccgtagaagtttgtactgtcatgaaaaatatgaaaacgatcgacttttttccatccattagcttgtacggtatcggttgcaccccagagtttattaataatatcttggatttgtgaagattcagaatcaattgctgactttttcttaggcaaactgtcttcaaatttgaacctcgatataggtgaaatagattgatcgataagtgctgctaatccagaatcaaactgcttaaagaattcaccaggtacaatctgagttttaccatctccaatatcaagttcgatatcgccattaggtaatgataatgaaatcacttcattaatgacattagggtatagggaaaaaatctgcgtaactttatctggaatgataagcttagaatcatcaatacttgcataacgatgaatcaaagcttcagcattcttaccctcattgtccttacctaattcactgatataaaaatcagttttattagctcgagtactacctaattcaaatgtatcgattgaaaagctaataatatctccccacgaaaattcaaatgaaccatcatttaaaatagcccctgttttatctacaccagtaataccacgagtattattactgaagtatgaaacaccattaataactcgaccttgactatcaagtaagcgaccaagcgaaggaataacatctgtcggtatatagctcaaagactcttcagcattagcagaaacgaatggactattcaaattagatgaagtcccaggcgtgaatgatggagagatattaggcacatgagttgaaggttgcttatcgacctgattatcattggcgattttttctgtaattgcttctaaaaattggtctttgggaagatctaaattgtgccgtaaataattttcgaatgtcaaggcatcaagagtacttcggaaaactagagatattttatctccatgtattgtcgccatatttttcattaaaatttggagattttcctgtcgaactggcgagtcccggtactcatccgcagagattaaagataaaacttcagaatcagtgttacggccatttttattagcgtcaaagggagcggtaaatgttgcgattgaacgcccgttgatcgtacaaaagacattatctttttgtgatatttgaaaatgagaggcatcttgatcattacacagtaaagaactatcaaatttcaagttaccatctaaagtcatggatagcgagataatgggatccggaacaccaatatctggcaaataaccacctaccaaaccaggatttagtgcgttaccacccgaaccatcagcaggcacagtaggggtaattatactttcatgcttacaacctataagaaaacccaaaactatcaatgatacaatacgaatcttcatcttaagcctattaaacaaaaaacaagaattaattatccttgttaaaaatgaaaaaaatcgctttatacattttgttaaatttattttttaaaaatttaacgagttagcataaaaaaaataaaaaattaaagttagaataaaatgtgaaacacaggtaaaaataggagtaaaaaatgcaaaaaactttatcagcaatttttttgtttacgactttatcagcaaatgcagcaccgtatattggtcttgaacttggaattggaacagcaaatcatagctttgagacgaactatcaaagtgacgctgttagcctaaaccccaatatggaagatatgtttttaggtggactaattggttataaatttaatgataatttttcttttgaaatcaactattcaagttataaattagaagatcaatacagtaagtttataggaattgaatctttaaataatcaacaatatagaaaagagcacgaatggagctctgagattgaagctaaacaacttgcattaatctcagtttactcataccccattcatcagcaattgaaaacaaatataaaagttggtgtgacacatacacaatatgaagcatattctggaaaatatgaagagctagaattactcctaaatgatgatatagagattagaaaagctctattagaaacaggtcttaaaaagaatcgctttggtgcactattttcgttagggttggattataatttaattccagagcttagcgttggaacagagttaagatatcagttcgataagtacaatgatgtgctttctataagtttaaattcaaagtactacttctagtcttattgtgcattgagattcggattcattgcaatccggatctcaatgttagtcagcaattcatcccatttgattaatggtactttattagtaatttcagaaaaattatcgtaattccattttataaatgggtgagggtctagggatttaccgaggaaacggatttcatagtgtaggtgtggcccagaggataacccagtatttcctgagtacgcaattaattcaccttttttgacaaaatccccctctttaaccgagaacttatgcaaatgagagtaactactactaaatccataagtatgctgaagacgcataaaattacctgaaccctgggtactgactcttatcgcttcaacaacaccatctgctggtgaatagattggtgtgccaatagcagcagggaaatcaattccatggtgaatctgcttaactttggtaactggatgcacacgttcaccatagcgagatgatatctttgcatcaggaataggaaagccattaggaatctcattcaacacagtttctttcatatagctaccaagttgctctgtaacagtcaccatatcgatcgattcagcgctatgtacaaaagattctaatctttctaaacgattgatagctaactcgtaacgctcttgctttgaaaacaaatcttccattagttcagatgaagaactgttaattgatgatattttgttctctaagaaaaaggtcttatattcattttttatctgacttagaagagaggaactcaatttcatgtcaaaattaaaaatcaacatagctattgccaaaaaaaacaacataataaaacaaaaagtcaaatgtaaaaacactctatgtctgaattttatgttaaatgtttttgaaccagatatagataataatgtaatcctaagtgtcttattcattttaaatattactgagtactagatggcaattttattacgatggtctttgcgattttatcatgccatccttgattttttttgttaaagaaaatccagaaaaagccgatgaaaaagcctaacagactaatataatatgacaaataacgaattatagattgcttaaatgtcaacttattaagagtatgctcatcaacaacttttaattttaagagcatcttgccaggtgttgcagatttaaaattccaaaataaaatagtaatgcaaagtgataaagataaattagcgatatcgacgtatctactgtttattgcaacatccacatcaaagacattaaatataaacaaaatgacagctagaattaataccgatagcactaaactatcaatcaatgatgcccatagtctatcccagaaagtagcataaataacactaactctttgattcatattagttcctacgaaaaatttcataggagagtacatgtactctccctaaaatcacttaaaccagccatagtgctgaaagattgcttcagcgtctttgctttttgttagataatcaaaaaagtcaatcgcttcactagatggatttttggcaagaacaacgttgaagtcacgataaatacgatattcatcctccattctaaccatatcgccgattgttggattagctatggcccaatcgacccatgtaatccatgcatcaatatcttcaccatcaacaaacgccttacgcgctgatccactatttggggcaaaaacgtgaatattagatctaaatgcctggagtttctcaacatttttcattctaccaactgaatcttcccaaacagcagtgcccgatgtattacttacacctgctccatcatttacgacgattccgataccaggcttcaaaagatcagccatacccttaatatttttcggattacctttttttactaagataattgcttcacgcatgaatacaggatgaatattaaattttgaaaatctttcactatgtccttctgcaatagctagagcagaatgttctgatgcaccgaataaaatatcagcattttttttgctttgtcattccaagtagcttgaggtccaaaagtaatattaacgcgttttgattgtgatttttcaaaactttctgcaactttaatcaatggcacatgtggaccaccaggtccataaagattaacatccgcaaaaacactcgtagaaaatgatagtaaagaaattaataaaaatcgattcttacttttcatgaaatacatccatattaaatgataaacttactgattaaatcatcttgatgaccaatcagtgctttttgagaataagcctgttgagaaatcttattacccaaacttgataaggtatctgctttatcttttatagaaatagagttgctgtttatttcctctgatacgtgactttgttcgtaagcagctgtagctacttgatttgtgatatcaacaatttgtattactgattgactaatattgtctaaacattgttttgaatcagctgatatagtcatagtttcagaggcaatattaaaactttcatccataacatgaacggatagcaaagagttttcttgtaatatatggataatacttcctatatttttagtagactcttgtgtctttattgctaggctgcgtacctcatcagcaaccacagcaaaacctcgtccattttccccagctcgtgcagcctcaattgcagcattaagagcaagaaggtttgtttggtcagcaatatcattaatagccttcaaaataacatctatattttgagtttggcgattaagatcttggataacagatttcgtcttatccaacttctcaactaaattacctacactttcggtaacagaagaaacagcaccgactccttcattcacttgaccgttaatcttagatgtgatctctgatgcttcggatgtaatttgtgcaatctgattagatgttgccaccatctcattcattgagctagctagcatatcaagttcacgatactgatcagctacgctattattgcaaacttcgactagctcttgtgtttcagtagttatgcaatttattttttctgagttcattttaacctccgacacaatagattgcagattaccaacaaaaatgttaaaggaatttattatttttgaaaactcttgatccgtactattcgggatacgaaccgtaagatcagcactgcccgatgaaatatttaccattgcatcggttaattgatgcaatggcttcagcattaaccgcatagtaaacaacaagatagcaaagaaaacacttgctaaaatgacggcagtaaatatactattgtttctcaacgtgataatatcagagcgtgctttatcatggtcgataatagaaacaagattccaaccgccaaagtctgacattttgatgagtacatcgtaatttaccccatttttatctttcgtttttgactcacttaccgatagagggaagctatcaaagtctccaaataaatttttacccgatatatcatttttattaccgaaaattattttcccactgttatcaacgataaaaatcgtgccggcatcaaatggattgtagcttttaattaattcctgaacgtcatctagtggtatatcaaaaaatataactcctgttaaatcgtttttattatatattggtgcacttgttgtcaccattaacttctctgtaatgagatcgacatacggctcagacaaactaaaggtattcaatttttttgcatttaataccacgatcgagtccttggatcgaatcctgtaggcactttaaagtttgggtcattagtaatgatctctcctgttctttcatcagcatatccgaacaattgaaaaacatttgaaagatgattgacatcaacatccttaaatttactgagaggggattccccctccagtaaattttcataaatgtcgataacagattttgacacatcgaccttggactcaatagaaagatttattttatcttccaaagagtctagcgtttcagaaatagtatcttttatcgtacgatcaagatattcattggttccatgcatctgaaagtaagtaaggatagatgaaatagtaattataattgatgtaaaaatcattagtaacttgatagaaaacttcattttagcctcacattaaacggattgaaaaaaaaacaattacaaaagagataataatgcttggtccaagagggatatataagcaataccgacatgagactctagcaaagaaccaatgaataaatgcaataatcgaggacaggcaagaataaatatggtacaaactcaacaccgataagagtaccaatcgcagtatagagctttatatctccacctcccatcacatcgattcttttgaataaccgaacaatgaaattactcacataggatatgatgaaagccgcaaaaccaccaataatagagctttcaactgttaatgctggatttgctgcacataaataaatgccaacatgaatatcggatacgtaagtaaatttggcaatagcatagatttaaaatcaattacaaaaagattgaataaaataaagtaaagcccgagcaatacgaacgaatcaacccagtcagttgataaccaatatattggaaatgcgattataaaaaatgataattcgacaataaaataacttaatgaaattttttcatcacaatgtctacacttaccatgaagtaacaaataacttaacaatggaacattatcataccaactgattttatttccacatttagggcacatggaacgatttgaatcgatgtcataaaaaaaatgattctttagtaaaatttttcttggtagacgataaatcacaacattactaaaactacccaaaatcagtgatacaatcgaaaataggatcaagtaaacgtattccattatttttctgcaactcctgtcaacataaataaatattcacttggtgctacattcatggttgacttaaatactgtagaaaaatatgaaacgctagcaaaccagactgatatgcaatctgttttattttgaattcaccggttttcattagtgaaattgaatatgatattcgaatgctattaattaattctctaaactttactcctcgagactctagttcttttttcaaaatcatccgattcgttcttaattcaccacaaatatctgcccaacgccaattacgcgtaatatcactttttactaaacatgaaattttctccatagcatcaagatcatcagtaataaatatagagttatattttttttctactttcgagaagaaccctgaaaaaaaaacttttaggaactcatctgaataattaatttctctgaaaccatttaccacttcagaaaggacagctatatcattatgttcacaattccaaagtaatagatctttattttcactatataaattccttatcatgagatcaccaagaatgtaagattttagtgaacgyataaatgaatcacttattgtaattacagaaacatttatattttcatctgataatgaagtcaaagaaaatcgctgaatagagtttttcttgagtaagataattgaacttgaatttatctcataactaaccaagcaatttttatctataagctttgcaattccactatctatccagaacattttgtagtcgtttatatataagttattgaatatgtaagtatcaaatttactcattctatatacattagtttgaaaagattttttcccaatcattgcgttctactctgaagatatataaataaacgcagagagccatccacgtaaagttatcttaaaatcgaagttaatataaaactacataacagacataagaacaagttacagacgtattacataagaaaaacataaagtaactcatgttattttatgttttttgagataagataacagccacgaatatggctgttatcttatctattttatttaaagttctctgaatatgctttgctatacagtttcacaccacttccatctcctttagttaataatatttgcgttttataattagaatttgagaacatagtatttgaccacttgtaaccattatgcatgtcatttgtagatacattatacaacttcttacccgttaagttgccactaggctgatatggtttgacagtttcttcataaacagggtcatagataactcctgtttctgcatgtggaactccaacaagaaccttaaactgcacatcccacagattggtatacccgtgcttacttaattcacttacgtcatattctaatactgcgatcattgcaccaccaggttttaaacgactaagagtcccttcataaactttgatatgaggataaatttcattgggaattgcattaactacagaagttgtacccattagtccgcgtttagaaacaatagctggtagtttaactggagtattatctggaacaccaccaacattcacaatatcatatcgaccattttcttttgtaagaaatcgacctgtaatatactcttgattaagtgccgtagacaatttaccttcattagcataattaactagtgtctcaatttgatcccttgtcggtatttcccaatcgaaagtcgtttgagcaagataaaaatctatatacaatttctgtaaactatcataatcaccagctaaaagccgagcagagaaatcttcttttgttcttgtcttagcaccgtcagattctgtcgatgggtatgcgtcataaaacatatcttgagaggttggaaaagatactttcacacagttttcaagataatctctactcataccgattttgatacactctaaataagggtatctaaggtgctcactcccccttgaatccgtagcttcattagacgtagcataaaccgtactggttgaactataattatcattaaatgcaaatgagttaaatgatgtaatcatgattgataacattaaggtttttttatatctcatatatcctcactataaagatgaacttagtttatcaacgagcgaaaagatcgcaccgaagatccaaatcacagacaacgccaacgttattagtgaaatatttttcattacccctgctaaagtggcaatttttttatgtagatttatattggcttcaatagctaatttttgcattacatccgaaaaattaggtagttctgaataaacagccattgtcaggagcatttttttatctagtaaattggtgtcgagagcctgtttgtagtctagcccttcttgcatgttagctttcattctttgcaaatgtgaggagagccagcgtgtcgttttatgatcgacaatgtccagaccttctttaaatgggactcgactatctagcaacatggacatattggccaaaaattctgttgctgcaatatgctttacaaaattaaaaggtggcagcttatctaaaaaaccatctctgaaattccctgtaatgtttttagacataaaaactaaaatcgtaatgaagatagcgacaaaaataagaactttgatccacaagccttcatacaatgaaaatccaaggttataaagtgcttgggtaacaccgggccaccggctcacaggaagtacagactcaaatgtgggaaatacttttactgaatagccagcaataacaaccatagtcacgataagcatcacgctaggcgtgatcatagatgagatagctttagatttgatctcatctgcatcgataatgtttttgcgtattgcagcaataccactcgaaatcttacctgagttttctgcaacattaatcatcaaaacttctttatctggtattagtccagttaaggcatccgttagtgatgaattacttttcatcctatccttaattaattcaatggatttaataaaattcttatcatagatgcccactccctcattttgtattttatttaatgcatcatagagtgggatattatcattcaataagtccacaagcattgaataaagttctagcctatacttcttggagataattttcatatattatattttcatcctcatgatctaactgaccgaaatgcagcataaaatattcgtgacacactttaccttttaaaacattgtaataagctttatctttaatgctgaagccttcaccaagacctttttttccagtttttataaagcgtcgctcccgatatttacgataaagggaaacccagttttcactcgccactagctctaaatcttcaactgttgggactaatgtttctaataaaagcagccttcctttaaacccagaatgattacatgcctcacagccattttcattcgcgctaaatacagcacgctgataacgttcatcaacaaaggaaactttacaacttgggcaaagttcgggaattaatttctgacttgtaataccagccagaaatccaggtgatgctattttgtcagccttcatccctaatcctgaaagtctttgtaaaacagaaacaacagaacctgcatggatggtcgtaagacaatagtggccactttctacagcacttgatagagcctcaacggtaggtttatcacgaatttcaccgatcataataacgtccggatctcgacgcatcgctgaacgtaccgcatcagcaaatgggttctttgttttatcatcattatcggcaacaattgagctttgctgtgctccagaaattaaatactcgacaggatcttcaacggtgacaaaacatccttttcccttatatttattaaagaaaagtaattctatatactttttcaaagatgttgatttaccagaacctgttgttccggaaacaatgaacaatccataagatgtatttagaattcttgcaatcgcatcggtatcagcctcgttatacccaatatcttgatagtttgtacaaacaaaattatttgaaggatagataatacgaactaccgcatgatagtttttccctccctcaccaaataaaggcatatgtgcgtaacgaaagcgatatgccttttcgttgatcacaagaataatatttgcatcttgaggtagttttcggttccacgtcgtttctttcgttgttgccatcacattgtatagaacaaacattagcgcatcggcttctgaacttaatatttctctatagtcgatcattgtgccattcacacggaattttattttacaaatcctatcctctcggatgaagtggatgtcacttgcaccataagctgtagcagatgatgcaattttcattatatctttttctataaaacttaagtctttagcttgctgctcggtaacaagattcgctattaataatttatgatttgcatctgaaactaagaaatacttataaactttatctttcttcagaagattgacccgaaattttgtatcgaattcgagaagagttaatacctcacgctcttcatcgaatttcttacacattaatctcgagtctttaaagaaaaactcctcacgatctatatcaatacgacttaaatactttatatcaattgacatcgattaccttattgcccttggaaaattgaattttattttggtcttcaatgaatttccaaccatttacaaaatcaccattaaccaatgtgataagtttgccattaagattgaatgtatattttttttgttgaccattgttaaccaaataagccaattccactttgagctcttcttctatatgttcgatacttttttgtaattcttctgacgattttactacaggctgaggagataaaacgggtgcagacttatctatttttggcattcttgcattgcgaatctcgccactcagctctgttattttcttttctaactctagtatttcgattttgttttttaaatcagttacacttttgtagtgctcttgagatttttcaaattcgttagcagcaacattaaaacttaacgatagaaaagcaattgaaataaatgatagtttgatattcatttctctaatcccaccttaatagcagtaataatttaacttggatttaaaacttgaattttgcaaagagatagacgtaatcatcatactattattcataatatttttcatcagacccaagtttttctctggcatattttcaatttcaatagaaccgaatttaatgtcactattttttacccagtcataacccgatattgaagttacattcctaggaagatttattttaaatttcacctgttctttcattaacaactgcaaattatacagttcagaaagttttgttgagcactgttcaatgatattttcactcttatctctctcttgctcagtgagatctttgagataaatagaacgaaaaccagatatataatccacatttgcaaactggagcttattctggtcgaactgtggttttataacagctccatttcgattcatttctaaataagtaaaggtgtcaaagcttcctcgtttaaaggctaaattacagttaacattacagtccattacatctaataaccaattatttaccctgaaaaaatcgatatcagatctgagtacatcataaaaaccagttagcgcttggtaatcaagaccttcaaaagccgatttaaaatctgacaaataggtttgtttgtcagagttctctttttgaattttctgtaatcttgcctgctctaactttttcgttttctcattttcatagtataaataggctccacctcccagtattgataaaactaaaaaaataattgccactaacaattttttatcaagctttatattttttatattaatactgaaattgcttcccttcttcaaactgctaatcttcataatcacattaaccaaaatacgccgatactaattattacaatagcaatgaatccaataataaacactttattatttttgacttcatcttcaatcagttgtgcatccaaccttcgtgcttttattttatttagctcatctgctttaagttctactgtttcaaaatcaactaatttctcaacggatatatcattatcattaagaaaatccagacattgaatattgacgccttgataaatgaggatatctttgtaatcatctgattttactaatacattattcattccttcttccatgagaatataagggataaatggattaacatcagatatatcttctttatctttaataaatacgtacttatttccattagtcaatgtcaaacgatattttttttggtatctttctacatctaagttaacatatctaaaatctgactcatgtaaccatatgctagtcatatatatttactctattactagccagatcattggttttgtaactgcttgcaccaacaagcacagcaatataacgagccgatttcttattttcagtaccaccacctaataattgaacaccattactattctgaatgtagttatccttaaatagcattgctaggcgtacttcaccagggttcatcgttactgtattcattgattcattttcatcaactgttggtagagtaataccttgtgcagtaccaatagacactaactgttttcttgaaaagccagacgatatttgaattcgtccatcatctaagattttcggcataaccatcatgctaaaaccagttactaagtcagaaactttgacagttctcgtttcctcatcagtattggtatcttttgttgtttcgattgaggatatatacttcgagtttgtagtgacatttagtggcattactctgttagggataccgataaaatgcccctcatgcattacttcctgtgataactcattaaccactgcatctaatcttgctgaggcggagcgatatgaagcgcctaaccccccccctacttgacttaaagagatcgcatcgaccatatcactggtaatactgtatttccctgcattttcaataccaaatttggcagctaactgatttaagcgttcttcactaagagataccactctataatcaaccgcgatttgcatcttgctctcattgattaacttatcaaagaaagtatgtaacaataaaaacttatctggtcgagcttttactgtaactagtgaataatcttcaaaaatagtaaattttccagtttcacctaacgatgcacttaaaaactcatcgattttttcccaactattagattctatagccgtatctgcagtaccttttaaaccacttgatgtgccactggtaccgccgatctgcattgatgagctaaacttattatcatcaaagtattgctggaggttaaaaacttgatttttataatgatatgccttaactaagttattatgaccaaattcaaagtgcatgttatatgcactacttaaataatcaaaaaaaccagccagaggacctgagtattttattttcttcgccgatgatgagcctgatgactttttattttcttctgaattttcatcttctaactcatctgagaatacatactgaatattatattgcttagaaagtccatcaagaacatcgattaactctatcggtgatttactttcaaactcaacatacttaccactgaacttaatgtcatgctttggcacttttctctcacttaaataggcaccagagagaaattcaatatttctagatttcgcttcgtttgaagacttactcaaattgataacactttgctcgctagccagattgtcttttagcaagttcgtattagaacaaccggaaaccaaaccgataacaagtgtactgattattgtttttttcatacttatctcactgaatagacgacaataactttatttttttgaaatattttaaagttaatgtctatgccaatttggttaatatcgctagccaactcagttaaaacttgttcaaagtctccttcataagccaccgcattatcgaactgaaccgttttctgtgtattccatttcacaacataaccgtgtaaatcagcccaagattccaatttatctttcaattgatcataaggtgtaacaaacaagataggttcttttgatgtgctttcttcttgttcgaactgttcggattcaacaaacgtttctgcatatcggtctgaatgataaatttctgcgattaaatcaactgaggactgttctgcaatctgctcatttgtattgtgcatctctccttgtgcaaaggttggcccgcttaatatgagcgcgatgcatgcacctatgtaatagttttttttcattaattttcacaccattgaaacgctataaaagacaatgatttagggtttcgtaataacgatccagaatcgatacctgaagtaggcaatataccggactcgataccaatcgaggcagttacatcccataccttattcgttaatgtccagttcagtgatataccggatagaagcgcatgtggtcctttgctaccatccttttgggttgtgccttgagaatccttagcactctctgaactaaagtttgcattctgtccagcagttgaaaatgaactcaccaccgcagcaaaacgattatttaaacctgttgggcattcaatagcgttaatggttttagcccgtccgccatcttgaaaagtctcataagtagaaaccactggtgtttttgttttaccatcactttcaaatgataggcctttcgcactgaccacatctatctgttttaaatccagttctgttttatttccaacggtatcgtaccgaaccgagagacaagactttgcactacctgccgccgtatcccaacacaactcagtatcttctaaaaatgcaacggaaccatcacgttgcattgctatttctccggtttgggcaagactgaccgccaacgccagagttctatctttcgtcgcttttaaaagaaaattttcacgagcggatggattttctataaactcttcatagctaataacatttgactcaaaatacccgacacgatcaggttctattagtacgattcgatagtcttgtgcgctaaatccttttttcttggcctcactgataacataacccgcagcatcgccaataaacgctctttccatgcctcgatattgaaaatagctgacgacttgttttatttgtcgttgaatttccgggttggaaggatgtacataggttgagaattcaaactgactcccaaaatagcttagatcacctttcctataatcagcatcacaagcaataaactgatcttgtagatcattattattacccgttgtcggcacatcacctgctgtgaggcagttttcaagctttaaccatttcaaatccgcatctttaaattcttttgccttattatctttgagtattgggttagtacgattattaattttacttaaagaggcgtaacgctggatttgagatgacaactcaataacatcaaatgcgttactggatttaatcatgagttcagcttcccgcttgtaataactcccagcagcgaccaatgccatccctaatacggcagaggccaaaatcgcctccaataatccgacaccttgttggtattttctcatattgatatcacttttagcttaataatttgcccatttccatgggcaaattattattaaattatcaagataatggtgtagattaactgttaccaaaagctactgtgaatggagcagttcctgtacaaagcttctcaacatgcgtgatattagttaggtttaagttggcacttcctggtgcaatggacttaattacgccagcgccagtagcagcatctgcgacactcgtttcgaaatcaccaagatcagcgacagcagcgaaagcaccttctttcacgttgataaatggaaacatatcccctacgcttgtaaccaaagtcttacattgtgcttgggtcaagccaccgactgtaattgcgaatgctttattcgctgcagagtttcgtggaaatgagaaaatccccatagctgtaccagtgaaaggattctttgcctcatcagctgaaaccttaccaaggctgaccaaaccattagctagctgtgtagcagcacttgcgtttgcggtagctggataattaccaagactacgataagtttgtgtcattgcaatttgcacgctgtttagattttgcgcagccttagtcatattctgcgaatcaatcgcacgctgagccagcgtaacaacacccgctgagaccacacccataatacccagaacaatgattacttcgagtaatgtcataccctcttgaccggttttcttatcgtgttcttcttttacaaacttcttcttaaaaagctgttttaataattgcatatttatataactccaccatttgtgttttaaggaaatgcattgcttggtccttttttaaagaaaaagaaagcaatacgcacatttaaccacacaaagtcacctgcaattgacrgatatcattttttgctatgttttttttatttttttaataacacacttacgttgaaagaaacacgtgcaacattcacatagagaataaataaaacacaaaaacaaatactaacttattcaattcagatgatttaaagtgatttaatgcaaataaaatgcgttaaaatatttccggagtggagatcgaaattatgaatgacgataaaaaatgggtaagactcttatcactatgcccacctacgtgatctggtgcgacacggacagcagtcatcttatgactgcaatagagccaaccaattgggacttgttgcgggaatgatctaaatacaaccgcgaacattagggtaaagatgaagagatgactttcagtcactttgactgtggaggagcgcctactcgtcacagactatctaggcggctcatgataagaccctaaaaatcgctttgacaggaaaaccacattttttcagccgttagcagcttgtaagggaaggcgagaaaacaacctttgccgagttgataaatactcaacacattgtaatcacggctagcattactttgtgagtagtcgggaatcaaatttagcttctgagagctaggatctggcaatgtttgataacgtgtagtccaacttttgactacgttaccttgtggatcggtctgggtaagccaaacattggatagattaccttgataagtagaaaaaatttgtgtgactgtaccatcaataatcattgtgccgtgcgagtttttttgtcgcatcgggagtgcgatgatcgttacaccaagtgctacaacgaatagacctgtagcgcccccccaagcttttaattttttgtgcattctaatgtcttctgttcataattcacggaacactgatgttgatcaatagcgaacgtgagtttttgttctgacagtttttggattgttatccccggtaaccttgctaaatctcgtagatcatgagtaatgccggctaattcatgttgataccattggccataactccaccaaatcacaggtagcaaagcaacataaagcgccgaaaaaacaagataaggaactacgtttatcttcccccactcaatttttatccgctcttttactgattttttttgactacagtcagcttcatcaacaacgttttcagaaacaataacttgtataatattaatacgataaccttgtaactttacattttcgatcaacgtcttatgttcatcattcaaaaaatctctggttcttttgattgcctgagttagactttcagagctgataaatccatgaggccaaagtgctttaattatttgatcatttggacagggggcaggatgatattcacagagtattttcaataacttagtctgtattatgcttggtgtaccaatcagcctttctggcttcattggatcttgtgcataatagacttgattagtgcattcattccaccaaaggttatcgggaaattgataaatcacgcggacataccccattactttacattttcttaataataactacccattttttttatgtctattttttttaatataattatttgcaatctaattctgcagttgataatgagaacttaattgcataataaccaagccattcaaaaaaaaataaaacagcattaaaaaaataaccagtcacgatatcagaaagtaattctcattataattcattcggtttagcactcccccctatagtgcctattccatatctattaacttggttacattatctttcctgtgacattttgccccttacgtttggggytttttttaactttgtaactttattttcctaaagacaaaaacactatttaaaacgataaaagctgatttttcacatcattattttataatttcatttttaactaattatcacgaagtactccgtgataaccatttaaacttagagttaaactaatgataaaaaaaataatttcggtttttttattacttgcgtgcatcattacgttggcttttactgcctttttctatcactcgaaactatcagatcaaacaaaatctatatctagccttagttctcagcaggcacaagaacggttgcaaagttatcaggattctttagatttttataaaaaacttaatacctctctctcagttgcaatagccaattcacttcgcgataaagcagtcgaagaactcaacgctattgctttgcgtatacaggaaaatcatgggtttattggtgttaccttcgctagtttagatggcaccatgtttacagatattggtactctagattggaatgcaaagacattgagaagagattggtttgttaaaacggtcgaactcggtactaaacattacacagcttttgatatcgataaaacaactgggcaacacgttctcactattgccacccctgtttatgtaggcaacgacattgtcggcagtgtcgctttagatattgcaggtgatcagattgcctcacctaacggcagtgggatgtttatgatgacggataggaattttaatgtatttgcatctgatctcactcacagtaccttaattggaaaagatttaacgaaagagaagcctctgttcaaaaatctggtctcaggccagtatgtcaccttcagtgatgctgatagtcattggtttgcagtgtcacaaacagaaatagatggtgaaaataaactgttcactattattgatattcaacaaatcgtccaaacatacaagcgagatatccagttgattattgctggatttagtggtttttcatgcgtgatgctaattggactatattgggttctaagcaaagaactctcaggagttagacagatcagagaatggattcttgccctttctgatggtcagataaaagaacgcaggcctataaaattccataacgagctcgacactattgcccaaagtcttgaaaatttacaatttaggcttcttgatgtggtgagaaattctcatcggactatgaatgatttaagtatcaaacagactgacattacgtattcaattgaagggaatacgaataattcacagcaagaacttgggctcattgaacaagtggccacagcaacaacgcaactatcatgtacttcttttgatgtaatgcaacaagctcaaagtgcagagcttaatgcggagacggcccaaaaattgattgctgaaagtcatgatattatcgattcatcaagcaaacaaaccgaaatggtaaccctatcgatccatgaatcccaacaaataatcaatcagttacgcgagttttccgataatattagttcggttacggatgtcattaataatatatcagatcaaactaacttacttgccctaaatgcagctatcgaggctgctcgtgcaggtgaacaggggcgcggatttgctgtagtagcggatgaggttcgttctcttgcagtgaaaactcagcaatcgactatagatattcaaggtattattttgaaactgcaagagcaatcgcagttggcagatcaagtgatgacacgtaatgtttcacttattcatgaaacacaagttgccaatcgggcacttatcgcatcctttaacctgatttctgataaggttcttgaaatatcaaacataaactccatcgtttcgactgccgcaaatgaacaaaaaatagtaactgaagatgtagcaaaacagatggaagatattcgatatctagttcaagagaatttatccgcgatggaacgaactaaacaggcaaatcagaatatctctgatttgaccaccaatctaaatgatgctcttagcttttttaaaattgagcttacttcataaattaggctagtgccagtcagttgagctgactggctttttttctcgcacaatcgtgtagccatgctacaacaacctttacacatgttagctataccaaagttttctaatcattggtttaggacaaattgttccatgtttgaggcataacgaatggcgacatgagtgtatgattaattgaaaaataaaaggctctaagccttgggaacttagagccttttataaagtcatccaacgcttttttatctattgatagataaaattggcctaattactgattatagtgacatcaaaatacgatcgtaatctggttcattggtgatttcattgactaattcactgtgggtaattacaccgaactcatctgcaacaatcactgctctagcagcaagcccacgtaaagcaccttcatttagatttacaccgaagcgttcagtaaaagcaggctcacgaaaaaacgacgcattcgtgacattagctactgcatgctctgtacaaaagcgagacatagcaaaaggcagatctgctgaaacacagagaagcactgtgtcattgcgagtcataagtgcattttgaagaactttcacacttttagaacaaaccggagtgtcgatactggggaaaatgctcattacaatcttttttcctttaaaatcttcattgctaagatcgttcaaatcagcaccacaaagagtaaaactaggcaaacgatcacctactttaggaaaagagccagaaatagaaacaggattattttgaaatgtaacagtcataatttaattccttaaatacaaacactactttagtgtcaccgctattatacaaactattaaaaacaaaccaaactatatgaaaaaaatctgtttagaactttagtttaaattacttataaccctgattttgttcttgtattgattttttaaactggtcatagaaataagcggacatatagggccagtcataagtagattgtatattatcaatcccataaagtttcgataacccttcagcaaatgactcctctaatgcaacagcatagttattctcaggttgtaagaagtagtgttcttttatcttccctagttgataatcactatgccaagcttgataaaaactcggattttgactgtagggcttaccagtaaaatatgtacccactacacgatctagagtatgaccaaactcatgaataactagatttttcgaaccatgattacctgttggtatagcccatttaccatccggatttttttgaagagcaatcactaattctgttaaaccttctggtgatcctgctcctggaatagaatcccacgttatgccagcttcatgtccgcgaacaggctgtccttttaaatgttcccaataagtagtgacattatcatgtgttactacaagctttatttcatgaaccgtattccatcctgattttaaaagcgctgggtctaattttgagagttcttttgcaacaagatatctaccttcaaactctggtatcatagagtttctgtttattttcacataactaagtgcacttgtaaaatttttaagctttccagaatcaagcaattgttttgcccagtaggtatgctctgctgttagcatctggtcagttttaaaaaatgggtttaattcatcaatcaatcgatataaataatctctataataagttccaccagttagcttagccaattctgcgcgcaactcatgggatgtttcaatttctaatggtaattccatagactctagaatatcaccaattggacaggcatttgtaatgctagaaaaaaggcacaagctaatcaatatcgattttctcatttatttttataactcccataaataacttctgcatcctctttcttgaaaaaaaatttaccatcagaaaagttcatttctacagcatgaaaccgaccttgtgtattagctaaagttaacacattatcttgaattgtgtttaatactgtccctacgtatccgattattggtccacggaatgtagggtacattgccgttaattctttagcaaactcccccagaaagctatcatcaatgtcaccaaataaaggagtgtaatcccccttattcatacgagtcagtacttctgtttttgaataatcacttggtttgagagagcaagcactccaacaaaagtcaagttttatgattgaatccggctttaatcctttatttttcagcatatcagctaactcgaaagcgtaaaagtaatggcttgcatcaccagggtagatgacttcatcaccagcatcaccatgtccgacgacatgaataaccggtctatcatgtgttatagaatccaaaccaaaaataggatctttcgtaacagaagcataaaattcatcgaagagctgctgtgcctcatttagattaattttcctttgttctgaaattacatttataattaattctttatcagagtctaaagttttttttaattttttgtactgcgatttgttcaaaaaaacaggtttaatactcatgttattattataaaacttacctagcatatcatacatgatggcatcagtattttttacaaatggagtaaatgcatatctagacatgccagaattttctatagtatcgaaaacccaayttagagtatctatatcgatattataattaagagatagcgaagaatttaattttaataagtattctttaatatcaggtccatatcgaccattaatcaactccaataatcctgatgctgttctggtttttgggtcaaaccccatacttattaatgcatcatcaatgttggtgaaatgacatactttagtattattcattaacgaaacaagtggacaaatcccattattaatttctttaatagaccaattgccatttttatctttaataatttctatccttctcccactattttgttcataaataaaattagcacgtagtattggatcatattcgaccctatagtagttaccatcaatataaacagctcgatattgattattaataattaaataaccatcatctaaatatgatactgaaaacacctctgatttaaactttaaatcatcgtaaaacacaactgagttatcacctattatattttttttaggtatactaacccgcgatgaatattttttatataatttacttgnccctgtaacaacgagctgatccaaacctgcgataggattaagttcatttaatataactttagggagttcctttagttttccttgtatttttaatttatagaaagctctatcagcttgcgatgatgttaatgaatacttaccttgtttgtttaggccaatgacatttctaacaaacttaacatttctcggtagtagtttagacgacgcagctttagcagatagttttccgatactagaaacactttttgctatgggtaaaaaaaacattacgtcacctaacacaccaagggttgccattcctgcatcacccgatttaatatcttcaacagttccccatacaggaagaatcgccatcaatacttgatatgctatatctctatctgtttgtacagtcttcaaatcgttcattttaaaatttagaaactcttgccatccatatgacatgatgtcttttgtattatatgattttttatttctcgttataaattttgtatcacacacattccaccgaggataccatccatcttgataatatgaacacttatcggcgtaatcggagttcatcaattgataaagtggataattattcgagcctgaattaaaatcgataggttctatcactttaaaattattaagactgaacaggctcaacaaatcaccaggtgtcgtaaccgaataacttatatccttacccgtcatgacccagctttgagttggaatattttcatatcttgaatgggctttaccattattacccatattataatatgtaattccgaatccaaaattaaatctaactgaacgatttttattttcagattgaatatcccatgattcttttccctctagctttgctttaaatgaaataagagttgcaatatactttgccataacttggctgatttcttggtattttcttctccataaatcttgtgcaccttttgttgttacatctcctcctaatgcagcagcatcctttttaagaatatccttccctacacgaaccccggggataagagacaagcggcctttttttaggtatgacttccagtgtttgtcaacaaagttggcatctaatccataactgtacagctgagctttagcaaaaagctcatcagttaaaggaagggcataaattggtgtttcattttcataaccgacaattacttgaaatttatctatttctctgtagctattttttaatgattcaagctcattacgtattaagctaccttttatcccagatgtttttttcaatatctcaatagagctaattacatcattaaatcctgattcatttccagaagcatctcttgtccaataacgtccttgatagtcaccatgttcataaaatcgtacagaccagccatgtgggatagtccaagacgaaagtgtatcattaaatccatgtaggaatttcgtcgaattttcaatatctatatagtgacctgtatagttatgatcagcatagagtcttacaacattatctgaacgatataaattagcattagaataaatatcttcagtaagcttatctaatgcattagaaaagttaaacattgttaattgattatttcttgccaataattcatcaataataaatggctcagatccaataccgacctcttcaggaagtaacctttttgatagattattgttgaccctcaagaatagacttgcttttatattatccatactgccataagggtatacggtgtcaataccaatactttctaatgcatttttagtactcagtaactcaatatagctgagctcctcaatagatttttgatacaaaatggctgcaacttgagcaaaagtcttccccaaaaatccaccagtaatacctctatggttaatggtaccctttttatagtcaactataatatccttatttttattaaaaatttcgcgagaaaaatctatacctgagaggttaccataattgatggtcaacaataacatgtcatagagttcggaaggatcatcaccgacatactcaaccatcaaagaacttaccgtatcattcagattcttctctcctaatgccttaatatcactattagctacaatagaagaaccagtatatccgccatgttcaaataaagtaacttgccaccctttcggaatttttattgatgaagcaatatcattaaagccatgcaaaaattcactatccatgtttaatgatatcgaatgcccatgatatgactcatgttcatataatttcacaggttcaatactattgatgaatccacttaacattgactcccataaatcactaaaaaaggaatcgctgtatgcaggtatcgtttttccgtaggataatataggctgactgtacaagtctgagaacatcattaccaatgataattgcaaatttttctctgaaccatattcaaagtaatgatcttgatttaaactttttagtagtctctgtcttaattcatcaatatactttgattcttgaaatttacgatcaacgataccaacttctactgcaggttttacgattttttcttttataaaattattgatcttatcttttgttcgtaatttaatgaaatcttcagatatattaaaacctatagaaccatttataccactatctcctaaagatatagtgtttgtatatccaataatttttctatttagtgattcattccctgactttcccttattataacttttcattttggatatgttctggaggatctcattctctgttggtttttcatctttcattctataggcgaatgccatgtttactatatcagaaaagaaatcaaaactggaaatcttattattttcaactatatttctaaatgaaacgtcgccattaaaatcgtcatatattgtaactttagcatatttcttatctgataaattaacacttaagactttacattcatgccaccatgaatatggaagttccatttttgacatgacaataacatgatcatgaacaaggttatcaaattcattaaatttgaatttaaccatctctgtaccatgaggcttctcaatttttccatttttatctttctcatacagtaaaacttcaaaatcgatatcaaagtgatttttattaattatattatatatttcatttaaattacttttttcgatctccatagcaaccatacatcttccattactaccataagagaaataatccactgcgaaattaattttaggatcagctttagccataaaggaaaaaatagacaacgtaataccagttgaagttattgtaatttttttattgaacatgaatagtccttaatccttactaactatatgattacaccatatagttagtattttatttttcaatctaactatgaatgaacaaaccacagtcatcaaaaaaagctctatagttttaatggtaggtyatcgttttataagtactaaataaccattgtttaccattagaccaatgaatttgtctatcttgtgtacatctattgttttcatcgaggtaaccagcaccataaaatgatctattatctaatacgcacaatgtcttattgttatcaaattctatttttgatcctaccaaatttttatctcttactgataaccattcaaaatcgttttcttttgatgatagttcaatattaatttcgtttttcttgtaatagatctcacttccaccagtacaaatgtacttactttcagataattgactcacataaccaacaaatttcatttcctatctgaatcagaaaaattaaatcgacaaatatattcatcattatcatttacacgcatctttcctaattcatggttgatttcatttttgggttcaaaattgtcataatgtttgaaccaaccactaggaagcttaggctcatagcttgtgtaaccatgctcttgcccaacaataataggtccttttagtaattttatatcaggattatcagaaacctttatgctagttaactcatgttctccacaatacacgttaatatctattatgggcttttctctgcttatattaagatgaattttattactctgatttttttctattctataatttggtatcgatattgattcaatattattatctttatctttaatttttaatacacattcatttgaccatgtataggtactatttactcctgattgatttaatgtaaaagcccattgaaatccgttcataaaaacaccgtcaatttgccgacaagagtttcctttaataaaacctgcaccgtatacagtaccagacatctttagtgaacatattttactttcaccaatagtagaatcaggaacataacttatttctccatcaccatctattgataataaaaaataatcattatacttggattctattggatttttcttgccgtcttctaaatagtgaatacttctacctcctgtgcatattttattctcaatgtcttcataccctagaaattcaaattttttacctttagggcttagataagaaaatcgacatattttttcttcttttctatttacgagcatcgtatgccaatgtgtattaactctatctagatagttgacatctttaacatattgccacccttttaaggatgattctgaacgaggtttttctaaatcgaatatatttccataattgctgtatgtcggaggatacaattgacttggattaattttgtcaggatcataaacccctaatatcgtcacaacaggtacacctttttttattggaactttgaagttcgttcccttatacacatagatattttttaattcatcccaaaccatataatcattatttattacaacagccccatttttaagccaatcttggataattcttgcaacatatggatgatgaagtgtatatctactaatgattccattttgatggtcatatcctccagacattgcatcccaaagatatgtatacttgtccatgaagggcttaacaacttcttgattatctggccttatatttgattgtggtgaacgtttccaatcaaagttagctatgaatcttttataatagccatcccaaccccatgaagtatcaggtccatgactagtaccacctgcaacataatgtcccaatccatagttatgtcccaattcatgagaccattcgttatgaagtgtattttctagtgtaacgatcccaccaccaccactccctccatgcacaaccactccattgttataatatccaatatttgtgtgtgcggtaatatgattcgttaatctgttgtattgttgagaatatcctgacgaggcaactatacctaaattagcattatttattccggtagatactagtgctttccctactgcttctctcatatcaccttgatgccatccacctatatcagcacttttctcagtatatactgtaccatttggtaatgttattttttcaaaatgaataggggtataatctgaaaaaatcaactttgagacaggaactttctgaaagtaatcaacggctgttctttccaattcttttattacgatatttcttcytcttggtttatataacattccaagatctatattttgaataatcaattcactaggtgctgaaaattttatacgttctgactcaataatacctaagttgccgttttcgtcttcaaaatgtaatgacataccacttttcattttattccatggtatctctgcactccaatatgagttagagtaacttacaactttattattttcatcaatatctattggttgatcagtttttggcaacatagatggtgatttcattacaactttgctagtgagtccatcttctgaataaattttcatcaaaattgaacttgagttttttattgatggcttaaacaatattaatgcatctcttcctgtgattatttcaggctcattctttctaccctcaggagaaatgacatgcgtttgcacaaatctaacttcaccttccaagcttccatacacatttttttctatttctgtggtgtgataataatctatctcgttcaacgtaatgaattctatttttgcgctttctgaacaagcagagtgtaaacaacttgagacatctatagaatactggctgttaggttttaaatcatcgataaaaacactattattcctagttctgatagttattacatcttctattcgatcttttctatagacaattacattataatgactaaaatttttttcacactcaatcttatcccattctattgtaaccgaagtatctgttacacctttatttttttcatcaattataggccttgatggcttctttgtttgttcacttatatcaggatcagtcaaatactggtcgttactggatgttgcattctcattacatccaactaagaaaataagtattgcaaaagaaactttcattaagagtgaatatcttaccaccactaactcctcgtaaacatttttcgaaaaaatcatttaacaaaaaaataaagacaagggaaacgtattgatgttttttaatgcattaaatattaacttaaaattttacattgaaatttcaatacgattttgtttttttaaatcaattctcatgtaagaagttaatttcattctatagaataatttttccatcaaaaaaggtagctgttttttatatgatttatccaattcctaatagcgaaacttcgactgttcatttcaaagatgtatatgataattacattggaggtcaatggatgaagccacacagtggcgaatattttagcaatacgtcaccagtaaatggactggtgttttgtcgtgttgctcgctcgtcttcgcaagatgtcgaacttgctctagatgccgcccataatgcacttgaatcatggtctacaacaagtgcagtagaaagatcaaatattcttctgaggattgctgatcgaatcgaatcaaatttagaaactctcgcaatagttgaatcatgggataatggaaaacctatccgtgaaactttagcagctgacctaccgttgactattgatcactttcgatattttgcggcttgtattcgatcacaagaaggtgctgcttccgaacttgactctagaacgttaacttatcatttaccggaaccaataggtgttgtaggccaaataataccatggaattttccgttactcatggctgcttggaaattagctcccgctcttgcagcaggttgtactgttgttctcaaacctgcagaacaaacccccgtttcaattttgtttttaatggaaattattggtgatttaattccagctggtgttattaatgttgttaatggtttcggctctgaagcaggtaatgcattagcaacaagccaacgtatcgataaactagcatttacaggttctactgaaattggtaaccatattcttaaatgtgcggcggataacttgattccatccacaatcgaattaggtggaaaatctccaaacatttatttccccgatatcttttctcatgaagaccaatatcttgataaatgtattgagggtgcacttttagcatttttcaaccaaggtgaggtttgtacctgtccatctagaattttagttcatgaatctatttatgaaaaattcattgccaaaattattgaacgagtagcattaattaaacaaggaaatcctttagataccgaaacacaaattggtgctcaagtatctaaagaacagtacgataagattcttggttatatacaaataggtaaagatgaaggggcagagctaatttttggtgggcatcctaacaatcaagaaaattatttatctggtggttattatattaaaccaaccctattctttggtcataatcagatgcatatctttcaagaggaaatatttggacctgtaattgcaatcactaagtttaaagatgaaattgaagcactgcaccttgctaatgatactgtttatggtttaggtgccggtgtgtggacacgtgatataaatattgctcatcgtatggcaaaaaacattaaagctggaagagtatgggtaaattgttatcatgcatatcctgctcatgcggcttttggtggatataaaaaatctggcattggacgagaaacacacaaattaacattgagtcattaccaaaatataaaaaacgttcttattagtcatgagattcatcctctaggtctattttaaatctaatattgctcactttaggtgagcaacatctccctaatatatcaaaaattcactcaatttaattttcattgaaatttacgatataaaaattttaagtcattacaccacaaaccaactcaaggatccttatcttatttaagaatacttatactatctatcattaatatattcttataaacttggctatctttacaaaaaatcacattaatcaccaattaatacatttggcattcccattaaaataatgccaccgtgggcaggctttgttgcgtaattcgagggaactaaatccgaaggttacgatctgatccgttaagtaagttaattcccctagtctcatgccgaaacctcgctacaaaacaacgaattggaaacagtacaacaaagccttaatcaaccgtggttcactcactttctggattgatgaagaagccactcgccagtggaagcagagcaaacaagataaacgaggtagacctcgccagttcagcgacttagccattattactgcgcttatggtgaaacgagttttctcaatgcagtttagagcattgtaagggtttatcgattctgttttttcattggctaacgtccctatagtctgcccacattacagttgtatcagtcgaagagctaagcaagtcgaggtttcatttaaaccaaagactagaggtgcaatacagcatctagccattgatgcaacaggtctcaaggtttatggcgaaggtgaatggaaggtcaagaagcatggtactgacgggaagcgtagagtctggagaaagttgcatttagcggtaggttgccagaagctctacgggtccaacaataagtggaaaaagcggtacggctatcataaacgctcactatctgaaacagcaatgtatcgagtgaagcagttgttaggtggacgattaagtctgagaaactacaatgctcaggttggtgaggcttacccgatgatcaaagcgttaaataagataacagggcttggtatgcctaaaacttgccctattggctaactatcaatctaagtaggtgtgtgattcatagagatggtttcaattttcttagctgaagatcgagcttgtaattttgctcttgaaaccgctctttcttgatctggtagttctgagatacctcttcagacaaaggagtttgatcagatatctcagtaatcctgtctatcggggttagcccatttaacgagctgtggggccgttcccagttgtagtagtgttgccattcagctagtagcagatccagttcttgcagccccacagagacatctatggtcggatagaactcacttttatctgttttctgcgagcgttccactttgccattcaagtgaggtgagccaggcttatttgggcgaaacttgatcccataaatcatgagttgtttctggactttttcagcaaagaattcacgccctctgtccgtctgaatacgctggataggaaatggcatctcttccacgacacaatcgataaagtcgactgtatttgctgctgtgcgccgagagtagcaccttagaacccgatagcgagagcaatcatcaatagctgtatactggtaaattccaggcgctattttacacgtgtccatctggactctatcaccaggaattgggcgctcatatctttggaaatcttttttgcgtcggtaagttacgatgggtttgactgatgcttcggataaaactttatggagtgtcgctgtgcttaggtgtattttgtgaagtcggattaattccgtttgtaaacgtcgcgcccctaaattgcgtttgtcacgcatcgtaaggatcaatgctcttagctcatcagtgagtttggtatctggagatgaatgagggcgtctgctctggctttccagaccagcgattccacattgcttatatcgcttagcccactttcgtaatgttggtctggaaataccacagcgtcgacatacgaggcctgcatcaccacattcctcatacatttttacccactgtagtctttgttggatttctctgtccatagacacccagtatagttgaaaggatgtctatgaatcacacactttaagtcattcacgctactgctttatcagggcctataagcatggataaaaacttaaaaaataaatgagacagaagtgccattgggtaagtagcaacaatttatgggtacactaaaaggtacaccattaaaaatcaaatcaatacaatttaaatataaacaataagttaaaaaacaagatcaacttaccccagcccaccaatcactagtaacgggacgtctcaggacgtcccgttttcttttctaaactcttatcctatttggctttaagtggttcagagcgtctcatcaagattcactttgttcatttaaggcaactgttcatttattacgaacaacctgcatcactgaacaaacaattaacgcccagctccctatcgcagctttacatagctaaaacaatccatcctgctcatcaacaaattttgacttacaactcatgagtaataatttactcataaatagtatccacatacattaatgagtaattttttactcacaacttgaaagaaaatggctttaagagtaaatttttactcattgataagtagaggtgttgtcgatggaagagctaaccgtacaagcttttatcagaggtgaatggatagatattggtatcatctcattccctaaaagtagccaacataattttcgagtgactgaactcaactacctcagcgactatgcgctagaacattacgataaagatgactttcacgctgtttcactaaaccaccctgtctcattcatttttgatgacatgggtaagcctggatggttaaagtttctagacgatattatgcctagtggcgctagtagacgatactgggtcaaacacctagatattgaagatcttagttctgatgaacaagactatgttttgctcaaatttggcacgatgtcgcctattggtaacttaagaataaaagactcccttcctgaacgctacgaagtcgcagacaacctctacttctctgttgatgatgttaaaaatcgagcaggtgatttcctcgactatgcacagcaaagaggggcagccgcaggtggtgcaacaggggctggaggtgaagcgccaaaactgatcctccgatgtggtttcgatcatggatctggcagcgaaaaaatatggattgatccataccaagatgacaatagcagccacgacttacattacttagtaaagtaccctagaggctcaagaagcaccatcgactgtaatattctaagagctgagttctacttctaccacgagctaactgaaatgggagttgaaacgatctccaccgacggtatgcgcttggaggaaggattaaactacccttccttatggcttcctcgatttgatgttcaaattattgatcaacaaatagagcgatttggcatggaatcagtgtattccattttgaacaaaggcgctggagtcactcttgatcacgaaacaacaatccgaactctcatagaaaaaattactgaaagtaatatggttaaacaccaagggtataggtttgatacccaagctttcgttattgaatgggtgaagagagatctactcaacatcttgtttggtaatagtgataaccatggcagaaatacttcattcttaaagggtgatggagtcataaagcttgctcccatttacgatttcgcaccaatgaaagccgatcctgcaggaattccaagaacaacaaaatggaaagccccactagaggttggcggaacttacgactttgtcggcattgcagacaccttatctgatctggtgccaaaggaaatgttattaaaagagctagcaattactgcaagtaaatgcgtaggcctaaagcagagactcgctttacgaggagtaccagaacaaatcttggagatgccggccgttggacttaattatttatcagaaaagctcactaaatgggggctactatgaagccaagcaataaagagtccgtacaagatacggtagctcgtctaagagaaaaccgaaatcaacagcagtccaaggttgggaagaatgcaactcattcgagcaaagagcaaacaccactcgatactccaacgagatcgaaagcctcaaaaaacgccaaagcagtaagtgcagcagagcgcaaaaccgaggcaaacaaaatcatcaaacacttattgcttggagagctaacacagggccaagcgctgaaaagtctacgcattaatatactgggactcaaacaggatgtattcgcaagacttgtcgatgtctcaagaaaaacactctcagacatagagaatgatcggggcagctacaatacagagattctcaacaaggtattcaaaccatttagcttaaaaatcgggctgctgccttcttcccccgatgcgttaaaatcgctcttaatggatggtgaggatgggtaaattgctccgtatcagctctatttatttagattaaattgctataacaagctagcatttttaaatgatttaggaatacatggacacgggttcagttccttttgggctcctaatttatggttcctaaacatgccgtgacagacaaaaccgctatccgctacggaagtcaaaaacgctgaggtaaagcgaattaacttgtagacgctcaagaattgaaaccaccgatgctccctactatttaaaccatgatgccatcttctaactgaccccgacttgcccaaggccgcttgagcttacgaggagagcatcttgaaccgacaagccgtacatcctcgatttcacaaagtagctcacagttacattgcaactcattgagcaatgaggatgaggaagttacactctgcatccaattcaggaggagctcacgccaatgtctgtagaattttacaatcaaaatgcacagcagtttttctcttccactgtcgaagtcgattccacttccctacttgaccagtttgtaccttacttacctcaaggtggattagtgttagatgcagggtgcggctcaggacgagatagtaaacgatttctagatatgggctatcagatcgatgcttttgatgccagtgcacctttagcggctttggctgaagaactactcaatcaatctgtcactgtgactaccttcgagaactttacctctagtaaacgctatgacggaatttgggcttgtgcttccctactgcatgtcacgagagaatcgttaccggagacgtttgctcacttagcaaaaatgctcaagtgtggcggtgctttttactgctcatttaaatatggtcaggacgaggtagagagagatgggcgtcgcttcaccaactgtaatgaagtccttttaaatcaattactcacctcttcaccgctagccatcgacaagctttgggtgacacaagatctcagagcagggcgtgaacatgaacaatggctcaatgccatattaattaagcgttaagtgatgagtgatagacaaagttttctgtattcaggtcataagctctcttctggtggtgcaaacgatccgctcctaccaagacttgtccaagccattaatcacgcgactgaaattgaaatttcagtctcattcattcagccatccggtctggatttactgtttgatcctctgtttgatgctgtgcaaagtggtgctcaggtaaaactcctaacatcagattatctctcgattactcatcctgttgcgctgcgacgcctaatgttgctaacagaacgcggcgctcagtgtcgtgtatttgaatgtggtcagcacagctttcatatgaaatcgtacatttttgtccgatgtgaacagggagaaatacttgaaggttgcgcttggattggttccaacaacatcagcaaaacagcgttattagacagccatgaatgggctctacgtcacgactttgaaccacctgaaaccagtgctgctgcccttgagtttctccatattcgtcaacagtttgcttccattttcaaccacacaaatagtaaagatttaacgcatacttggattgatcattaccttgaacgctatcaacaagcgaaaaagcagcacggcatgcccatactggccgatagccaagatgaacagtcagaaccgccagcgccgaatgcagttcaagtagaggcgttaaccgcattgaacgccactagagcccaaggattttctcgtggattagtcgtgctagctacgggcatgggcaaaacgtggttagcagcatttgatgctctacaaactcagtcgacaaaagtcttgttcgttgcgcatagagaagaaattcttctgcaagcggaaaaaaccttctgtcagcttattcccaatgcaaaaacgggtctctacaacggtgtaacgcaaaatacacaagcgatgctgctgtttgcttccgtggcaaccataggtaaacaaaatcacctgcaacgctttgcagcggatcactttgattacattgtggtggatgaatttcatcacgcggcagcgagaagttaccgaaacttactcacctattttaagcctaaatttctcctcggcctaaccgcaacaccggaacgttcagatcaagcggatattctctcgctttgcgacagtaatttagtctttgaacgtaaccttgttcatggaattgatgagaaaattctggttccttttgactatcacggtatctacgaccaagccgtgaactaccaagaaatcccatggcgtaacggtaaattcgacccagactcactcgataatgccctagcaactcaacgccgtgccgaacacgtttaccagcattggcaccagaaaaaacaaacccgcacactggctttttgtgtttctaaaaaacacgcagacttcatggctgagttttgtctgagtaaaggcataaaagcgattgcggtttacagtgattcaaaggttcgacgtaaccaagccttacagtggctagattcaggaaaaatagacatccttttctccgtcgatctttttaatgaaggtaccgatctgcccgctattgataccattttgatgcttcgtccaacggagtctaaaattctctttttacagcagttgggacggggattgcgtcgaagcattgaaactcaaaaaagtaaactggttgttattgattttattggtaatcatgactcgttcttaaatcgtccaaccacactctacaatgtgagtcatttaaaagacgccttagccaaacaccaacaacaagcattacctgacggatgccatgtcacttttgatatcactttgctcaacttttggcagcaattaacccggaaaatgcgtttctcagtgcaagatgagtatcagcaacttgcacaccagctcgcacatagaccaactgctagtgagtttttctatcatggaattgaaataagtaaagtgcgtaaacaagcgcaaagctggtttcatttggttgcgagccaagaaaatgatcccgagttggctgagattgttacacgctatggtgattttcttctgcatggcattgaaagcaccggcatgagtaaatctttcaaagcaattctacttgaggccttactcgaactggatggattaagaactccgccgaccttagccacattggctgaatgcagttacactgttatcgcacgcagaccagacctcatggctgaagacctaactgaaaatgccaaacaatttaaagcagcagataaagattggcttaactattggcggaacaaccctattaaggcctttacgaacaaagcaacgaaacaggccacttggttttccatcgatagccaacaacgcttcgtcgctaactttgatatccgagagcaagatctagaacggttacacgattgtatacaagaattggttgatctgcgtttggcggaatatgctcagcgacccaagcaacataaagaaaatcttattaaggctaagagcaaagctgctgtcatttcattaatacctgaacaaaaaacgataggaacacctatcccattctatccagagctcaaaattgcctgtggccattttaagcgcggttcagagcgagaagtacagacttattttgttcctgatggctatggattacttgatcccacacggcattttgtctcgccagcctctggtaactcaatgaatggcggtaaaaatcctattcaagatggtgacttattattgcttgagtgggtgacaccaagcagtgctggctctatatcaaacctcaccatggctatagaaactcaagatgaaacgggggataaccagtacttactgcgggtagtacgtaaaatcgcaccaaaccagtatgaactacaagcacaaaatccaagttatccaaatatgccagcaaccgatgcaatgaaaacgttcgcacggttaaaagctgtgataaaaaataatagtcagcaatcacagactcgatgacgatgaataaggcataattcaaatatataaattttaaataacaatatgtaaaaaaaaggctaggtagttatgatagtaaaagaaaaaacacatattaaaactagtaatttcaaacaagacttaggcaatcaagtagaaaatgatgtcgcattctatttgagacgtcatttttccgaaaatgagagcatcttcatttataatgatttacgtattgagcataaaggtgaaatcgcacaaatagaccaccttgttgtttataaaaaagggtttgttattattgaatcaaaatccatcaagggtactgttcaaattaacaaacagctagaatggcaaagaacggttcgtggaaaatgggtcggcatgccatctcctatcacccaagcagaaatgcaaaccaaactattgaaagcattattaaatgataatgcagaacagttactagaaaagatattaatgcttcaaggctattttggcggccgatgctgggacactctttgcgcggcttcgaatgatgcaatcatcgatagagacaacatcccatcaaaaatatcaccaatgattattaaatcagaacaaattgctaatcgagtggaagaaataatagctagtagatcgagtatcttaaaaccaaatccaacatttagtgataatgagcttcaaaatattaaaaacttcttaattgaagcacacaagaacccgttaatcgaagataaaaaattcactaataagttcaataaaccagataacattacacatcaaacagaaaaaaaataaacatctcaaatccttggtttatatgtaaggagtgttcaagtaataacacctcaccaaaatatgggaaatttggatattatgtcacctgtaaagattgtaataagaacacatcaatgaacgtagcttgcataaaatgtgggaatagaaaaacccatgtatcaaaagataaaaacacttatactgtaagttgcgaatgtggtcataaagtagagtatgaatatcaatcattagaaaaaacagcatagtgtatatttcatgattgatataaaatagtgccctgcttaatcaacagggcatggcgtattatgttgatattatttagtgtggttcatactagaaagccaacaaaaacaatattaacaaagaaagaaaaccagcacagacactaattattagatagatatacttggaaataaatgtattctctcttgcgttttgaggttcatttaatggaacacgcaaaacaactttctctcctagtttcttaccaacaatacgatgtaaagtagcatcgtaagttactaataatgattgagtgtaaacctgaccattccaagtatattcaacctgaggattgagaaattttttctttctaaaacgctcctcgatatttctattgtatttaacagttacttcaaatccgaccacgacaccagttgtgattccatattggttattgcgctcttttataaattgtttaattgcacccattccagagagcgcaagagctattacaaaccatccaccaataatgaatccaccttgttgttcaaaagtcaaagctgaaatgatggcggtaggaattgagagtaaaaagaggaaaaacccatgtgctctattcatattcaatcatccagaaaaatataatgccaaacttaatatttattttgtttatacccttcctacttgaagctgcagcggtgttggctacgctcgttcaccccagtcacatagtttgcctatgctcatgaggattcacttacttgccgcctacctgcactccaagttgtttgggtataatagcaaccagaagagaaccactaaacctgcttgggatagtgttttttcaataagttatgcatatttcgcttacgtttgtaggcttctgccagagcggtgatttcgagataaaaatcggccaacacggtgggatttttggctaataaacgctcgatacgttgtagatggtgaatcgcattttgataaccttggttgctggtttgttcaattgaagcgcgcgccacgcgaaggtagtactgcaacgagatctgaggttggttggcaataatgtgatcggccaacctgagtagtacctgactttcggtggctcgattggctacccaatcacaggcttttttccacgcttgctgctcgatataaaattcgaccacatcactactgttgcggctgataaatcctcgtgcatcagcgggttgatagcaggcgatcaagctctgttcgatacgcgctaaaaactccgcatcttcaatttggtgtgtggttttgaacgcactcagcttttggtaactatcaaaggagggattctcagtgaaaagtcggttcgccaactgccacgcttgagtcatttgccccaaacagaggtagaggttgacctgcagttgctcgcactgctgcttttcataaggggtcgcgtgctttttggctttagctaaccagaattccgcttgatgtggctcttggtgctcaaggtagagctgcactatgtccagaaaatcatcgcagcgccacgcgattttttgcttaatggcgataacttcatgccaatccgctgccatggccagtagtggtgcggcccacgttttgagatcccacgcgttttcacggtttagtggtgtgttctcaatggctttgcgacacaagtgtaaaaatgttgggttgctgcgccaaacgatcgcgaagtcggtttcaattgagggatacacatcaaactcatggtgggtcatgcgctcaaacatccactgcgctttctcttcctcactccactccaatcggttcaaaatcatcggcatctgaacattgatcagcgcttcgactccaaaacgttcaccgttggagtcatcaatctgctctaacacgctgttcaaacgagtgactgtgtgctggatcagtttccactgctgatcggttgcaagttgcatcgcaacatcaaatacccagtcgagctgctcttcggcctgtgcaaagtaatcgctcacgtccccccaatcccaaagctgtttacgagggagcgcttgggtaatttttttcttcagctcgttataactgaggctctgatctttgggttgttctttcgccagtaaggcttgccaaaccgacttatctcgctcgagataatcaagtaacatctcgagcctcgcctcttcgcttaatgtgcttagataacggcggatctgctcacgttcaccgtcttcattctgtgattgctgatcgagtaagcagagggcaacagccacggcgtgcttgcatacggcttgatggcccgccgcagggcaagtgcagcggctagaggaagcttgaccgccagtaagttgtacgcgataaagttgagagcctttcacttctgcgttgacggtatgcccagtgatggtgagcttgcgtaccgagccacttttcgcgagttgtgcacctttcagtagtgaactctgttcacactgttcaaacagcgctgaaatatctaaaaacgaggagtggctaggcatgggcagttccatttcaaagttgtttggctttctagagtagagatagctcaagatgaattgcactttgcctatcgaatcccgatggttcaagtcactctatgcaatttttagctttactgcccaacacctgcttacaattaacccaacgagccgccatcaatgggcttgagtcaaaccgcttcattcgtatactgggcgctcaatcactaggaagttgtttgtatgaaatccaaccaaagcttactcagtaatgttctgatcaacattgttattccagtggtgattttgagcaaaatgagcggtgaagataaccttggcccaacgtgggcattggtggccgcgttagcctttcccctgctgtttggggtttacagctttattcaagagcgcaaagtcaatttttactcagcgctcggcatgattagcgtgttgctcaccggtggcattggcttgctgcaactcgaccctgcttatatagccattaaagaagcggcgattccggggctgatttttgtgattctggtggtcagtaatctgattgggtatccgctagtgcgtaaaatgctgctcaatgaagatattgtcgatcacgacaagctgcacagcgcgttaagcacgccagagaagaaggcagagtttgagcgtcgggtgaatgtcagctcttatctgattgcgttctcgttttttgtttcagccgtgctcaactatggcttggcaaagtggattgtcaaaagccctgcgggtacggaagcctttaacgaagagatcggtaaaatgacggcgctgagctttccggtgatttcactgccggtgacgattttgatgatgggcgcgctgttctatctgtttagaagcctttccagcatcacaggccataagatggaagattttctgcgtagcaagtaatcgcttcgcatcgaaccatcaagatcaacaaagggctcaactgagccctttggttttattgcaagtcttactcgcctgcgaatctcgccatcatgtcacgtgcgaccgcttccgcgactttaatgccgtcaatccctgctgacaaaataccgcccgcataacccgcgccttcaccggctgggtagaagcctttgaggttgatgctttggaaatctttgccgcgcttgatgcacaccggagatgaagtacgcgtttccacaccagtcagcaagccatcttcagaagcaaagcctttgatttgacgatcaaactcagggatcgcttcacgaatcgcttctaccgcaaaggcaggcagcgctttggaaaggtcggtaagcttgattcccggagtgaaagaaggctgtacatcgcccagttcacttgggttacggcctttcaggaaatcaccgattttctgcgcgggcgcatcgtaagtttcaccgcccagtttataggcgttggtttccagttcacgttgcagacgaatgcccgccagcggatcgcctgggtaatcttgctcaggcgaaatgcccactacaatcgcgctgttggcgttacgctcagcacgcgaatattggctcatgccgttggtgacaacgcgcccttcttcagacgttgctgccaccactgtaccgcccggacacatacagaagctgtacacggtgcggccgtttttacaatggtgtaccagtttgtaatccgcggcgcctagaatcgggtgacccgcactgggtccaaaacgcgcttcatcaatcatggattgcttgtgctcaatacgaaaaccgaccgagaaaggcttggcttccatgtacacaccacgcgcatgcagcatctcaaaggtatcacgcgcactgtggccgaccgcgagcaccacgtgacgagattggatctcttcgccgttggagagtatcacgccggtgatttggccatcttgcatgtggatatcgtcaacgcgggtgctaaagcgaatttcgccgcccagttcgatgattttcgcgcgcattttttcaatcatggtcaccagtttaaaggtaccgatgtgcggcttactcacatacaaaatttcttctggcgcgcccgcttcgacaaattcggtgatcactttgcggccgtagaagttgggatctttcacttggctgtacagttttccatccgaaaacgtaccggcaccgccttcaccaaactgcacgttagattcggtattcagagtacgcttacgccaaaagccgaaggtatctttggtacgctcacgcacctctttgccgcgctcaacgatgatcgggttaaaccccatttgcgccagcactaagccagcaaacaggccacaaggaccaaaaccgatcaccagtggacgctcaggtaggttctcaggtgctttggcgacaaatttgtaggacatatccggcgttgggcgcacatgctgatctttgctgaacttggcgagcagtttttctgggttcgccacttccacatcaacggtgtaaatcagttggatatcgctttttttacgagcatcgtagccacgtctaaacagagtgaaagagaggacttgctgagcaggaattttcaacttggcagcaatggcatcaagcagcgcgccttcctcatggttgagaggcagcttaagttcagttaaacgtatcatgggatgtctcgtgggtcatgggtgtcttagcctcaccactggcgtggcggctcacaatggcgcgcattttacgagaattcgcctccactgtcatattaaaagctttgtcttaagattcgggcaggaaacgcccaccatcgaaacggcttgggttgaattttagcggcggcgcagtatcatccccgttcttgatttttgcgtacactttaggtgtgcgaaacggctaactagatagagcgaattgtcatggcttttgtcgtcaccgataactgtatccaatgtaaatacaccgactgtgtggcggtatgccccgcggatgcgttccatgaagggccgaactttatggtgatcaacccgattgagtgcatcgactgtgggctgtgtgtgccggaatgtaccgcgcaagccatttttcaggaagacgaattggtgggtgaccaacggatttttatcgaactcaacgctgagttggcggagcattggccaaatctgactgaagtgaagccggcgatggaagacgccgcaaagtgggatggcgtgccaaacaaactggatatgctggagaaataaaacccagccgcgagcttgagcgtgcaatcccttaagaccgaaatgccttaagaccgcattactttaagaccacagcgccttaagaaaaaagcctagagatgaaaaaagcgtcggacagtccgacgctttttggttttaggtatgttcgttttaggtaaattcgttttaggtaaatggattaactatgctgacggcgaatattgtcgagaatgatccccgttgccatcgcgacattgagtgactctgcgccgccaaaggccggaatggtgatcttatccgtcacgtactgcgccgcttgctcgcgaataccgtgagattcactgcccatcagcaaaatgccttcggcttgaaaagcggtttgatgcacgctcaccccttccaaaaatgcaccgtacactggcaaattcgccttggctaagtagtcgggtaaatccacttggctaacttgcacgcggccaaagctgcccatcgtggcgctgatggttttcgggttatacgggtcggcgcaatcttggctggcgatgatgtgcgaaatgccataccaatccgcgacacgaataatggtgcccaagttaccggggtcggaaacgccatccaacgcaatcatcaacccttgtgctttaggcacctcgatgtgtgggatcgccaccaccgcaatcgcggcgttgttgctcaccaaggtgctgactttggttaaatcatccaaggttgcttcaatacactcgaaaccggctaaggcttgtgcgtgctcggcgagaaactcggcggtcgcaaaaatgtgttgtactttcagcgtgctgttggtcagctctaggacgtttttctcgccctgaaccagaaataagccgtgcgctttgcgctgtttcttctgccctaaagcgcgaatcaatttgagttgggttttcgaaatcatggtgctgtccgagataaatgccggcgaattatagtgcaaagcccctacgagctaaaggggcgcgtaggggaagccatcaaaccaacacaatggcagctttcgattgccaagcgctaggcttgagcaaactcgcctaatgcttgtaatgcctgctgcgctttctctttttgcacgaaaatatggtcgtggtaataacctgcaatcacattggcgctaatgccatgctcagcaagcttagtggcaaacgcggcggttaacccgacggcttccaaactggaatgcacggttaaggtgatcaaactaaacaacgcgctgctctccagccctgcttgctgcgccttttcagcctccaacactaacgtcaacccttctggctcacgaaaagtggcgataggctctaaagataaatagtcactcaatgccccattgactgtgcagaacacgtaatctcccgccatcagctctggcgacatggattgcaacaacagttctaagcttttgattcctgacatttttcctcgcttactctctaggtcttttgcttggcaggcaggatagaaaagctcgtatcataagtatatggaatatttttaatccgtaatcagttctactaataattctggcattaagccctgttatacccatactacttggagttgcaggtaggcggcaagtgagttcatccccatgagtatagataaacgatgtgattggggtgaacgaacgtagccaacaccgctgcagcttcaaataggaaggggatattcagacaatcataactgcgtgatttaagaaaaatgcaataaaaagccctgctgtcgaggcagggcagtatgaaaaatggaataaccggtaagcttagtgacgcactttaaataactgcaccaattcgtaaataagccaagtggcggccaataaatcggcgctgccgccggggcttaagtgtttttcaatcagcacgctatcgagcgcggtaagagcttgttcgatttcttgatataaaaagccacctttggcgagcagttgctgcgcttgttcttgcacaaaatgcagccctgctaatccaccccgtgaaacaagattgctgtcgttattgttggccatcaacaccaataaggtatgccacaaggcttgctcggtgctggctcctttggttaaacaggcttggtaggctggcagcgcatgttgcatcaccatcgcaaggcctgaagcagcttcaccgcgtgcgccagtcaaaccatactggcgataaatgcgctcgcctgcggtttcaggttcacaatcacgcttggcttttagctcatcgataaccaaaaactggcacgcttggcgaatggtttcacctatatgctgcgcatcgattttgagttgattggctttaagccaccccaccgagccgcaaataagccccaagatgaaaatcatccctttgtgggtattcaccccttgtgtggccgcaaacatggcttgctcagcttctatgcctatcgggcgtaaggcgctcagtaactgagctgccggatttcccgcactctcccaaccagcactgacaaaagagtgcagataaggcgcgatcgcctcggcgctggcgataaaagtgttgagatccatatcgcgatgcgcgccattattggcggtatccaccaaacccggtttaggggtgagatgcacctccaacatcatggcatggtaggccagatgccccactaagcggggcaagctgaaggtccttgaacctgaagaggaagacgcttggctaggcagttcaagcagcagatcaagcgcagcaggaatagtcatgcgtcatctcctcaatttttgccagcaaagcttcgacactgtgccgccgtgagcgagcacagatcaccgcatcgcgttcacacagcaggcagcgccgtcttggcaactgcgcaccttggcgcgaaataatatgtccatcgacatcaattacatccagatccatcagtcgccccagcgggtgctcgcgttcaatcttcatcatggcttttttcaacatgctggccgatggagcctgaattaccacaaaggcttccggtccggttttttccaccaacaactgacaagccacttgccgccagcccgttttctgacagagctcttgaatggcacgcatacctgcatccatcacggtttggctggcagcgttgagcttaaccgcgcccggcatgttaaccgtgaaagaaaccagaggcagtgaatggcgctttagccactcaccttgttgccgaacccgcacttctttacgcagaaggagctggtccagactgactgaaagatccggatggtgactcataggctttttacctgtttgataacatcaatgatcgaaccgtcacggtagtgaacaaaggcaacggttttgtcttcaaattgcaacggctggggtttgcccgtcagcaactcggcacgctgttgcaacgcttcaatctcgacaacgggcagttgcgcctcgatgaaacgtgctttcagttcgggacgattcgggtttaccgcgataccttgatccgtcaccaacacatcaatggtggatcctggggtgatgacgttagtgaccttctcgaccacggtcggaatgcggccacgcaccaaaggcgccacaataatcgataagtttgccgcagccgccgtgtcgcagtggccgccggatgcaccgcgaattaccccatcagagccggtgatcacgttaacgttaaactgggtatcaatctccagcgcactcaagataaccacatccagcctatccaccgccgcccctttcgagcttgggttggcgtattcgttagcagagatttcgagatgatgcggattgcgcgctaacgagcccgccgccaccgaatcgaaacactgcacatcgagcaagtaatcaatcagcccctgctcatgcatatcgaccatggttgcggtgataccaccgagagcgaaagaagcacggatgtcttggcgcagcatcttctctttcaaaaagcgcgcaaccgcgagcgatgcaccgcccgaaccagtctgcattgaaaaaccatcatagaaatagccagaatgctcaatgacttccgcagcgcgtttggcgatcaacagctcgcgtgggttggtggtcatgcgcgtggcatccccaccgattttgcttgggtcgcccacttcggctacttgcaccaccgcatcaacacgatcttgagtaatcgatgcagggaaattcgggaaaccgacgatcgcttcggtcagcatcaccactttttcagcgtgctcggcatcaactttggcatagccgagtgagccacaattggacttgcctttaaaaccgttagcgttaccaaattcatcgcaacaaggtacgccaataaacgccatgtcgatgtacagctcaccgctttggatcaaatgcacacgaccaccgtgcgagtgaatatgcacgggctcatcaagcaggccgttagaaatgctgtcggccagcgctccgcggatccctgaggtgtaaatcttgctcactacgccgtttttgatgtgttcaatcaaaggcgaatgacaagaggtcagcgagcttgaggcgagcgtgagatttttaattcccaattcagcaatcacctccatcaccagattgacggttttatcgccgccacgaaacgcatggtggaaagagatggtcatgccatcttttaagccaagatcgacaatcgcttcgcggatcgagcttttcactttgcggctttttttcgcttgctcatcgtgcagatgcggcgtgatcgcgcgcgcttgggtgtaaggcgtcaacgcgtagcgttccacttccagcacagacagagggttatttaatgtattgatactcatgagatgacctttagtgtttgatgccggattcagcacgttgcagtgtccaacgtgcgcgttcgatgatggggccatcgaccattttgccgttaagggaaaccacgcctagccctttcgctgcggcttcttcggcggcttcgatgactgcgatggcgtgatcgacctctttttgggttggagcaaacacgttgtgcagcaggtcaatctggcgcgggttaatcagtgacttgccatcaaagccaagctgcttgatgtgctccgcttcacgcaaaaatccctcttcgttattggcatcggaatagacggtatcaaacgccatgatcccggcagcacgcgccgcttgcagaatggagcagcgtgcaaacagcagctcaatcccttccgctgaacgctgcgtgcgcagatcgcgcacatagtcttccgcgccgagcgcaatcccaatcaggcggcgtgagctaaaggcaatctcaaccgcgttgttgatgccttgcgcgctttcaatcgccgccaacatacgcgtgctacccacttcacgtccgcatgcacgctcgatctgctcgatgactttttccatctcaatcacatcgttggcgttatcggttttcggcagacgcaccactttggctccgccgcgcaccacggcattaaggtctttgatgccgaattcagaatcgagcggattgacccgtaccacggtttccatctcttggtacatagggtgctgcagcgcatggaacactaacatccgcgcggtgtctttttcacgcaacgcgaccgagtcttccagatcgaacatgatcgaatccggttgatagataaaggtgttgctgagcatggcggcattcgcgcccggcacaaataacatactgcgacgaagtttggtcatgatagctggctccactcaatgttctgaacatcacaagcgcgcatcaccgccgcctgtacgcgcgcgcggatcacacaatccagcgcacctttgtcttcgatggtgaccagcgcatcgcgtacttgcatcgcatcgagggtgtgcagcacgacctgacgaatcgcatgaccaaattgctgctcgacggtactgtctaacaccagttcaataccgccatcgttattgggttcaatccgaacctgaagatcactggattccagtgttcccgcaaaggcgggatgggcaattttcatgggtacaaccttgttaatgagttattggataaaacagtgtcagcaccgccctcataccgctaacagttgcggtgcggtctgtagcgaatgttccgcatagtgctggcaaaggtaggaataggtcgttttcggcacgagatcggcaatcgcagcaaagccaaattgtttgagcaagtaacgcacgcgcgatgctgaaattggctgcgaggcttgttgactgcgctcaatttcaaccacttggatcggcgcactggcatcgtgcgcttcttctagccagcggcgcatggcttggttgtagtgacgcgtcaccgtacaaatcggctcactgccgacaaagcggtgcgtaatgccaagtgctggcgcgattgaatggcggaaaatacttaaatccagcgcagtatgggattgattgaccacttgctgatctttaataaaataactggggaaggtcgcgcgcgaaataatataatctgagccggaatgaatagttaaattcaataaatgtttactacccgccttaatcatggccatgcgatcagcgtaagaaaaatctttattctctgcttttacaacaaataaatgcacccagtcacattgttcacaggcttgttcaattaaatattgatgacctaaggtaaatggattggcattcatcacaatactgccaattttacgcccagacatttttaataactgcaactgtttgcaataaacagaaaggcgattagggctattttctaataaagcaatatgcggttcgactttatcgaccaagaaaaaaccacactgtctaaataaatcaatattggctggcttagtaaatagaaagagtgaaaagcgccccatttcataagcgaagttggttaattcggtcatcagtttgagcgcaaaaccagtgccttgcagcgcaggagaaaccgcgatggacttcaacacgtgccccgcaattccaccgcaagcgatgatttggtttgtgccataagccaccacaaaatgctcgacatcgtcatctacggtcagctgatgctggcagagaaactctttgatctgtaagagcttggttcgattcttggttgaaactcgcgagaaggtataaatatccaccatggtcggcttcctcacctattttttctggctttattatctaaattcagccgaaaaggtttaatgagggtaatcactttatttcccgccgttaacgctctttatggttttaatgaatttaattcctatctctttgatttttagttttattttaaatttaaaccataaaaaccattgagatttttaaagccactggtttggatgactattttcacaattatcactgactattttatttaatgtagtaaaggtcttaataacctcattggacatggaattatgaacgagaaaaccctacatttagataaaaagtccgcagtcgtaggtggattgaatctaagccaaacgaaaatatttggcactccactccctttatttttatttttactgctcaccgtattagccgctcattttactgacactttacctagcggtctggtgggtggttttgcgtttatgtttgtcatcggcgcaatatttggcgaagttggcaaacgtctaccgatttttaataaatacatcggcggtgcgccggtaatgattttcttggtggccgcttggttcgtgcacatgggctggctcagtgatcgcgaaatcaaaaccgtgaccgaagtgatggataagagcaaattcttggatctgttcatcgcagtgctgatcactggctcaattctggcggtcaaccgtaaactgctgatccgctctctggctggctacattccaactattctcgctgcggtagcgggtgctgcggtgttcggtatcgctatcggcctcgtatttggtatcacgcctgatcgcatcatgatgctgtacgtgctaccgattatgggcggtggtaatggcgcaggcgctatcccgctttccgaaatttatgaatcggtcaccggtggctcgaaagagcaatactactcggttgctatcgcgatcctgactatcgccaacattgtggccatcgtcgccgcggcagtcatcaacatcattggtgaaaagatcccatccttaaccggcaatggcgaactggtacgcagctcgaaactggatgtgagcgaagaagcgaaaaacctgacagtgactcaccgtgaaattgccatcggtttaatgctggccgcttgtgtgtacaccttctcttatgcgctatcgaaagagattttgcccggttttggttcgattcaaatccacacctttgcttacatggtggtgatcatcgccatccttaacgcggcgggtttgtgcagtgatgaaatcaaagaaggcgcgaaacgtctatcgaatttcttctcaaaacagatgctgtggttactgatggtcggcgtgggtattgcttacaccgatctggctgaaatcatcaacgcgctaacttttgccaatgtaatcattgctacggtgattgtgcttggtgcgattatcggtgctgctttaggtggctgggcgatgggcttctaccctgttgaagcttcgattacagcagggctatgtatggctaaccgcggcggctcgggcgaccttgaagtgcttgccgcctctaaccgtatgagcttgctctcttacgcacaaatatcttcacgtctgggtggcggcattgtgctggtcatcgccagcgtcgtattcggaatgtttgtttaaccctttaacccttgctccttgggattatttggcgcgcttagcgcgcctttttttctctccgttttcaaccctgtttttaccactggaagtgaccatgcaatcaacctcactgttcctcgaagggattaatttgctgacgctggggatgggctttgtgttcatctttctgattttcttggtgtatgccacgcgtgcgatgtcgcaattgattgtgcgttttgccccgccggaagtgccagccaaaaccaccaataaaaaagcctctgccaacaaggccaaagccaacccaaatcaaaaccaaggtgaattgctcgcggtgctcacggccgctgtccatcaccataaaacacaacaaaaactatcttaagtgaaggagaaaccacagatgactcaggcgatcaaacgcgttggtgttacggatgtcgtattgcgcgatgcgcaccaatctctttttgccacccgtttacgaattgacgacatgctgccgattgcgcagcaattagatcagatcggctattggtctttggaatgttggggaggcgcgacctttgacagctgcatccgctttttaggcgaagacccatggcaacgcctacgtttactcaaacaagccatgcccaatacgccactgcaaatgctgctgcgcgggcaaaacctgcttggctaccgccactatgccgatgatgtagtggatacttttgtggagcgtgcggtgaaaaacggcatggatgtatttcgtgtcttcgatgcgatgaacgatgtacgcaacatgcaacaggcgctgcaagcggtgaaaaagatgggcgcgcatgcgcaaggcacgctctgctacaccactagcccagtacacaatttacaaacttgggtcgatgtggcgcagcaactggctgagcttggtgtcgactcaattgccctgaaagatatggccggcattttgaccccgtatgccgctgaagagctggtgtctaccctgaaaaaacaagtggatgtcgagctgcatctgcactgccactccaccgctggccttgccgatatgactctgcttaaagcaattgaagcaggcgtggatcgagtggataccgcgatttccagcatgagtggcacttatggtcatccggcgaccgaatcactggttgcaaccttacaaggcacgggctacgacaccggattggatattgccaaactcgaacagattgcggcttacttccgtgatgtacgcaaaaaataccacgcctttgaaggcatgatgaaaggcagtgatgcgcgcattttggtggctcaggttccgggcggcatgctaaccaacatggaaagccagctcaaacaacaaaacgcgctggataaactcgatttagtgcttgaagagatcccacacgtacgtgaagaactcggctttttgcctctggtcacccctacctcacaaattgtcggtacacaagcggtaatcaacgtggtgctgggtgagcgttacaaaaccatcaccaaggaaaccagcggtgtgctgaaaggagaatacggcaaaacgccagcaccggttaacactgagctgcaagctcgcgtgttggcgggcgcagaagccattacttgtcgccctgcggatttgattgccgccgaaatgccaaccttgcaagaccgcgtattgcagcaagctaaagagcagtacatcaccctcgccgagaatgcgattgatgatgtactgaccattgcgctgtttgatcaggtaggctggaagtttttagccaaccgccataacccagaagcctttgaacctgcgccgcaagcgataagttcagcctgcgcaccgaaagcgccaacagaaaaaagcaaagtacagccagtggaaagtcacggtgtgtacaccattacggtgaacaaccaaagttatgtggtgaaggtggatgaaggcggtgacctgacgcatgttgcgccgacggcatcaaccaaccacgcaccagtcccgagtgccgcagaaggtgaaaacctcgccgcgccgctctctggcaacatttggaaaattcatgcctcagccggtgatgaagtggccgaaggtgatgtcttgctgattttagaagccatgaagatggaaaccgaaattcgcgcgccacgtgccggagtgatcagtgccattgaagtcaatgaaggcgatgccgtacaagtcggtgatgctttgttggtattggcgtaatcagaggcggaaagtatggaaaatattttagccatggtgcgtgattttggcctgttccaccttcagtggggacagggcatcatgatccttgttgggttagtgctgctctatcttgccatcgtcaaacgtttcgagcctttgctgctggtaccgattggttttggtggcattttatctaacctgcccgatgccgggcttgccatgtcagccatcgaaaatgccgtgtatgcggccaaaccggaagtgatgacggcgttttcagaagtgctgcaactcagctcctacatgcctgcagacatcaagcaagccttgagcagcgcaacgccactgcagatgaccaccttgcacctgctcgctgagcagtaccaatacagtgatggcatgctctatctgttttacagcattgccattgcctctggcgctggcccattaatcatctttatgggcgtaggcgcgatgaccgattttggtcctctgctcgccaaccccaaaacgctactgctcggtgcggcagctcagtttggtattttcaccaccgtactgggcgcattggcattaagcagtttaggggtgatggattttagcgtggcgcaagcagcagcgattggcatcataggtggcgctgatggcccaaccgccatttacgtatcgagcatgctcgcgccggaattgttgggtgccattgcggtggcggcttactcctacatggcgttagtccctatgattcagccgccgatcatgcgcgcgttgaccacgcaagaagaacgcaaaattcagatgcagcaacttcgtcaggtgcacaagctggaaaaaatcggcttcccgctcctgctactgattttgatcgcactgctgctgccttcggcaacgccgctgctgggtatgttctgctttggtaacttgatgcgtgaatgtggcgtggtggaacgtttatctgacactgcacaaaacgccctcatcaacatagtgaccattttccttggcttgtcagtgggttccaaactgatggcggataagttcctgcaaccccaaaccatcggtattttggtgctaggcattgttgctttctgtgttggtacggcggctggggtgttaatggcgaaactgatgaaccgcttttccaccaccaaactcaatccgttgattggttcagcaggcgtttccgctgttcccatggccgcacgggtatcgaataaggtcgggttagaagccaacgcacagaactttttgctgatgcatgcaatggggcctaacgtcgcaggagtgatcggctctgcggtagctgccggggtaatgatcaaatatgtgatgggctaaacataaatggttggggtttcttagaccccaatcaataagccccgttaatagcaaggatagactcgccggcatgaaaatatcactagcgcaatttttacataccaaggtctgtcagactctttcatttcaacaaagggtcggcgctcttttggtggctatggtggtgatccagctttcgctggtggctggcttttttcatcaaaccttaagtgaaaccttacaagatcagatcagcaccaaagcgctaatccaagcgcgcgaaattgcgaccgatcccaatctcattgtgctgatccaacaaaatcggcttgctgaagtgcaggccaaaatcgatcgtttacaacgcatctcggatgccaattttattgtgattggtgatgccaatggcattcgcatcgcgcatccggatgagcaaaaaattggtttaccgatgcaaggcggtgacagccgtcgcgcattaaaagagggcgaatattacacctcaacccaaaaaggcagcctaggctgggccattcgtggcaaagccgcgattgtcgccccttcgggagagatcctcggcgtggtttctgttggctacctgctcgataacatcagcagttggctgcgggtttactcctacccagtgattttcactgtgctgcttttaatgctgctttctgcgctcggcgcttggatctttacccgccatatcaaacagcagatgttcaatatggagccggaagagatcgccatgaacctcaacctacagcagtcgattttacaaagtgtgtatgaaggtatcgtcgcgatcagcttgaaaggggaaatcctgtccgtcaatgctaaggcactgaatattttgggcattgcccatcagccgactcatttgattgggcgtaatgttcaagagttcatcactccaacctgcttttttatgggcgcaagcccgtttggcaagttggcgcagcaaaaccgtgtcagccagcaagatgaactgatcagctgtaatggtgaaaccttggtcgcgaatcgggtaccgatcaactctgggcagcaacaaatcggctgggtggtcagctttcgtcgccgcaatgatttcaacacactcacctcgcagctcactcagatccgtcaacataacgataatctgcgcgtgatgagtcacgagtttgccaaccgcctctcaaccatcggcggcttaattcaaatcggtgcgtatgacgaagcggtgaaaaccattcgccgcgaaacggcagagcagcaacagctgatcgatttcatcgcccaaacttttcacccgaaagtgatcgcggggttactgctgggaaaatacagccgcgccaaagagttaggactgtgtttagagttcgatccgctatcgcatctgcaccaagagccgcagtgcatgacttcagatgaactggcggcggtacttggcaatctgctggataacgcgtttgaagccacgctaaaaaatccacacagcaataaaaccatttccctgctgctgaccgataacggtgcggagttggtgattgaagtggcggacaacggcatcgggatctcggccgacatcgcccaaactttgtttctcaagggagtgagtagcaaaaatcaagaaggacacggtatcggactttaccttgtccatcaatttgtcactcaggctcatggatcgattcttatcgacagtgcggagccgcaagggactattttttctatttttattcccaatagacccaaaacgcttgcggcggaaaaccttccagcgcttgccgaacgggcataagaagagtttgattatgatggaattaatcgacgtattgatcgtagaggatgaaacgagtattgctgacgtgcacagcttttatctcaaacaaaccgcccgctttcgcccagtcggcgtggctcaaagtatcaacgaagcgcgcaatatggtgcgcattctcaaacctaaactgattttcttggataactacctgcctgatggtcgtggcattgagtttttgaaagagctaacccatcaaccgcaagcgccggatgtcatttttatcaccgccgcttcggatatggagaccgtgcgcgaagccgtacgctgcggagtttttgattacctgttaaaaccgatcgcctacgatcgagtacaaaactcgctggaacggtatctgaaatacatcagctcgctgcgcgccaatgacagtgtgaatcaaagacacgtcgatgagctgtttaattttcaagccaaaaccgatcagcttgatgggttgccgaaagggattgatgagctgaccttaatcaaaatccaagagatttatcaccatgaaccgcaagccgcctacaccgcagaattgttaggacaagcgattgggatcagcaaaaccacggccagacgttatttggaatattgtgtggccagtggttttctggaagcctgtattcagcatggtcgggtgggccgtcccgaacgactttatcaaaagcgctaacccactcagcatgccgaatgcatcaggcatgagttacaaagtgtagtgaaaggggatcacttcggtgctctcccctatttccaacattccttctaagttgttgctgtgacactgacaaagtgggatcacaaataccccttcttcatctttatcgcatttcactagcatcgcctgagaagatggcgttaagcagttaatctcagcgcaaaacgcctgattatcacggctaaagtgctgccaataggccaaccaattttctcgcgcttgggcagaagccaaatctctagaaacttttcttactaacatcgcatcaccactgtggctattgagtcgccctattacaatggatttcgactccgctaagcatgaagcgattcaaagttcgccgtagcgataaaaatcttattggtttttatgtggttatcttcaattccgatttaatcaactcgttgagtcatcgcctaagaggactcactgtgtataacggaaaatggtgcgatttaaacctagcggctcaccgagccagcggatgcggtcgtcttgatggtcataagcatcatcgcccgataccggatggatcagtacactcagcgcgccgcgattttcctctaaccattccagtaagccgtgttggttatcgcgaaaatgcatttcaaacataggcttaacatgcgggccaacacgacgcggaactaaaccaaataacgcgatcacatcacggcgttcacgggcaatttgttggcgaaagcgctccgcgacaatcgcttggtctgggtcaaaataaacatgggcatggaacataataactccttaggagagaacaacaggacgaggtcagcatagcgctacactaaacacaatatcagcagccgaatttgcacaataaggtcgatttcttcgaacgagagtgcaaaatacaccgcccctatagcgtagaatcgcgatcggtttggctaacctgcaccggaatttgcttttgcaaccactggcaaaaaacttgcgtcgcgtcagtggcttggtgagtaatcaaaaagtagccagccttggctcgaatgggagcaaacggggtaaccaaacgccctgtatcgagttcgtttgaaagtaaggcagtacgcgccattgcaatccccactccggcctctgcagctgacatcgccatatccgtgcggttgaagtagtgatcacgccgctcaggcaaggtaattcccatctggtgagcccagtagtgccactcttggtcgcgtgccgcattcgcccacggcattgcatcatgcaataaaaccacttgctgccaagcttcggagttagcccaatcctcctgtaaccaagaatgggctgcgagatagttcgtgctcatcacgggcaataaccactcctccatcaataactgcgcatctcgccgtggataaggtaacgcgccataatcaatcgccagatcgtaatcacgccgctcactatcgaccaacgcgccttccgcgaacgtctgaatctgaatctcaggatgacggcgataaaagtcctctagccgcggaaccaaccatttaaacgcaaatgatggcgtcagtttcagccggatctcttttcgctccgttgatggcactaaactgtgaattgtctgctcaatatcttgatagctacgttgcaccgttgtcagtaagattcgtcctgcctcagttaaacgtaccccgcgagagtgccgttcaaataagctaaaacccaactgcgcttctaactgcaacatttgttggctgatcgcccccgtggtgagatggagagccgcagcagctaaactaaagctggtgtattgagctacctgcataaaagtatgcagactggcaacttgctggctttttaacatggacttgcttttagttttactaaagggtggtgataatttttatcgattgttaatgaaaagtaaacctccgaaactgagccgaaaatgaagcaaggagtcaatgatggaagttttggttttaggcagtggtgtggtcggattaaccagcgcttggtatcttgcgcaggcaggccatgatgtcaccgtcgtcgatcgccaaccacgtggcgccgaagaaaccagctttgcgaacgcagggcaaatctcctatggctactcttccccttgggctgcgccgggcattccgcaaaaagcgctaaaatggatgctggaaaaacatgcaccactcaaaatccaaccctcgcttgatcctgcattactgagctggatgggcaaaatgctgctcaactgccagttgtcgcgctaccaagttaacaaatcgcggatgttggcgattgccaactatagccgcgagtgtttaaaagcgctcaatcaaacctattcgctcgattaccaaggccgccaacgcggtactttgcaggtatttcgtgatgaaaagcagttaaccgcgattgaaaaagacatgcagcttctggcgcaaagtggcgtacgttttgagttactgaatgtcgcccagtgtctgactcatgaaccggggctcgcccctgtgcaggaaaaactggtgggcggcctatggctgccggatgacgaaacgggcgattgttacttgttttgccaacagttaaccgaactggccaagcaacagggtgtacgttttcattttgactgccacattcagcaactggtttgtgagggcaaaaagatcatcggtgtccaaaccgatttaggcttgctcaaagcggatgcttatgtagtcgcattgggcagttattcgacctcattgcttaaaccgctggggattgaaattcctgtctacccagtaaaaggatactcgttaaccttaccgattattgatgaaaaatttgcgccgcaatcgaccgtgatggatgaaacctataaggttgcactgactcgcttttccgatcggatccgcgtggcgggaacggctgagttagcgggttttgatccagcgattccagaagcacgtaaagcgacgattgagatggtcgcgcgtgatttgtttccgcacggcggcgattttgcaaaagggcaattctggaccggttttcgtcccatgactcccgatggcacaccaatcatcggtgccactccctataccaatctctatacaaatactgggcatggcacactgggatggaccatggcttgcggatccgccagtattctggccgatgtgctcacccatggcgaaagcccgctcagccgtttggggctagatctgttccgttatccgaaagcatcttaaatgcgcggctttttggctctgcctgcaggagcatggcagagtcatctctcacaatccgcacgccatccgcacgccatccgcagtgtaaaactccaataagctgactaaattatggtcatttcttatttatttttatcctacttaaccaaagcataaaatttttatctagcacatatcacccaccagattgaccaaaaactcaccacaccctccaatactcagcccgttgtacaacgaataaacagtttttgtgttcagcgtcacgcatccattctttgccagataaaagaattaacatttgagttacaaaaagattaatataccgaacacacaacagacacaataaacacaacaactcatttacagggaaactacttatgcagtcatttgttgattttctgaatggaatcatctggagtccggcgctgatttatctctgcctcggtgctggcttgttttattccgttctgactcgttttgtacaggttcgtcacttcttcgaaatgtggcgcctacttctgaataataaagagtcctcaaaagggatctcctctttccaagcgctcgccgtatcactctcaggccgtgtgggtaccggtaacattgctggggttgctgccgctatcggtttcggtggcccgggtgcggtattctggatgtggatggttgcgttttttggtgccgccaccgcgtatgcagaatccacactggcgcaaatttataaagaagaagacaacggtgaattccgtggcggccccgcttactacatcgaaaaagccatgggtcaaaaatggtacgcttgggtcttcgcgattgcgaccatctttgcttgtggggtgttgctgcctggcgtgcaatctaacagtatcggcaacgccgttgagtcagcatttggctcaggcccaatgattgaaaccgcactcggcacctttagctttgccaaaattttcaccggtacggtgatttcaatcctacttggcttcattatctttggtggcgtaaaacgtattgcaagcttcactcagatcgtggtgccttttatggcgctggcgtacatcatcactgcgttcgtgatcattctgctcaacatcggtgaagttccacgcattattgcgatgatcgtcggcgacgcattctcaccgatggccggcgtaggtgcggcgattggttggggggtaaaacgtggggtttactctaacgaagcaggtcaaggtactggtccacacgccgcagcggcagccagtgtagaacaccctgcgcagcaaggtttggtacagtctttctctatctacattgataccttgatggtctgttctgccaccgcgttcatgattttgatcaccggcgcttacaacgttcacggtgccgctgaaggcatgttccttgtgcaaaacctgccagcggacatcattgccagcagcccagcctttacccaaattgcggtagatagtgccctccccggcattggtaaaccgttcgtggcgtttgcgttgttcttcttcgcctttactacaattttggcttactactacatcgctgagactaacgtggcctatatccgccgtaccttcaaagtcgatggtttgatgtttgtgctcaaacttgtactgatggcatcggtattctacggcacagtgaaaaccgcgaacttggcatgggcgctgggtgatgtcggggtaggcttaatggcttggctcaacattgtcggcatcatcatcatcttctttatgtctaagccaaccatggcggctttgaaagattatgaagatcagcaaaaacaaggtgtgaccgaatttaccttcaacccagtgaagcttggtatcaaaggggcgacgtactgggaagggaaataccttcgcaaaacgggcaaagccccaaccgcggaagtgaaagagacccaaagggtagagcaaactagctcactataagaaaaagcagtgaacacaacataaataagtcaaagggttagcattcgctaaccctttatttttcaactcaaggtgaagattacttcgttttcggttcgataatattgaaccagaattcgaagttatccagcatacctgcgatatcggtcagcgcttgcgcgttgccttcaatcttcgctttgccttctttggccaactgttgaatggtggttttacccatcaatacttgattgagctgagcacgattgagagtcagcgtcatatccggattctccgattgaatgccttttaagttattcaagtgggcattttccagttcaaccaagaatttctcattcacatctggcaagacgaaattaatggtgtaatcaataccagcggctttgtcgccattgaggcgaacgcccaaatagtcgaggaacagctcagtatccatcgccacaaccgtatcagcacccgccgttttggttgctgacactttcggtaccccattacgcaactcatacgcgcccatcaaataagtgttacgctcccctgccgattcactctggtagcccagttgctccaagcaatccgcctgtaagtaacgagcttgtttattgctcggctctgcaaacacggctttatcgacaatctctgcacaccaacgaaactcgcctttatcaaacgcttctttcccaagcttaatcacgttatccatgccgcccatcgccgcgacatatttaggagccgcatcggttggagccaatgggcgtaacgtggcgggattcatatcaaaataccccagatatttgttgatcaccgctttagcattgcggtggtaactaccgtgataacctcggttgtaccactcgtgtgctaacacatccggtacatggaattcgtcttgaatttcattgatggtgacaccgtggttggccaaacgtaaagcctgatcatgaatgtagccgtacatatcacgctgtttacgcaggaaatggttgatattgtcgttcccccaacgcggccatgtgtgtgaagcaaacatcacatccgcctctttcgcgtacatatgaatcgactcattgatgtatttgctccacgccttggcatctcgcacttctgcaccacgtaaggtgtagacgttgtgcaaaccaccaacggtgttttctgccatccacaaggctttaaactgtgggaagtaggtgttcatttccgctggagattcggttcccggtgtattctggaactccatggttacgccatcgatcaccacagtttccgtttgctcagaaatgactttggttggcgcaatcaagctcacttcaccttgcgcgacattcttaccaatcgcggcatccacctgcccggtcgcccctttcggtaaaacgttgccatattgataagtcgtacgacgcgacatggcatttcctgccaaaacattctcagccaccgcgtgatttaaaaagcctttcggtgcgatgatcggcacttcacctcggtcgacctgctcttggctcacaatgcctttgacaccaccaaaatggtcagcatgcgcatgactgtacaccacagctttaacgggacgctcacctagctcttggttaacaaaatccagcgccgctttagccgtagcaggaacggtcaatggatcaaacacaatccatcccgtatcgccctttacaaaggtgatgttggccagatcgtagccacgtacctgataaatgcgatccgtcactttatacaggccgtgatgcatattcagttgcgcttgacgctgtaaactaggatggatgctgtcatagtcgagtccatccaataaaaagcggtaattacccaattcccaaaccaccttgccattcgcatctttgatttcgagatctttttgctgcgcgatcagacctttctcgaccaatttgaaatcttcctgatccgcaaacggcagcgtattgcgttgctcagccgcaaacgcttttgtggtagggctcggggctttggtatccgcaatcaatgaatgagctaatacgggcgcagaggcggccactaataccgccaacaaagtgggtttaaagactgttttcattgggaatctctctttttagtcattagggaacaaggacaaggatatgagagaaattgccgacaaacgattcgccaaacaataatcaatagttaagcattgcttaactattgattattgtttggcgctgccgcgagagagcacttgagtgaatcaccatacgcgaagacacgctatggcatggagagaaacaagaacgcagccaataaattgtgtgaccttaaatagattgaggattggcgcagagaatcgcctcaatttgctcgcgcagccaaatcagccctttatcttgctgtttggctttatgccagcacataaaagtcggaaccgagcggatttcaaacggcaaaggttggatctgtaaacccaatttctccgcccacatatccgctaaacgctttggagtaaaacagagcagatcggtgacggatgcggtcgccatcaaattgagcatcgactcactttgataatgcactcgacgtgcgggcagcacctgatcgactaggctagaaaagagataattaccaaagcgacgactggttaatgcagtgtgtttttctgcaaaaaactgctcaaaactgagggtacttccaagacgcggatgatttttggcatacaccacaaccaaggcctcctccgccacctgtgtggtgacgatagagggatggctgatgggtaatgcagccaaaaacagatccgcctctcgctcacttaatacttggcttggtgtgaaatgatcgtcctcataagactttaaattcaccgtgatatgcggggcgatgtcgctgattttttgcaaaagtggcggtaataccaccaaatcgaaatagccctgaccgccaataataaactcacgcttactggttgcaggatcaaaaccggcatcggtttctaaaccaaaacgaatggcactcaagccttccgccacatgtttgtgcatattgagcgcatactgcgtcggctgtaacccacgtccctgacggataaacaacggatcgccaacttgttctcgtaagcgtgataaattttgactcaccgctgcggaagtcatacctagcttatccgctgctttactgactgagcctaatttcatgacagaatcaaataccgtcagcaggtttagatcataatcacgcagcataatcaataagttaactcaagtaggtaaggtggggacatgatactcgattttgcctagcattggtaacacgctgacggtcaatactcgctgttgttcaaaccaacgaaagtaaacctcacaactctgttgtgcggcattaggtacgcgcgtcaatgtgaaactcattttgtttggctccagtgaactgagctgggcatcgcagaaatcaaggtagaggtgtacttgtgggaatagtgctttaaatagactctcttttgcagaaaacagcaaagtcaccgctgaagcgagatcgaactgttgcgccaacagtgcccactcttgggcggtgccgattatagcttgcacctcactagcggtttgatgtgcgagccgatgttcaatatcaataccaagcgagaggtgttctgccttaagcacagtgcatactgcccagccgtcacaatgggcgatcgagcccgtgatccccgcaggccatagtggctcacgatgggttccgatagcaattggcctatcataaccctgcccgatctgtttgagcgcttgctgcgctaacttacgtcctgcgacaaattccgcttggcgcttaaccacggccttgtgcaggctatggtaggtgggaggggctaaatagtgctgctgatcctcatcaaattgctgaggatcgaattggcaaacctgaattgtcagccctgccagctcaatcgctggcattgaaatcataaaagccatgtttaaccgcgctttaacgaataaggtataatcaaaggcgtgcaggagataggatcgggcataacgacacaatcaatcccaaagacttgcttaaccaatgctggagtcaccaaagagtgtggatcgccctgcgcgacgattttgccttcttgcaacacaatcagatggtcggcgtaacgacacgcctgattcagatcgtgcagcacggcgactagagtatgcccttgctgacgattaagccgccaaaagagatcgagcagttcgatttggtgagcaatatcaagataagtggttggttcatcaagcagtaaatacggcgtttgctgcgccagcgccatggcgacccaaacccgctgacgctgaccgccggaaagctgatccacactatgctgcgcaagctcatggacgtgagtggctcgcatcgcctcttctaccgctcgttcatccaccctgctccattggcgaaatagcccttggtgaggataacggccacgagagaccaaatcgaccacctttatcccttcgggtgtcaacgcgctttgaggcagtaatcctagctgcttggctaccaccttggtcggcaattggtgaatattctgaccatccagtaatacttgcccagccagcggcttgagtaaacggcacaagctttttagcaaggtcgatttaccacagccattaggcccaactatcaccgaaaatttcccgtgcggaatcgccaaatccagcgcatcacacaccgattttccttcataacctaaactcagtcgctcagtcttaagcctgtgatgttcagcctttaatgcagcgctctgtaagtcagcatcccaaattgtgtccataacggcatttcactcaatcaaaattctctttattccgcaaagcgttgaatggctcaaagcacaggctgacgactgcgcgcaaatagcctaaaaaacctgtcggcatgtgatgcggcttaaaccgtattttttgaacgcatcaataagattaataaatacatgcccccaaccaatcccgtaattcgcccgatgggaagggttaaggcgagcggcatccactgagtgagcaaatcagcccccaacagtaagcaagctcccattaaacctgcactcaccagcggaatattggcggtttgacgcaagcgagctgcaagttgaggagcggccaaagcgataaaggcgatcggtcctgcggctcctgtcgctaatgccgccaaagtcaccgcggcgagaatcatgaataagcgtatcggctcgactacgaccccaagttgacgggcaatctcatcccccatctcaagcatctgtaatgagcgggcaagacttttgataagcggcagcagcaccaacacgccacacatgacaggaaatacgtggctccattctcgggcatgcagtgagcccgataaccataaattggcggtgatggcgctgtctaaactgcctttgactagcagcaagccattgagcgccgtcaacactgaacccacgccaattccggttagcactagccgatagcgcccgaccgtgcctgactttaccgacaacagatagactgcgatggccgtcatgactccgccagcaatcgccgaaaaaaccacggcaaccccactgccggaaaataaaataatttgcagcaaagccccggtggccgcgccagaggtgaaaccaatgatgtccggagaaccaagcggattacgagagatcgactgaaaaatcgcgccggaaaggcctaaggccgcaccagcaaacagcgccgtaaaaatccgtggtaaacggatatcgagtaagacttgccgtttgaaccctgaggtaacttcccccaataaaatggcagtgacgtcagagattgaaatcggcaatttgccgacacaggtcgcaagtatcatcaaagccaaaacaataaggcttagcaccaacgcaaccgcaatgttgcgccgctcaacacgcagcgtgtatgccccttttcgccatagccaaaagcgagtttgattcgaccgaccttctggggctacagatgtgatagtttccatcgtctcaccaatagcacaaagactggccctccgattaaggcgaccatgatccctgcgctgatttcatcgtttgaaccgattagccgcccggccagatcggcacctaacaataacagcgccccaagcaacatagagtaaggcagtaaacgacgatgttcagcgcccacccaaagccgcgctaaatgaggcgcggttaagccaagaaaactgattggccctgccgctgcggttgcggtgccagccaacagcgtgaccacggcggcagaagctatccagatccataacggattgacgcctaatgctttgcccgcgtcatgcccgagcaccacagtatccaatccgcgggcgagtaagatagccgcgatcaacccgagtagtacgaatacacttgtcggcagcaaaacttcatatcctctgccttgcaaagagccaatcgaccaatgtcgaaactggttaaacacctcttgggcgctattgagcataatcaaatgagtcatagacaagagcaccaccgtcatcgccgcaccagccagcaccactcgaacgggattgggtgattgattgatacctgccagcagataaacgcccacactggttgctgccgcgccaaataagccaaaccacaaatagtgcagcatatcggttagaccaaacccagcaatgccaatcaccaccatcaagattgcgcccgcattgacacccaaaatgcccggatccgccaatgggttacgcgtcatcgcttgcatgataacgcctgcagccccgagcgctgcgcccaccaatatcgctaaccccgtgcgcggcacacgtaggtaatgcactagaagatgctgagtattctgctcatcaaaatgaaacagcgcatcgaaagtcacggcataaggaatgtcgcgagatccgacaaacacactgcttatcgtcaatcccatcaatgccaccagcatcaaccccattagccagtaatcacgccctgccaacgtcggattttctcgctttgaggacgcaactcttattcccatcagctcattcatggcatgactaaagattgtgcttgctcgccagcaaagcgtcgcagcagtgagttaatgatttctcgggcactgaacaggtcaatgcgaaatgagttttcacccaatccataaacttgtttgcgctggatcgaaggcaagtttttcaaaatcggatcgtggagaaaagcttgagcttgctgatcggtcatcgtgataagaaacgtggtttcagcctgcaactgagttaaatgctcataatggatgcgcagaaaatctcgatggacgatggaacccgcttgccatgctggatctggctcctccaacacaaccccgaccgattgcaacagttgagcatgagcactttgcgctttcgccaccgcattgaccacaccggggccgtggtagctcacaatattggcgcgccctttgggcagatccagcacatctcgcacttgctttgtccactgctcaaaattgtgtattgtgcgctccgcttgctcttcaagtccggtagcaagccccaactgctgcgccaaagattgccaagtttgatcgctgtaatcgaccaagatggtgggagcaatcgcttgtaaaaggggaatttgatcgcgagcggaatccgcgcctatcatggaaaccacgatcaaatcaggttgttcgacatacaccgattcgagatcgacacttcccgcaggccaaagttttttcacttggcgcagctctgccagctttcgccactgctcaaaaaaggtgctttgcgtggtcgcagcactagcaataactggcgcatctatcgccagcagtgttccggtcaccgtgacggccgtcgacaaaattcgctttggctgagagggaatcgtcgtgattgaaccgtccgcattctgaaaggttcttggccaaacattctgctgcgcgctgacaaaaccactgaacaggcaacccaatatcacagacaataaaataaaaatgtttttcattgtaatattgattctcatttcgttaaaagtttactatcgctcatcaatcatcttagggtggactctagagacagaggggtgagtaaaaagtgaactcagtatagccatgccccctcaggctcgcaaccaagccaccgaacaccgcctcacgcgaaagagtaattatgattctccaactggataaggcttaatatcgtgtctatgttattggctcaaaagcctttttggcagcgccatctggcttatcctcacattaatctcgacaccgttgcccattcgctacgcctgacagggcctttagataccacacttttgctgcgcgcattgcatttaaccgtcagtgagatagatctgttccgtgctcgcttttctgcgcaaggtgagctgtattggcacccattttctccgcctatcgactatcaagacctcagcatccaccttgaagcagaacctttagcttggcggcaaatagagcaggatttacagcgctcaagcacactgattgacgcgccaataacgagccatcaagtgtatcgtttgtcacacagtgagcaccttatctatacccgtgcgcaccacattgtgctggacggttatggcatgatgctgtttgagcagcgcctcagccaacattaccaatccttgctcagtgggcagacgccaactgccgcgtttaaaccttatcaatcctatctggaagaagaggcggcttatcttaccagccatcgctactggcaagataagcagttttggcaaggctatttacgcgaagctcccgacttaacgctcacctctgcaacctatgatcctcaacttagtcatgccgtgagcctctcttacacactcaatagccaactcaaccatttgttactcaagctcgctaacgcgaatcagattggctggcctgatgccttagtcgcgctgtgcgcgctctatttggaatcggctgaacctgatgcgccttggctgtggctgccctttatgaaccgatggggcagcgtggccgctaatgtgcccggtttaatggttaactcgctgcccttgctgcgtctttctgcgcagcaaacctcgctcggcaactaccttaaacagtcagggcaagcgatacgctcactctatttgcatggccgctatcgaattgaacaaatcgaacaagatcaagggctaaatgctgagcaaagttattttatgagcccatttatcaatattttgccttttgaatccccacactttgctgattgccagactgagctcaaggtgctggcttcaggctctgcagaagggattaattttacctttcgtggctcaccccagcatgaactctgtctagacatcaccgcagatttagccagctacccgcaatcccactggcaaagtcattgcgagcggtttccacgttttttcgagcagttactcgcccgtttccaacaggtggagcaagatgttgcacgcctactcgcagagcctgcggcattggcagccaccacctccacacgggctatcgccagttgaaagatgaacgatcaatgatcgagcgtggctccaccatccactcgtaaatcatgcagcgtgatgtgacctgcgttatcggataacaaaaacaggaccgcttgagcaatatccgctggctcggcaattttattgagcgggatccccaaccgaaattgcgcagcatctccggcaatgacttgtgcctcaccatactgctcagtccaaagctgttgctgcatagcggtgcgagtggagccgggactgaccaaattacaacgaattccgtaaggggctagctccataccaatgcacttaaccagcatgtgtaatgcggctttcgaagcgccataagccccaatcgacatgcgcggcgtattggcagcattagacccaataatcaccatacttccctgctgacgcgctttcatacttgaagcgacaccttgcatacaggccaacacaccaaaagcattcacggtaaaaatagaactcacttgttccattggcatttcatgcaatggcgcaacatgtaggattcctgcacagcagaccagatgatcaaatcccgccacttgctcagcccattgattgacttgctcgcgcaccgcttcaggctctgctaagtcgagtttttttaaagtgagctggtccggataacgccccaataacgactcactctgctctagcaacaactgccactcacaatctgccgccatcacttgcgctcccgcttgcaataaatgttcaagcacggagaaccctatcccacgcgctgaccccactagaagaaccttgctgttaaccaacgacatatctttcatcccctatcacaaacgagatcaaccttcacaatcatcactttgattatcagaccaaatggaaattgcttgcatttattaataaaaactattctcatttgaatgtaagcaaatgtaatctgttgcgcttggcaacgcaacccattcactcgcaaatatggataaacaacatggtcatgaagcgtgaagtggtcggatacaccactatgtctgaacatctgatcgacacccaactcactcgctcaccgtttttctttgcctcagcaaaccagtcaatgctcggttgtggggtcgctcatgcttttcagcaagccattccttttgctgaactggctaaccaagccaaacagcttttgcagcaggccaaacgtgatgagtgcgacaatccattactgtttggcatagtgccgtttgaccctaaaacaccgactcgatttatgattccgcgcaccttatacgtgtcgagtagcccgcgcttaaaccgtccagctcacctcacccgccaagtggctaaactcatctcctcgccatcaggagagcaatacaagcaaggtgtaagccatctgctcaacatgtttcatcactctgggctgtctaaagtggtgctgtcgcgcgccattgaaattgccaccgagcaagagatagcactaccgaccttgctgcgtagtctgctcgccattaatcatcacggctatacttttgcggccagcttggacgagcagagaaagctgattggtgcaagccctgaactcttggtcgccaaacgcggaaactatctcatctcaaacccactggctggctcgcgcccgagaagtcaagatgcccaagaaaatgcgcagcgccgtgcctcactgctcaataccgccaaagatttgcatgagcacggtttagtcgtcgaagaagtcgagcggatcatgagccgctactgtcgtaacttgtacacccccatggtgccttctgtgattgaaaccgaaaccatgctgcacctctcaaccctacttgaaggacaagtcagcgatcctgaggtttgtgctttgcaagtcgccgccgatttacaccccactccagccgtatgcggttttccgcgcgaatcggcttatcaagcaataagagagctggaagaatttgatcgtggctacttcactggcatggtcggttggtgtgatgcacgtggcaatggtgagtgggtagtcaccattcgctgtgctgaagtgggatctcaccaaatgaagctttttgctggcgcagggattgtcgatgagtcgttaccacaaagtgaactggaagagacgggcgcgaagatgaaaaccatcttggctgcggcaggtattgagctcaacgatgtgctcaccgcttaaggagataagaatgacaaccgattttaccccttggccagaggcacttgccgctcaataccgtcagttaggctactggcaagataaaaccttgctcgattacttacagcaaagtgctgagcgtacccccaatgcgcttgcgctggtcggtgataatcagcagtggcgttaccaagccatgctcgaacgtattgagcagcttgctgccggatttaccgaacttgggctaggctgtggcgataacgtagtgctgcaattaggcaatgttgcggaattctatttatgctttttcgctttgctgcgccaaggcatacgaccgattctggcgctccccgctcaccgtttagcggaaattcgctatttttgtcagcacagccaagccaaagcttacctcattgatggcgctcagcgaccatttgactatcaagctttggcgcaagagctgcttgcttgctgcccaacactgcagactgtgattgtacgcggccaaactcgagtgacagatccaaaatttattgaactggcgagttgctactcggcatcatcttgtcaagcgaatgccgacccgaatcaaatcgcctttttccaactttccggtggcacaacgggcacgcccaagctcatcccgcgtacccacaatgattacgcctacagcgtaaccgccagtgtcgaaatttgccgttttgatcagcatactcgctatctgtgcgtactgcccgcggcacataacttccctctcagctcccccggcgcactcggtgttttctgggcgggtggctgcgttgtcctcagtcaagatgcgtcaccccaacacgcgtttaaattgatagaacagcataaaattactgttaccgcgttggtgccgcctttagcactactctggatggatcacgcagaaaaaagcacctacgatctctcctcattgcactttgtgcaagtaggcggggcaaaatttagtgaagcggccgcaaggcgtctgccgaaagcgctaggctgccaattgcaacaagtgtttggaatggcagaaggcttggtcaattacactcgtttggatgacagtgcggaactgattgctacaactcaaggtcggcctatctccgctcacgatcaattactggtggttgatgagcagggtcaacctgtcgccagcggagaagaagggtatctgttaacccaaggtccctatacgattcgcggttactatcgagctgatcagcacaatcaacgagcgttcaatgcacaaggtttttacatcaccggcgataaagtcaaactcagtagcgaaggttacgtgattgtcaccggaagggccaaagatcagatcaatcgtggaggggaaaagattgccgccgaagaggtggaaaatcagcttttacatcatccagcagtgcatgatgccgctttaattgccatcagtgacgaatacctaggagagcgcagttgcgcggtgatcgtactcaaacccgagcagtcggtgaataccatccagctcaaacgttttttacaccaagcggggctcgccgattacaaaatcccagatcaaatccaatttatcgatcaactgcccaaaacatcggttggaaaaatcgataagaacgcgcttcgtcgtcgatttgacacgctcggcttagcgttaatgtcgtgaaatcaatgtaaagacaatgagtgagtagagggaatccttgaataagcggttcccttcctacttagaatccgtgtgttaagcaggaagggaactcgttcaatcacgcagagcaaggttgatgtaaattggcttgaatggtctgccaccactgctgcaaagtgacatgctccatcagttgagcaaagctaatatcagcaccttgggctttccatttttccaacaactgaatcgcacgaatcgaatctaaaccgagaaacaggaggttctcctgcacatccacttcatccacactcagattgagcgcagcggccacatcgtgttgcatggttcgcaagcttaagccagtaagctttgagtgttgggcggcaatctctaaacacgcttgttgagtggatttgaccgcaccagtacgaccactgatataacgcagactgaattcgtgatcactgagcgagaaatctgccacgccatccccaatcacaaaaggctgaatatcgaacataaaggcatccaacgcagtcgagagaatgccaatgtgcgcatagacacccgtaatgattaactgatcccgccctgtttcacgcagccaatccaataacggcgactttttaaacgcgctataacgccatttggtgagctgaacatcacctgattctggagcaagaggcgcaatgatcgccgtctcttcactcaaaccgggcccccaaaaatcgctcaatagtgctcgctcggcaggatcttgattcgcgggttgagccgtatagaccacagggatccccgcttgcttggcatgagctttaagctgttgtatatgcttgattaaacttgggatgggttctgcctgcgagtcaaaatagtgtacaaagtactcctgcatatcatggataagcagtaccgcccgcgatgcatcaatgcgccaatcgactttattagtcggtaatgatacgggtaaagggtaagaagcgattttaggaatagccatgaaagtacatcatccttattgatactcagccaactgagcgttgttagtgttgttatgtcatcgcacgacgcagcagaagcagccattcggccgaatcttctgccgatcaataatgcaacgatgctaacaacatcactcatggatgtaaataataacaattatcatttaatccaatttcacttcatggcggcgcttctcattgctcataagcaccaaacgttgtgagcttccctctcctcactccgttgaaaatcgcccataaaaaagggctagccgatggctaaccctttacatgttcccaaatgtttgacttatgcagcaagctcttgcgctttcactggctgcacacgtttttcgccgattggcagaacaacacggccgtattcattattgagtacttgtgccatagcgaagtagatagcgctcgcgccacagaagatgccttcaaaacctgcgatagtaccaatcagctcgctaccagtgaaatcacgagcagccagcagagcaaacaagatggtcagagaaccaaataccacttgtttcgccgttgggtagcacagagaaccaatgaacataaagccagtgaaaatgccccacagagccaagtaccaccccatgaaaggcgcagggcttgcaggcagtcccatgtgtggcattacgatcaaaccaaccagcgtcagccagaacagaccgtaagaagtaaatgccgttgtaccgaaggtgtcaccacgtttaaagcacatgatgccgacgataacttgactcagaccgccgtaaaaaatacccatcgccagaatcattgagtcgattgggaaaaaacctgcgttatggatattaagcagaatggtggtcataccgaaacccatcagaccgagtggtgctgggttggctagcttagttgacatgtgaacttaccttcagagtgtgaattcaaaaatgtttgtaaaaattacgcgcggattttaattaacaggcagataaaagaaaaaagatcttattggaaacttagattgttgaaacagttagttacagatgcgagtaaaaaatcgcccaacctaagttgagcgatgaaataaacacttttaatacaacaacttagcaggacaccttatcccagaaccagttagattgagtaggtgactcccaaacgcctggactgttcttagcaataaagcattggccgttataggtcactttatcgccgttcgagaccttagtgactccaggttgccacacaatggcatccgtaggggctggctctgtcggcggcactggtgttggctccgatggtggtacaggttcagtgggaggtactggctcgcttggcgttggctcagttggtggtgttggctcaccagaaactaacgcccaaggcccgcctttagaaggttcatcaccttgtgtccaccatttagcttggtaaaccgcacctttataactgaccttgtcacctgagttataaaccttacccacttcccacgcaggggcaccacctacaggtggatctgtcggatcggtaggtaatggatcaagtttttccactacacgaacttttggccagctcgcatgtgaaccatacagattagtcacacacttctcataatccccttccaccaaagcagaatacgcggtttggaaccccaccaactcacattcaaatgagtagccacccggacgatctggataatatttccagttaccatcccagtttgtgtaaagcacatcggtcgcaccattgaggttaaggctgccgtaaggcagttgctgccagcaggtattcttctcatcagcttcaatagggatttgataatgcgccgctaagccttcccaataacgaatacggttaaccggctgccctttatctttgttttgctccccgcactcaataccaccattgatgatattgatcgtggtgccgaaaccgtaaccaatccctgcatcaatttcacgctgtgaaggcacccaagtacgatcaatcacatgcaacatggcaggttttggtgcttgtggcgtgaggaagaaccagattgcagacgcaaggttcaaccacgaatcagccactaaaccggggttgttcaacaatactgttgcatcaccatcaaacatagcctcggagaaagcgccgtagttaaagtggtaagaaagctgttttgctccacggccaaagtaaccttgcccagtagcacaaggccacttcttgttctgccagtcattttgaccacaccccgtggtataaccttcttgaccttcagaccagcccatttcacgcacatgcaccagcgcttgttgccactcttccagcgctaatgggttatcagaaatgttgtccttcgcgatgtgtccaccagtttcctgagcaaagtgagcaaaagcggtcacgatcgattttttacaaatcgcgtcagaattgcggccatcggtatactcggcacaaaatgccgggaatttgccaatcgcacgcaagaaacgggtataagtgtattcaggtgccgccatgtgagtgaggaaattccactcagactcaggaaatacgcgttcaacccgtttcacgttatcagggtttgtcgccagtcccggctcgatcgcatcaacaatcgcattggcgcgggtcgctaaggcatttgaccaaatggcatacataggattggcggttttggcttgttctgctgcggcaatatccgctttagccaccaaatatccaccaggattttgtggatcaggctgaatattcatcgccgcttgcgcaggcaatgcacacgccatggccacccaccatgcggtatgtttgagtttaaacatggataaaagtccctctctcaacttggaaatccatttgagagtaggcttattgataactaatttaatagtgaaaaataagaaaaaagccagaattgcgagccatttccagccgatgtaaatcgtacgcttgcggtctacatcaagactttgaacggaaatacaaaaacaacagattctcttgtaaaagaaaaaacctcaggctatgcctgaggttttatatgattaatccggaatattcatccgcattattaagtagttattcccactcaatggtcgctggtggcttacctgagatgtcatacactacgcgagaaatgccattcacttcgttgataatgcggttggaaaccttacccaagaactcataaggtagatgtgcccaatgtgcggtcataaagtcgatggtttcgactgcgcgcaatgacacaacccaatcgtacttacggccatcgcccatgacaccaactgaacgcactggcaagaacacagtaaaggcttgagaaactttgttgtacagatccgctgcgtgcagctcttcaataaagattgcatctgcacgacgcaataaatcacagtactctttcttcacttcacccagtacacgcacaccaaggcctgggcctgggaatgggtggcggtaaagcatgttgtaaggtaaaccaagctcaaggccaatcttgcgcacttcatctttaaacagttcacgcagtggctcaaccaagcccattttcatgtcatcaggtaaaccgcccacgttgtggtgcgatttgatcacatgcgctttaccggtttttgaagcggcagattcaatcacatctggatagatggtgccttgcgccaaccattttgcgttgctgagttttttcgattcttcatcaaatacttcaacaaacacacggccgatggttttgcgttttgcttcaggctcatcaatgccttctagcgcttttaggaagcgctcttctgcatcgactttaatgatgttgaggccaaatttatcaccaaacatctccatcacttgctcgccttcgtttaaacgaagtagtccgttgtccacgaacacacaagtgagcttacttccaatcgcacggtgaaccagcatggcaaccacagaagaatcgacaccgcccgacaggccaaggatcacttcatcgttacccacttgttctttgatgcgagcaaccgcatcttcgatgatggattcagacgtccacagacgctcacagccacacacgcccagaacaaagttctccagcatctgtaaaccgtttttggtgtgtgtcacttcggggtggaactgcacgccgtagtatttcttctcttcattggccatcgcagcgtatgggcaggtatcggtctcaccgattttcacgaaatccgctgggatttcgaccactttgtcaccgtggctcatccaaacgtcttgcgtgagatcgagatctttaaatagcgccgattcgccagaaatttttacctgagcataaccaaattcacgctcatcagaagtcgcaacacggcctcctaactgctcagccatggtctgcatgccgtagcaaacaccaaagacaggcacaccactgtcaaacacatattgcggggcacgtggtgaattagcttcggtcacgctttcaggtccccccgaaagaataatgccgtcaggattgaattcgcgaatgtccgcctcttctacatcccagctccacagctcacagtacacaccgatctcgcgcacgcgacgggctactagctgggtatattgagatccgaaatcgaggatcagaattcgttggtcatgaatatttttagtcattgtttagcagtcttatcagccgagaattaatacgggggattcttcaacggaggcgagtctactcgcctcacattcactcatcaagcatttaagcaaacgtttacgcttaacccagacggtagtttggtgcttctttagtgatctgcacgtcatgtacgtgagactctttcatacccgcaccagaaatgcgtacaaattgagctttagtacgcagatcttctactgtggctgagccagtcagccccatacaagagcgtaggccgcccatttgttggtggataatctctttcagatggcctttataagcgatacggccttcgatgccttctggaaccagcttgtctgccgcgttatcggtttggaagtaacgatctgatgaaccttttgacatcgcacccagtgaacccattccacggtaggctttgtaagagcggccttggtaaaggatcacttcacctggggcttcttcagtaccagcaaacattgagccaaccataacgcaagaagcccccgccgcaatcgctttcgaaatgtcgccagagaaacgaataccgccatcagcaataacaggaataccgtactcgttagccacacccgctgcatcagcaatagcagtaatttgtggaacgcccacgcctgtgacaatgcgcgtggtacagattgagccaggaccgataccgactttcactgcgcttacgcccgcttcaataagtgcgcgtgcaccttcagctgtcgccacgttaccaccaatgatttcaaggtgtggataagctgcgcgagtttcgcgaatacgctgtaaaaccccttcggagtggccatgagaagagtcgatcagtagaacgtcaaccccggcttcaaccagagctttaacacgctcttcgttacccggtgctgcaccgacagcggcaccaacacgcagacggccttgctcatctttacacgcatttggcttgctttcggctttgtggaaatctttcgcggtgatcatgcctttgagttggaactcatcattcaccaccagaattttttcaacacgcgctttgtgcattttttcttgcacttctgcacccgttgcaccttctttgactgtcgcgaggcgctcttttggcgtcatcacagcagccacagatttggtgagatcagtaacgaagcgaacgtcacggccagtgattataccaaccagttcattgttttcagtgacaacagggaaacccgcaaaaccgtggtaatgggtaagttccataacatcagcaatggtttgttctggacggacagtgacagggtgagtcaccacacccgcttcaaagattttcacttggtgaacttgagccgcttgctgttcaatcgacatattcttgtgaataaagccaatgccgccttcttgagccagagcgatcgcaagacgtgcttccgtaacagtatccatagacgcagaaaccatagggatgttcagcgcaatatttttggttaaccgagtgcgaagatcggcagtgtttggaagaacggtggaatgagcagggacgagtaaaacatcgtcaaaggttagagcttcttttgcgattcgtagcatgtgcaatatctcacaacaggagtgttaacaacggaaatccacttcatcgtttcgcgtaacaaagggatttatatttgatattgcggacggattatacgcccgaggcaatcggttgactacacattttttcattttttatttgcatttcaccccttgatatgtattatattgcggctaatttccatacccacgtctgaggaatcagcgttgtcttcttctctcgccaatcgaaatatctacaccgtttcccgtttaaattctgaagttcgtttattactggaaaatgaaatggggatcgtctggttggtgggtgaaatttccaacttctccgctcccgtctctggtcactggtatctcactttaaaagacagccaagcgcaggttaaatgcgctatgttcaaaggcaataaccgtctggtgaatttcaaaccgcaaaatggtcagcaagtattagttaaagctcgactttctctttacgaaccgcgcggtgactaccaaattattcttgaaagcatgcaaccggaaggggatggccgtctgcagcagcagtttgaacaactgaagatgcagctcgccgccgaaggtttgtttgctcagacacgtaaaaaaccattgccggaaaatccacgctgcgtggggattatcacctcacggactggcgcggctttgcacgatattttgcacgtgcttaagcgccgtgacccgaatctgcctgtagtgatctaccccactctcgtacaaggtgaagaggcagctattcaaatcgcccaagcgattggtcgtgcgaatacacgcgccgagtgcgatgtgttgatagtaggtcgtggtggtggctctttggaagatttgtggtgttttaaccatgaaatcgtggcacgtactatcgctgcgagtgaaatcccaattatcagtgctgtaggccatgaaatcgatgtgacgatcgctgactttgtcgccgatgtgcgtgcccctaccccatcagcagcggcggaattggtcagccgtgatcatcgccataaacagcaagcactccatcaatggcaagccaaactggctagcaccatgcgccattatttggcgcagcaagagacgcaatttgcccgtttacagcacaagcttgataaacagcatcctcaagctcgtttagagcgccagcagcagcaacttgatgagctcagcctgcgtcttgagcaaaagatgcagcaacgtctggcaactcagcagcaacgctgggatcgcttaagccataagatcgagctccattcgcccattcacttgatccgccagcagcgttttaatctgatccagcaagagcagcgaataaatcagtcgatccaacgctatttgatccaatcacgccatcaactcgctttgttgagtgaaaagttggatgcggtcagccctcttgcaaccttagcccgtggctattcggtgacacgtaccacacaaggtgagttagtgcgccaaagcgcgcaagtgaaaccgggtgacactttagtcacccagttaatggatggtgagattctctctactgtgaattcccgttaagcggttggaagacaaaacggattttggatttcgatttcagctcattacactgattacagaaataattcgccgcaccacaagcctgtagcttttctaattcactgccacactcagggcaaaatccgactttacagtaatctaccgtacaagcgctgcagtggtactgacctgtccattctaattcttggccacatgttggacatgggttgtccatagcactctccttatcattttgcgttgtatcacataattcatcgagatgggatccgacgccatgatctttatcacgcctactcagatcgatgcgacttaattaaccaataactgatactcttttaagcaggatcctaaccggatcttctgctcaaaaggttttgatcagcgatctgccatgaaaagaacttttatataaccacccaccgaaagcataagttacatattctgtatttcaattttaaaaagaataaaaatctaaaaacaaaaccatttaagacttaagacagaatatagtgaaaagatcactcagattctgagggctgcgcgcaagtgactgcctcaatatgctgttcatcgacttgtttcagtgtcacttggatcgactgaaaggcggttaaacccttgcagtgtgtgcctccacaaggaattcgtgcgatattggcttcatgtaagtcacattcccaataacgtgaatcggtcaaggttgagcccgtgcactcaagacgaattgggctggctaaagctagccactgcgcaagctgttcattagtcttttgttctataaaacttaaatctctcagcacatcatcactatttaaacctcgcttacgcagtgttttccccaaacgatagacatcggttgaacaatcaggagtaacatcacttgagatttgggcatagctgttgaagtcaaaataaccctgcgggtctttacgctctgcatctttacgccaatacccctgtgctaagactttattgagcgctaaataacctaaatgccctgcgctatgacctcggcttaaacttgcttgatattgggtatcgacttgcaactgaaccttatcgcccacttggcatgcggctatgacttcgccaagacgatgaacgaccacaaagagccagccgctctcttcacgttttacggggatattatttccaacgtacaaatgacccgaggcttgttcaatcgcccccacgacacagtcagtgacggcatactcactaccttgccaaattaagattccacggtcagcaggatgatcgggccaaatatgactgacagggtgaaaaggcgtactgtaggtgacaatatccattccattttgatgagtctgaagcaacatcacttgagtctctagtgatgtaattccttgtggaaaggtgacttctgttgcgcaataggtcatgcatctctctccttcagagacaaaaaagcccaagtaaacttgggctttataaattattttctgcggtttttcaccatgctcatcaatcgcttacgttgtcgctcttgtgagagggtcattttattcgtcttaccttcaaatgggttttcgctattttggaactggatacgaattggtgtacccatgatttctagcgatttacggtaatagttcatcaaataacgtttgtatgaatctggcagctcgttgacttggttaccgtggataacgatgatcggtgggttgtaaccacccgcgtgtgcatatttcagtttcacacgacgcccacgcaccataggcggctggtgatcatcggtggccattttcataatacgagtcagtacagacgttcccacacgcgtggttgcagagcgatacgcttcttgcaccgattcaaacaagtgaccgacacctgtgccatgcagtgcagaaataaagtggatgcgtgcaaaatcaacgaaacccagtcgacggtctagctctttcttcacgtgttctttgacgtcaaaactcagaccatcccacttattcaccgcaattacaatggagcggccagaatttagggcaaaaccaagtaggctaagatcttgatctgagatgttctcacgcgcgtcgaccaccaacaataccacgttagcatcttcaatcgcttgtaaggttttgactaccgagaacttctcaacggtttcattgatacgcttacggcgacgcacgcccgcagtatcaatcaacacatattcacgctcatcacgtttcattgggatgtagatagagtcacgcgtggttcccggcatatcgtaaaccacgactcgctcttcacccagaatgcggttagtcagtgttgatttacccacgtttggacgaccgatgatcgcgagtttaatcggcaagtcttgcaggcgcttgtattcggcttccgcttcttcttcgctgtactctaactgctcttcttctggatcttcttcgttggtcagatcttcaagttgagcttgctcagattccatttgctcagcaaacggattcagcacacggtcaatcaatgcgcccacaccacggccatgcgcggcggcgatctggtacatctgatccataccgagttgccagaactccgccgaagcggcatccgcatcgataccatccactttgttcacaaccaaaattgctggcttttcaatacggcgcagatgctgagcaatcgcttcatctgcaaccgtcagacccgcgcggccatccaccataaacagcaccacatcagcttcgtcaatcgcagcgagcgattgctgtgccattttggtctcaacgccttcttcagagccatcgataccgccggtatcgatcacgataaattcgtgctcacccaacttagcttgaccgtatttgcgatcacgcgttaagccgggaaaatccgcgactaatgcgtcccgtgtgcgagtgagtcgattaaacagcgtcgatttaccgacgtttggacgcccaacaagagcaacaacaggtaccataacaacctctacaaactttcatttatgtagttataggtaaacactctgtcacaagcgctaaatttttacctataaccactttcattatcatcattatgatggtcagtttctctccatcaatctgatgccactggcaataaaacggctcctaactgtttccagccaggagccgcgtgtgaatcatatcacaatttactgttgaatcgtcagcttctttatctggccattacgagtcacgatgacgtaaccgtcattcagcgcgagcggacccactgcaaagccgctgtcattaaccagttgctgggcaataaattccccgctattgcgatcaatccagtgcagataaccttccgcgtcaccgaccaccaaataatcatcaatcatttttggcgcagtgagcaaacgatgctctaactgagtattactccaaagctcggtaccgctgcgggtatcgaccgctaccagatgatctttatcggtaaccagataaagacggctaccatccgtcgccatgtcggtggctgacgagtaattgcgtttccagattggctggcctgaacgtaaatcgatcgcgatcaattgcccgttaaatccaaccgtaaacaacgtgccaccgatgaccaatggggaggcatccacatcgacaaggcgatcaatctcggttgcaccttttggctgaccgacaggttgctgccaaatcagttgaccacgttcagcaattgccgcagccagacgaccacttggggttccccagaatacaccacccgcaaccgctgttggacggctatcaccgcgcagcgtcaggttaggcacttccgtactgatcgtccatttctgcgccccatcttcttggttaagcgcaatcagagcaccacggctggtgttcacgataacgatgttgttatctgccgcgggggcggctaacacttcaccttcaatcgctgaagcccatagcggttcgccggtctctgcgtctaaagcattgactacgccattttcgctaccaatgaataatttaccaaacgctgcggtaataccaccggacaagcgtgccgagccttcaatctcaagatccgtggtccaaatcactttaccgttttgcggatcaagtgcttttactaccccatctcgactcgccacgaagactttgtcgtaagcataatcaggagccagttttgagaaatagtgcccaacaccatcgcccaccgaagcgctccacagcgttttcggcgtaaattcgcttttgacgataggcaacggcgccataatgacgttttcttcttcactagcacaacccgcgagcagagctaacacacccgcagcgaccagcacttgattgaacagcttcttcatcagggagtgcccttacttcgcgagatcatccagtttcatttgcagagtttggctagcatcctctgcctgttgcgcttcggtataagcggcataagcagctgcactatcccctttacgcatcaagatatcaccgcgcagctctgccactcggccagcccaagatttctcttgaatgctggttagctgagttaatgcgtcatcaaattggccttgctcagcctgtaagcgagcaacacggaatgtcagcaaaggtttcagtgcagcatccttggttgctccttttgcccactccaattgcgctaacgcttcatccagttgacccgcgtccacttgagctttggctaactgcattgcagccaaaactgcgtattcggtctctttattggcatcaataaaagtttggatagtgccttctgattcaatgccttttgcctgcagtgcatccatcgctttgctgtagctttgcgatgctgcttcttgcgcagcaaccacagagtcttgatagtagcgccagccaaataggccaccaagaccaattaccgcgccaaagatcaccgctttgccgttctctttccaccaatctttgatcgcttcaacttgttgttcttcagtatcgtagagttccacttcctgtcctcttatttaaaacgtgctgcaggagaattaggctaaatgtgccagtagtttagctacttcagcttgggcaacagtattttgctcgcctcccgccaaatcttttaccacaacggtttgggctgcaacttcatcttcacccaaaaccaaggcaatcgctgcgcccactttatccgcgcgtttaaattgctttttaaaattgccgccaccgaagtgagtcatcacacgtaggccgggcacttgctcacgtaactgttccgcaagcttcattcccgccatcatggtgccttcacctgcagtaaccatatacacatctacgctgcgacggacatccgtattaccgagtgtttccatcatcagcactaaacgctctaggcccatagcgaaacctaccgcaggggttggtttaccgcccagttgttcaaccaagccatcatagcggccgccgccacaaacggtaccttgcgatcccagactttcggtgatccactcaaaaaccgtgcggttgtaataatcaaggccgcgaactaaacgttgatttaccgtgtattcgatacccgccgcatccagaagttcacacaagcccgcaaaatgttgttttgattcagcatcgagataatcagagagctgaggggcatcacctaaaatcgcttgtacatcaggattcttcgaatcaagcacacgcagcgggttggtgtacatgcggcgcttgcaatcttcatccagtacgttttggtactgctcaagatagtcaatcaaggcggtgcgataattagcgcgagcctctagagagccaatcgagttgagctctaaacgcacatgttgtgcaatacccaattcgcgccacagacgtgccgtcatcatgatcagttcagcgtccacatcggggccatctaaaccaaacacttcaacaccacactgatggaattgacggtaacgacctttttgcggacgttcgtgacggaacatcggtcccatgtaccacaaacgttgctcttggttgtacagcaaaccattttcgataccagagcgcacacagcccgccgtaccttcaggtcgcagcgttaagctatcaccattgcgatcttcaaaggtgtacatctctttttccaccacatcggtcacttcaccgatggcgcggctaaatagatgagtcatctcaacgattggcatacgaacttcgctgtaaccgtaagcgctgattacatttttcaccacgccttccactttttgccaaagtggagactgggttgggagacaatcgttcatgcctcggattgcttgaatagtttttgccacaattcttaccgttatatcgttgagattaatcttgttctacgtgcttgatatcgatgcgatttttttcatccaatcgcgcggctttagcgcgaattttcgcttccagttgagcgacgagatcatcgttatcaaatcgctctttctggcgcacgccatcttcatagaacgcacttttcttattactgcccgctaagcctaagtgagacacctcagcttcaccgggaccgtttaccacacagccaatgattgatacatccattggtgtcagcacgtcttctagacgctgctcaagggcattcacggtgccaatcacatcaaactcctgacgtgaacagcttgggcatgcaataaagttaatgccacgcgaacgaatgcgcagcgattttaaaatatcaaaaccaactttgatttcttctaccggatcggccgccagcgaaatacgcagcgtatcgccaataccttccgcaagcagcatacctaggcctacggctgacttcactgaaccagcacgcgcgccccccgcttcagtaatgccaagatgcaaaggctgatcaatctttttcgccagcagtcgataggagtctaccgcaaggaaaacatcggaggcttttacgctgactttgaactgatcaaagttgaggcgatctaaaatatccacatgacgcatcgccgattccactaaggcttctggcgtcggttcaccgtatttcagttgcagatctttttctagcgagccgccattgaccccgattcgaatcggaatgcctttgtcgcgcgcacaatccacaaccgaacgaatccgcgcttcgttaccgatattgcccgggttgatgcgtagacaatccacaccgtattccgccacttttagcgcaatacgataatcgaagtggatatcggccactaaaggcacagagacttgttgtttgatcagtttgaacgcttcggcagcttccatagtcggaaccgaaacacgcacaatgtccgcccccactttttccaaagacttgatctgcgcaaccgtggcagccacgtcagtggttcgggtgttggtcattgactgtacggcgatgggcgcaccatcaccaataggaacgtcgcccacatagatacgtgtcgaggggcgacgtttgataggagactcatgttgcatagacatttttctaaggtaaggtcaatcttgctactttgccggaagtatacccagaaaggtcgacgggttcactcgctaatgtgattgaaaccccttctggtgcacccaacaccaatttataagggcgctggccactcaaactcacactctgccctgcttttttcacacccgttgacagtgttttgcccgtggcatctttgacttgaatccagcaatcggcagaaaaattcatcaccagcagtgcggaagcactctcagtggaagagcttacaggttgactaggtgcactaggcgccgcttcaggttgagtcacaggcgcagccgccactggagcttgagactgaactggagtttgtccttgaggctgagcaggtgctactggtgccgccgccgtttcttcaaccacaggtttatctgtcaccacatcagcttcattcggtgctggcggagtcaattcactggcctcaccagaaagagactcttggctcatcggtgcctcttcactggctggcgccgcatcttgtagctcattgagtggaggaacggttgcgaagtcttcattggcaagactggcgtcattgctagactgaatatccgaaatagcactcggcgcaatggttgttttatccgggattaagctgttcttctggctattttgccaccaccacaaggtcgacatgccgacgataaccgctaagatcacccaagtgatcagcatgattcggctgtcgtgcaactgacgcttggtctttttcgagaagcttttcatatccggctgaacttctggcttttggcaatagctgtcatcaaaagcacacaagatctcagattcacgaatacccaccgctttggcatacgaacgcaaataaccgcgagtaaaagtggcgacttgaccatcttcaaaacggttctcttcaatgctttggataatagaaaggcgtaatctgaggcggtcagcgatttggcgctgagtcagccccaaatcttcacgtttttgcttgagtaaagtgccgggagcaactttctcgatggcaggttgatttacttgctcggtcgtctcagtttggttgtaatcttgctgttcagtattcatccgtaatttcaatctcttagtcaggactaagccgctgggccattcacttttatttttgattataggtagtaatggaacaacttggcttaatcggtgcaatcggttagcgcgtcgcttgggtatagctcaaatcaagtttgagaaatttgcctcattctaatagatattgttgactaaacaataaagaaatggccaataaatcacagttagctcaaggtttttctttgatttgacatttaaacgcagtgatttgttgccatattaggcaaaaataaagccagagaaacatctctggcttatcttataacatcaattacagtgttttcactggaatcgcttgtccatcaaattgtttagctttggttcgtttagtgcgatcaatgacatctcccaccaactgcccacatgccgcatcaatgtcatcaccacgagttttacgaatggtgacggtatgctcatattgcatcaaggttttctggaaacggtcgatgcgtgaattacttggcttcttgtagggtgagcccggataagggttaaacgggatcaggttaattttacaaggcgtccctttcagtaattccgccaactcgtgagcatgctctgtaccatcgttcacatgatccagcagcacatactcaacggtcaccttaccgcggttagcatttgaggatgcaatatagcgacgcaccacctctaaaaacgcttcgatattccagcgatcgttgatcggcatgatttcgctacgcagcttgtcattcggcgcatgcaatgagatagccaaagccacatcgatttggccaatcatctgctctaaaccagaaaccacaccagaggtagaaacggtcacacggcgcttagaaagaccaaaaccgagatcatcgagcatgatctctaacgctgggatgaggtttttcatgttgagcaaaggctcacccatgcccatcatcaccacgttagtgataggacgacgcccagtttctttctctagaccgatttcacgtgccgcacgccaaacctgaccaatgatttctgaaacgcgtaggttacggttaaaaccttgctgcgccgttgagcagaatttgcattccaacgcacaccctacttgggaagatacacataaggtcgcgcgatcatcttcgggaatgtaaaccgtttctacatcctgatcacccacacgcattgcccacttgatggtgccatccgccgagtgttgcgcttccgagacataaggtgcacggatctcacacttggctttgagcttttcacgcagctgcttgttgatgttattcatttgatcgaagtcatcacaaccaaagtgataaatccacttcatgacctgctcggcacgaaacgctttctcacccagttcttcggcaaaaaacgtgcgcaaacccttgcggtcaaaatcgagtagattgattttttctgtggtcatggtgcctctcaagaagacggaacagtaattaagggcgcgaattgtacagcctttattcagcaacaacaagggctgcaaaaccgcgtcttttctaaggtgttaattcaagacaggttatgttttgtgcaaaatttaggctccacactgggagcctaattaatctgtcttaaagactatggacgagggcagatttctgattctggaaagaagaattcaatttcacgagcggctgatgcaggactgtcgctaccgtgtactgagttgtaacgcatgctcagtgcataatcggcacgcagagtaccgcaggcggcttcttctgggttagttttccccatcaattcacggtaacgtgcaattgcgttttcaccctctaagacctgcaccatgatcgggcctgaggtcataaattctttcagcggttcaaaaaacggtttgccttcatgctcagcgtaaaagccactggcttgctcttccgacaggtgaaccattttcgcggcaatgatctgcaagccggctttttcaatacggtggtaaatctcaccaatcaagttacgcttcaccgcatccggcttaatgatcgaaaatgttctttctagagccataaaatttccttttgtttattgtgcttatgttatacccaagcgacttggcgtcacaggtagtcggcaaggaggttcacctccatcagcatagacacactatgtgattaggatgaacgaacagagccaacaccgctgcagcgtcaaattggaagggtatactcttattaataaaaacaaggcagctatacaagctgcctttatatttatgcttgctgcatcaaaatacgtgcgagcattttcacgcccatgcccgtggctcctgcagcccatttatcgctggctgacttgcgatacgtggctgaacaatcgaagtgtaaccaacctttttggtagccttccacgaaataagaaaggaaggccgctgcggtgctggctcccggcgtgtaatcgccgttactgatgtttgacagatccgcaaagttagaaggcagcatttcacggtggaactcagctaaaggcagagcccacagcgcttcattctcttcttttgccgcagctaatgcttgttggctcagcgactcatcataagaaagcagtgcgtggtaatcattacccagcgcgtttttcgccgctccggttaaggttgcacagtcgataatcaattgcggtttctgttcactggcgtagataagaccatcggccagcaccaaacggccttccgcatcggtgttcatgatttcaacggttttgccatttttgtaggtgatgatgtcaccaagcttcaacgcacggccggaaaccatgttttccgcgcagcatagaatgagtttcacgcgcttgttgaagccacgcatgatagccaaaccgagcgcaccagtgatcatgcctgagccgcccatgtccgctttcatagctgacatcatgttagaaggttttaagctgtaaccacccgagtcaaaagtgatgcctttaccgactaaacacgcgaataccggtgcattttcatcgcccgttgggttgtagtcgagttgcagcatcgccgacgtacgctcagagccacggcctacagcgtaaatcccctcccacccttcagtgagcagatctttgtctttgacgatacggtaagaaacatggtcaggcgcaagcgatttgatgaactctgctgccatggtcgccaattggcgtggtgcaacttcttccgcgcttttgttgatgatatcgcgtgtccaatccgtcgctttaatgcgcgcttctagctctacttgttcagcagccgctaaagctttccactcgacggtattgcgctttttcgcatcacggtaaccttgatagaaagcccaaatgctctccagatcccaaccttctccagccaggaatgccgtgcggataccttgattatctaacttacgagctgcgcgttggatcgcgctgaaatcttgtgtttgttgcaggtgaatggttgcaccttgctctgcaaaagaaatgagcgctttctctccccactgaggctgggcagcttgagtactcaaaaatacagacatctgtgtagacatggtttctccttgtcttaaatattggctttgcctgtgccatctcattaaatcgccaagatgttagcattatgtcgaggcaaaatgtcaaccgaataaaaaaacggaccaagtggtccgcattttttgctaagaagtgttaactctgtggggtttctccccctgctaaacaaagcaagcgccatattgattgactcctcacttcattttgcatgagatgaattactcgaattcatccatccaacacagaatgacggcttcaaggattttttcgttggaatgattcggatcatcttcaaaatcttccaactccatgatccaacgatgcagatcggtaaaacgtacggttttgggatcgacatcgggaaacttgtcacacagctcaatcgcgatatcgcgtgaatctgtccatttcatggttagccttcctattggttttacctcggcagcgaccgaggctaagaattaatgatcttcgcttgcgtggtttagcgtgtatttcgggatctcgacaacgagatcttcatccgccactcgagcctgacagctgagacgagattctggctccaggccccaagctttatccagcatatcgtcttccagctcatcactctcttccagtgaatcaaacccttctcgaacgatacagtggcaagtagtacaagcgcacgatttctcacacgcatgctcaatagcgataccgtttttgagtgccacatcaagaatcgtttccccggtttgcgcttctaacactgcgccttccgggcaaagggtttcatgaggcaaaacaataatctttggcatgttggtaatctcttcaaatctcgtcaacggagtggccagccagtgcgctacgaatcgatttatccattcgtcttgacgcaaaatcctgactcgctttgtctgtgtcttttataccttgctcaatggcatccgcattatcgccattgcgcagttcaatcaaacgctcgatcgcctgtaataaagtttggcgctcttgctcgttcagcagctcatcaccatccgcttgcagggctgaaactaagccttcaatcacgcgatcggcttctacgcgctgctctgccaacgcacgcgccagcatatcctctttagcataggccatggagtctttgagcatctgggtgacttcgtcatcgcttaaaccataagatggcttaacctgaatctctgcttgtacaccggtgcttttttccaaagccgtcacggaaagtaaaccatccgcatccacttgataagtcacgcgaatgtgcgcagcacctgccgccatcggcggtatacctttgagtgagaagcgtgcaagagagcgacagtcatcgaccatttcacgctccccttgtaccacatgcacactcatcgccgtttgcccatctttgaaggtggtaaactcttgcgcgcgagcaacaggaatggtggtgttgcgtgggatgattttttcgaccaaaccgcccatggtttcaatccccaaagagagtgggatgacatcgagcagcaacatttctgcatcaggcttattgccggccagaatgtccgcttgaatcgccgcaccaatcgccacaacttcgtctgggttgatgctggtcagtggtgtgcggccaaaaaactcccccacttgctcgcgcacaaacggtgtgcgggttgaaccgcccaccatcacgacttcgagcacttcatccgcttcaacaccggcatctttcaatgcgcggcggcaagaaagtagcgtctttttcaacaatggtgcaattaggttttccaactcttcacgagtaagcgaaccttgccagccaagcacattcagctcagccgtcatgtattcagtcagatcgattttggcttgtgtcgcggcgttaatcagcgcgcgctgctgctcagcggttaaactggtgagtccgatttgtgcttgcaggtgatcggcgatcagatggtcaaaatcatcaccacccagtgcagagtcaccaccggttgcgagcacttcaaacacgccgcgtgaaaggcgtaaaatcgaaatatcgaaggtgccgccacctagatcgtacaccgcgatcacaccttcttggcctgagtccaaaccataagcaatcgccgctgctgtcggctcattgagtaaacgcagcacatgcaagcccgctaacgccgcagcatctttagtcgcaacccgctgcgcatcatcaaaatacgcaggtaccgtgatgaccactcccgccaattcgccacctaaggtggcggtggcacgttctgccaaggctttcaaaatatcggcagagatttgaatagggtttttatccccttgcgcggtttgcacaatcggcaagcctttctcactcgctttaaagcggtaaggcagatgaggataacgctggttgatgtcttgcagtgaacgtccaagcagacgttttaccgaaatcacagtgttgtgcggatcggtttcagcttgttcacgagcgggatagccgacgcgagtcgcatcagcaccatagttcaccactgaggggagaatactacgcccttggctatcgacgagtgtgcttgcggttccgctgcgcacagaagcgaccagtgaattcgtggtgcctaaatcaatacccgcagccaacttatgctggtgtggtgccgaactttgccccggctctgcaatctgaagtaatgccatcagttgttcctttgaatcttgaattagccaagcagttggtcttcgactcgttctacttcatttttgagtttggcaataaatttgagctttctgatctgatcagccgccgctaaccactcactttgagctaattggccttgtagctgtgcgagataatgacgctgcatcgcggttaccttagtgtcaaaagcgactaaggcggcctctggatctgcacaagccgtcacggactctagctcttcgcgtagctccatctgttccatcagaaacatcggatcttgcagcgtctgctgctcagcgttcatctctatgccttgtaacgacaaaagatattccgcgcggcggagtggatctttcagtgtctgatacgcatcgttaatttgcgcggcttgctgcactgccattaggcggtcacgctcagaagcggtagcaaaattatccggatggaatcgtttctgcaacgctctgaactgagaagaaagaaggctaccatccagttcaaactggatcggcagcccaaataattcaaaataattcatcttgatagcggtcctgtgatcgagaacagtctcgatggtcagttaccgttaaacgttgaagctttcaccacaaccacattcgcttttgacatttgggttgttgaattcaaagccttcgtttaacccttcttttttgtaatcgagttgagtgccatctaaatagaccatgcttttggtgtcaatgatcaccttcacaccatggctttcaaatacgtggtcttcttcgttgagatcatcaacaaactcgagcacatacgccattcccgaacacccagttgtcttgacaccaagacgtaaaccgatgccttttccacgattatccagaaaagtttttactcggcttgctgcggtttcgctaagagtgacggccatacttcaaccttatgatttcaataaattaaagggtgggagcgctcgacgctcccaaacgaattagtgttgatgctttttcttgtagtccgcaacagcggctttgatggcatcttcggctaggattgagcagtgaattttcaccggtggcaattcgagctcttcggcgatttcactgttcttgatcgctgccgcttcatcaatgctcttgcctttcacccactcagtcactagcgagctagaagcaattgcgctaccacagccgtaagttttgaattttgcatcttcgatgatgccttctggtgatactttgatctgcaaacgcattacatcaccacacgcaggtgcgccaaccatgccgctacctacagaaggatcttctttatcaaatgaaccaacgttacgtgggttctcgtaatggtcaatgaccttttcgctgtatgccatgttcgttacctcgaatcctttataaccttggaatgattagtggtgtgcccactcaaccgtgttcagatctacgccgtctttgtacatgtcccaaagtggagacatcgcacgcagtttatccactgctacgcggatcagttcgatcgcataatcaatctctgcttcggtcgtgaaacgaccaaaagagaagcgaattgagctgtgtgccagttcatcgttaagacccagagcgcgcaatacgtaagaaggctcaaggctggctgaagtacatgcactgcctgacgatacagccagatctttcagtgccatcagcagagattcaccttctacaaacgcaaaactgacgttgagattgtgtggtacacgctgatccagatcaccgttaatggtcacggcttccatatctttaatgccatcaagcagacgattacgcagcttcagtgcgtgatcgtaatcttgctgcagctcttccttcgcgatacggaacgcttcacccatacccacaatttggtgagtcggcagagtaccagaacggaaaccacgttcatgaccaccaccgtgcatttgtgcttcaagacgaatacgtggtttacggcgaacatacaaagcaccaatacctttcgggccgtaagctttgtgcgcagaaagagaaatcagatcaaccttcatctcttggacatcaatagccactttacccgcggattgcgctgcatcaacatggaacaccactttacgtgaacggcacagttcgccgatcgctgcgatatcttgcaccacgccgatttcattgttcacgtgcatgatagaaaccaaaatagtgtcatcacgcatcgcggcttcaagcttagccagatcaaccaagccattgctttctggatcaagataagtcacttcaaagccttcacgctccaattggcgcatggtatccagtaccgctttgtgttcggttttgctggtgatgatgtgcttgccttgcttgttatagaagtgagcaacacctttgatcgcgaggttgtcagattcagtagcacccgaagtgaacacaatttcacgtgggtctgcattcagcagggctgcgatttgctcacgcgcagtgtctaccgcttcttctgcctgccagccataacggtgcgagcgcgaagctgggttaccgaaggtaccatccatcgtcatgtactgaaccattttttcagctacgcgcggatcaaccgggcatgtcgctgaataatctagataaataggcagtttcattttctactccagtgtaaaccttgccgctatgagcgaacattaataccaaaaggcgcagcaccaatggtgactgtgtttgagttgttttgcgaaaccctttggctgaccgcaagatgaagatcttgacgatctgaaacttcgagaacttcgttatccatcatcagctcaccgagcgtgatgttgttaagaaaatccgtaatgcgtgagctgagatcacgccacagtgtgtgagtcagacagcgagtcccgccctgacaatcccctttcccgttgcatttggtcgcatcgaccgattcatcaaccgcggcaatcacagtaccaatagaaatggcgtatgagtccattcctaagcgataaccgccgcccggaccgcgcacactggcgactaagcccgccttacgtaacttagaaaaaagctgctctaagtacgagagagaaatgccttggcgctcagaaatgtccgccaacggtactgggttttgttgcgaatgcagagccacatctaacatggctgttaccgcatatcttcctttagatgtcagtctcataatcacaccgtatccacactgtttatgtggctggaagttttccatacttgactcttttggtcaagtatttatttgactaatttagtcaggtatttaaccctgagacttataagcttattctttgcgtgagattgacttttgtactgacgttaagatcccacgcaagatattgatttcttgagcttctggccgagcgcgcgtaaacatgcggcgcagtttattcatcacctgccccggctgctgcgcagaaataaactcggtttgcattatcacttgttcaagatgggcataaaaacgctccaactcttgatgacgcggatactcttcctgcaatgtgctgctttgcgagctctgctgcaaagcaagataggccatccgcacttcataactcagcagttgaaccgccattgctaaattcagtgagctgtattctggattcgcaggcacgcatacgtggtagtgacacagttgcagctcatcattggtcaagccagtacgttcacgaccaaacaccatagccacactatgttggttggcttcgctgatgagtttttctccgcactcgcgtggctcaagcattggccattcaagggtgcgtgaacgcgcactggtgcccacgactaacccacaatcagcaacggcggcttccagcgttggataaatttgcgcattgagtgcaatttcacttgcccctgcggctaacgcgatcgcttgagcatcaacctgacactgcggatcgaccagcaccatctggctcagccccatgactttcatcgcccgagcggccgaaccaatatttccagagtgagttgtgccgaccaatacgactttcacgcgttctaacatcatttgctaaaatgtactccaaacaaagccgcgggatattaacacaaacctgaccaaaatggtcagaccctttaccttgacgaacaactaagcgcacaaaaaataaccacttccttttttgatttgttttggtatactgccgcccgctttttcgttctttaacatccgttgggaaactcgtatgcatccaatgctaaatatcgctattcgcgccgcgcgaaaagcaggtaaccatattgccaaatctctggaaaacgcagagaagattcaaactactcagaaaggcagcaacgactttgtgactaacgtcgacaaagaagcagaagcgattatcgtttcaaccatcaaaagctcttaccctgagcactgcatcattgcagaagaaggcggccttatcgaaggtaaagataaggaagtgcaatggatcatcgacccactggatggcaccactaactttgtaaaaggtttccctcactttgctgtttctattgcggtacgctttagaggcaagactgaagtcgcttgtgtttacgacccaatgactaacgaactgttcactgcccaacgtggtgcaggtgcacagctcaacaacgctcgtattcgcgttcagccaatcaaagatctgcaaggcgcagttttggccaccgcattcccattcaaacagaaacagcactcagaatctttcatgaagatcctctctgcaatgtttgttgaatgtgcagatttccgtcgtactgggtcagccgcactggatctgtgctacctagccgcaaaccgcgttgatggctactttgagcttggcctaaaaccttgggatatggctgcaggtgaactgattgctcgtgaagcgggtgccatcgtgactgactttgctggcggcaccgattacatgcaatcgggcaacatcgtggcatcaagcccacgtggtgtgaaagcgattctgcagcacatccgtgaaaacggtaacagcgcaattttgaaataatatctgctccgtcacagctgatatcgccctgccattatggcagggcttttttttgttctatcaaccgatcgcctactgcttcatgatcaatcaggtcatagctaaccaagcttgataaaaaaccgctgacttagcagcggttttttatttatcgatgaaagagatgcctacggcatttcatccaactctgcgccttctttctctacttgtggaggcaataagtgctcacgggtgatcccgagtttcagcgccagtgctgatgccacataaatagaagaataagtaccaacggtaatacccagcaacaaggccagcgcaaaaccgtggatcattgctccaccttgagtaaagagggcaatcaccacaaacaaagtggtacctgaagtgatcaaagtacggctcaaagtttgtgtaattgagctattcatgatctctgcgggttcttctttgcgcatcttacggaagttttcacggatccggtcaaacaccacaatggtatcgttaagtgagtaacccacaaccgtcagcaatgctgcaacaatcgtgagatcaacttcaatctgtaagatagagaagatgcctaaggtaatgatgacgtcgtgcgccaatgccagcaccgcacctgcagccaaacgccattcaaagcgtactgacacgtaaagcaagatacacagcaaagaaaccagaatcgccaagccgcccgcttcagtgagctcatcacccacgttcgggccaacgaattcgatacggcgcatttccacgttgccgccggtaccttctttgatcgccgcgaggatctggttacccaacgcctcacccgccatatcatcacgaggacgtagacgtaccatcacatcacgtgcagaaccaaagttttgcacggtagcatcaccaaaacctttcgcttcaagggcgctacggatttgctccagattggcaggctgttcaaagcccacttcaatcaaagtaccgcccgtgaaatccagcccccagttgagccacttggtagacagagtaaaaatcgatgcggcaatcatcaccagcgacaaggcgaaggcgaatttcgaccaacgcataaagtcgatcattttgtctgcttttaggatttgaaacataacttaccccagcctcagatcgacagtttgttgatacgtttgccgccatacagcaggttcacgatacaacgtgtacccacaatcgcggtaaacatagaggttaaaataccgatagacagcgtcactgcgaagcctttaatcgcccctgtaccaacggcaaacaaaatgatcgccgtaattaaggtggtgatgttggcatcggcaatggtactgaatgcgttagcgtaaccttgatgaatcgcttgctgcggattttttccttcgcgtagctcttcacgaatacgctcgaaaatcagtacgttggcatcgaccgccataccgaccgtcaacacgataccagcaatacccggcaaggtcatggttgcgcccgggatcatcgacattacgccaatgatcaacacgaggttcgccattagtgcgatgttagcaatcatgccaaacttacggtagtaaagaaccgtaaacagcattaccgccaccataccccaaatacaggcctgaatacccatatcgatattctgctgacccattgatggaccaatggtgcgctcttcgacgatagaaattggcgcaatcaaagcaccggcacgcaatagcagagcaaggttatgcgcttctgccggtgaatcaatcccagtaatacggaagttacgtcccaatgccgactgaatcgtcgcttggttaatcacttcttcatgcttggtcagaatgactttaccttcaggagagcgcttaccgctgtctttgtattcggcaaacaccgtcgccatcagcttgccaatgttctttttcgagaacgctgacatcttgttgccgccttcgctatcgagcgaaatgttcacctgtgggcgaccatattcgtcggcgcttgagcttgcatcggtaatgcttgaaccacccagaatcacgcgctttttcagcaccacaggacgaccattacgatcgaacttgatttcgctgccagcaggcgcacgtcctgctgccgcagcggcaaggtcggctttatcgtccacttcacgaaattcaagggttgcggtcgcgcctaagatttctttagcacgcgctgtatcttgtacacccggcagctctaccacgatacgtgtcgcaccttggcgttgaaccagaggctcagccacacccagttcgttcacccggttacgcaaaatagtgatgttctgctcaacggcgtagttgcgaatttcctgtaagcgagcttcggtaaacttagccacgagcacaaaacggccatcggattctgaagtcgtaaaggtcatatcacggtgtttcgactccagaagcagcttagtttgcgcaagctgctcggcatcacgcagggtcacttcaaccgcatccgataatggacggatcgcgcggtaacgaattttctcgtcacgcagatcactgcggaaagcttcttcttgttggctgaccaatttttccatcgcggcatccatatccacttccatcaggaagtgcacaccaccacgcagatcaaggccgagtttcattggtgcagcaccaattgactctagccaatatggcgttgaaggagcgaggtttaacgcgacgattttatccttacctaacgcttcactgatgatatctcgggcgctgatttgcgtatccgtatcattgaaacgaacaaggattgagccattttcaagagcaatggatttttgggagagttgcgctttattgagcgcatcggtgacagcatccagcgttgacatatcaacagaggcgccacgcgcccctgttatttggatagctggatcttcaccgtagatatttggaagtgcatacaaggctgcaacggcgatggttaacatcaccatcagatacttccataacggataacggtttagcacagcgaggatcctatggctgttttaaagagatttcagcgtaccttttggtagcactgcagtcacgaagtccttcttgatcacaacttcgttgttggtgttcaactcgattgtgatgtaagcgttatcttcagcaatcttagtgatacgacccactagaccaccagaggtcaacacttcgtcaccttttgccatcgcagccatcaggtttttgtgttctttgacacgcttagcttgtggacggtagatcatgaaatagaagatcactgcgaacatcgcgagcatgatgatcatttcaaaaccgacaccttgtggggcaccttcgcctgcggcatgtgctacagaaattaaactcattgagaaacgtcctctaagttattgttgtttaatgttgattctattgggatgcacaggggtgaattcaagcggcttaccacgcaaatccaacccagtgcacgaaatcaggctttgtctttttgtagtggtggcacttcgcggttacgacgcgcgtagaactcggctacaaattggtcaaaacggtcttcatcaatcgctttacgaatgctttccatcaagcgttggtagtaacgcaggttatggatagtattcaagcgtgcaccgaggatttcgttacagcgatccagatgatgcaggtatgacttcgaataatttttgcaagtgtaacagtcgcaatgaggatccagtggtgttgtatcggttttatgtgctgcattacggatcttgatcacaccacccgtcacaaataggtgaccgttacgtgcgttacgcgttggcatcacacagtcaaacatgtcgataccacgacgcacaccttccaccaagtcttccggtttaccgacgcccatcagataacgtggcttgtcttcaggtagttgtggacaggtatgttccagtacacgatgcatgtcttcttttggctcacccaccgcaagaccacccacagcataaccatcaaaaccgatttccgtcaggccttttaccgatacatcacgcaaatcttcatacacaccaccttgcacgataccaaacaagttgttcgggttttcgagcttatcgaagtggtcacgcgaacgttttgcccaacgcagagacatttccatcgattttttcgcttcatcgtgggtcgctgggtatggcgtacactcgtcaaaaatcatcacgatgtctgaacccaaatctttttggatttccatcgatttctcggcgtccataaaaattttgtcgccgtttactgggttgcggaaatgcacgccttcttcggtgatcttacggatatcgcctaagctgaatacctgaaaaccaccagagtcagtcaggataggaccttgccagttcatgaaatcgtgcaagtcaccgtgcattttcatcacttcttggccagggcgcagccagaggtggaaagtgttaccgagcagaatttgtgcgccggtctctttcacttcttcaggggtcatcccttttaccgtgccgtaagtacccacgggcataaacgcaggggtttgcactgtaccgcgttcaaaaatcaattgaccacgacgggcattaccgtttttctttttcagttcaaattttaatttcacgaagcctccaatgtcagagaaacagtctgaccatttttacccacctaatcgcgcaaacttacgctctcagcaggtcgataattcaagccttattgccatcaacaaggctctttgcggagcggtcgcgtttccctgcgaaaaaggtctgcaccttttctggctactgccagcactcgttttcgttatcccttgccacctgaagcaaccactccaagtgattagggatgattacgctttagtcatctgcttacgaataaacatcgcatcgccgtaactaaagaagcgatattgctctttgaccgcatgttcataagcggccatggtgtgctcataacctgcaaacgcactcaccagcatgatcaaggtcgattcaggcaagtggaaattggtgatcaagcaatccaccaactggtattgataccccgggaagatgaagatttcggtatcaccaaaaaatggctttaactcggtgcctttttgcagcgcatcttgcgccgcactttcgagtgaacgtactgaggtggtacccacagcaaccactcgaccaccacgtgctttggtcgccgtaatcgcatccaccacttcttgtggcacttcaacgtattccgcatgcatatggtgatcgtgaatattttccacccgcacaggctggaaggtccccgcgccaacatgcagtgttacatacgccaactcaacgcctttggcttggatctgctcaagcagcgcttggtcaaaatgcaaacccgccgttggggcagctaccgcacccggcttttggttgtacaccgtttgataacgctctttatccgcttcttcatcaggacggtcgatgtaaggtggcaacggcatgtgaccaatttgattgagaatatccaataccacggtttccgcagtaaaacggatttcaaacaatgcatcgtgacgcgcctgcatcacggcatgaaactcatcgttctcgcctaaataaagttcagtacccggtttgggcggttttgatgaacgaacgtgcgctaaaatcgtgtgctcatcgagcatacgctctaccaacacttctaatttgccaccgctggctttgcgcccaaacatgcgtgctgggatcactcgcgtgttgttaaacaccagcagatctcccggttcaaccagttcgaggacatctttaaaggtgccatccaccagttgaccactgttgccgtcaagctgcagcaagcggctcgcggtacgttctgcttttgggtagcgagcaatcagctcgtctgggagttcaaaatgaaaatctgaaacttgcatggctctttcttgattaagtgatcagtatcgtcgcccgatttcgcggcgcgccagtatatacctaagtgcgctcaagatacaggaatgctgcgtggtgatacacctctggcaaggtaaccttttgtaaagagccatcaggttcgccaacggattcaacaatccgcatatttcggtttcacttcgcagaagttgctggccaatcacactatagttaaataagaaagcgttaatgggaaaaggggttagagaccccggctccgatggttctctgcgcagaaaggagttggctatgatcaaagttgaagacatgatgacgcgtcacccgcacaccttattgcggactcacacgctcaacgatgcgaaacatcttatggaggcgctggatatccgccacgtgccgattgtggatgcgaataaaaagttgctgggtatcgtcagccaacgcgatttgttggcggctcaggaatccagcttgcagcgcagtgcccaaggcgattctctcgccttcgaaactccgctgtttgaggtgatgcacaccgatgttacgagcgtcgcgccgcaagcggggctcaaagaaagcgcaatttacatgcaaaaacacaaaattggctgtttgcctgtcgtcgccaaagacgtgttagttgggatcattaccgacagtgatttcgtgacaattgcgatcaatctgctcgagcttcaggaagagagtgaacccgatgagttggatgaggagcaataagccaagccatcacccgattcattctcggctcggccaaacgatttgtagcggcatgtaggaatgggatagccatactcaaacagagtaaacgctcaccctaaaaaaggcggccattcggccgccaaggttcgcacagaatggtggattatcgattagtgaaattgatcttcttcggttgaaccggtcagtgccgtcaccgaactgttgccgccttgaatggtgttggtcatcttatcgaagtaacccgtccccacttcttgttggtgcgccacgaaggtgtaacctttggatgctgcttcaaattcgcgacgctgtaccatttcgacatagtgacgcataccttcgccttgcgcgtaagcgtgcgctaactcaaacatgttgaaccacatgttgtgaatacccgctaatgtgatgaactggtacttgtaacccatgtccgacagcgcttgctggaaatgggcgatggttttcgcatcgagattcttttcccagttgaacgaaggtgagcagttataagccaacagttgatctgggtattgtgcatgaattgcttcagcaaatttacgcgcttcttccagatctggcttcgcggtttcacaccacaccaaatctgcgtaaggtgcgtaagccaagccgcgagaaatcgcttggtcaatgcccgcgcgtacacggtagaaaccttcggaagtacgctcaccggtcacgaaatcggcatcgtacggatcgctgtctgaagtgagcaaatcggcggcgttagcatcggtgcgagcaatcactaacgtagtcgtgcctgcgacatcggcagccaagcgtgctgcaatcagtttttgcaccgcctcttgagtcggtaccaatactttgccgcccatgtggccacattttttcaccgaagccaattggtcttcaaagtgaacgccagcagcgcccgcttcaatcatggatttcatcaactcataagcgttgagtacgccgccaaaaccggcttccgcatccgccacaatcggcaggaagtaatcaataccgccttcatcttgtggtgatttgccgtttgaccactgaatctggtcagcgcgacgaaacgcattattgatgcggcgtacgactgacggtacagaatccactggatagagagattggtctgggtacatggtgcctgcggtgttgttatccgccgccacttgccagccagagagataaatcgcttcaatgcccgccttggcttgttgcaccgcttggccgccagtgagtgcgcccaaacagttcacatacccttttttcgctgaaccattcaccagttcccacagtttgtctgcaccacgttgggcgatggtattggctggtacaaccgagccgcgcaaactcaccacttcttcagcggtgtaagtgcgtttcacatttttccagcgtgggttggttgcccaatctttttctagtgcttcaatttgttggcgacgagtcagtgtcataatctatccctcttgtatattggttgcctgttggcagctcgattccttgttcgatcagtactgcgctcgctgatcgtaaagtggtttcacgttactggtgttttttcaccttactggtgttatagaggcctacggcaagtagtcgtagccaggtatggttaagaaattcggtagctcttggctggtcgttaagcgctccatcaattcggccgcttcagtaaaacgcccttgtgcaaaacgggactcacccacttcgcttttcaccacctcaatctcttgtttgaggtagtcgcgaaacagttcgttagtgaccacttgcccgttatctaacgttttgccgtgttggatccattgccaaatcgaagcgcgtgaaatctccgctgtcgccgcatcttccatcaagccgtagatcggcacacaaccgttaccagaaatccatgcttcgatgtattgcaacgcaacgcgaatgttgtggcgcatgccatgctcagagcgtgatccatcgcaaggtgccaatagctcggccgcggttatcggagcatcggccatccggctcacattgagttggtttttgcgctcaccaagcacttcgttaaacaccgccatcgcggtatccgctaaaccggggtgagcaacccaagtgccatcgtggccattggtcgcttcaagcattttgtcgccgcgaattttttgtagcacttgttcattgagcgcaggatctttggctggaataaacgccgccatcccgcccatcgcaaacgcgccgcgtttatgacaggtgtaaatcaacaaacgggaatacgcattgaggaaaggcttatccatggtcaccacttggcgatccggcaatacgcggtcgggatgctttttcaaggttttgatgtagctgaaaatataatcccagcgtccacagttcagaccgacaatgtgctctttgagtgagaagaggatctcatccatctgaaataccgcaggcagagtttcaatcaacaccgttgctttgatggtgcctgtgtctaagccaaaataatcttccgtgaaatggaacacgtcactccaccactgcgcctcttgataagcttgcagcttaggtaggtagaaataagggccactgccttttttcaatagtgcgcgatggttgttgtaaaaatagagcgcaaaatcgaacagtgaaccgggaatcgccaagccgttgtaggtgacatgtttttctttgagatgcagaccgcgcacgcggcagatgagcaccgctgggttggcattgagctcataacgcttgccattgtctgggttggtatagcttatgctgcccagaatcgcatcacgcaggttgatctgcccatccaacaccttatcccacgcgggcgacatcgaatcttcaaagtcagccataaagactttcacattcgcgttcagtgcattaatcaccattttgcgatcggttggccccgtgatctctacgcgacgatcttgcagatcgtctggaatgccgagaatcttccagcttccttcacggatatctttggtttcaggaagaaaatcaggtagctggccttggtcgataagcgtttgtttttgttcacgcaaggtcagtaattcatccactcgcggcgcaaagcgctcacagagttgctgtaaaaaagtttgggcttcgacagggaaaatcgcttgatgttcgggtgaaagggtacccacaacagcaagcttgccttgggtgattttggtttccgtggtgtgttgggttaattcagcagtattgattgacataaattccttccttgaaacactcaccaagaacatttgtaactttaaaactacaaattttcattattcagttggcttatccgttgtgatttaaagtcacttaaattgcgcacttttgcaagactccgggcactagacataagtcttaacaacgctaataaaccttaacctacaaagcaccaacaagaaagagcaaaagttaaccccaggttaaattcgaagttttattcggttgccacccccacacaattcatacaccaaaatccgtaagttattacgtaatttaattacacaaaaattgacattgaaaatagcacttaaacaagtgtttaaatttatccttacggtataaaaggtcggaatgactggcttagagcggaacccatcgtctgtaattaaaacagcgttacggtcaggatatgtaaaattcacattgtgaatatttacaattttatgaaagccccaccaattttgacttgtgaaatttcacaattaaaaaattactaaccatataaaatgctaaaaagcgcatcgctaacaatgcgctttcactagtccatagcagaattatcactacgaccaatcgctataacagttcagccactatctcagctaactggcgaaaagtgtgaattcgggaagaacttggacgccacactaggccgatttctcggtaagctttttgtccaggagggtcgatcaccaccaggttttgattatccagcaaaccgtggtcgatggccatttgcggaataaacgtcgtacctaagccattggccaccatttgcactaaggtatgcagactggtcgcggtaaatggattaatcttctctttatcggtgagcttacaagccgatacggcatgttcagttaaacagtgctcgttttcgagtaaaaacaccgattcatcgggtagatctgcgtagcggatcggcacgcggatctgattaacttggttacggctgatcaccatacgaaacggatcttgccccaccacatagctctccatattgccaatatcgacgggtaaggcgaggatcaacacatccagttcaccactgcgcaaggcggaaagcagatttgccgtggtatcttcgcgcaacaataagtgcaatttagggtaacgctggttaatctcttggactaaatcacacaacaaaaacggcgcaatggttggaatgcaccccaaacgcaattgcccttccatggtgtcaccttggcacaacttaccaagctcgactaaatcttgccccttggcgagcaattctcgcccctgcttgaccaccaactctccgacccgagtaaataccagagggcttttcttatcttgcttttcatacaaggaacagccgatcaactcttcaaggttttgaatgcctttacttaaggtcgattgactgacaaagcaacgctcagccgcctcactaaaatggcgggtttcataaagtgtcaccaaataagataactgcttgaggcttggccatttattcatacatcttccatcctctcatcaaaaaccgcgctaaaaacatcatggtacctaggcactactgacctcaccgagacttatcgcttttttcgattaacttaatctaattaattcattttttactttgtctactttgtactatatttctcctcgttattcacggactgaattatgaactcaacgcacatagttcagtacttacaaaattgcttaggagcaaaaaaatggtactagttggtcgcaaagcccctgattttactgcagctgctgttcttggtaacggtgaaatcgttgataacttcaacttcgcagaatttacaaaaggtaagaaagcggttgttttcttctacccactagacttcactttcgtttgcccatctgaactgattgcattcgacaaccgttacgaagacttccttgctaaaggtgtagaagtgatcggtgtttctatcgactctcagttctctcacaacgcatggcgtaacactgctgttgaaaacggcggtatcggtcaagtgaaatacccactggttgcagacgttaaacacgaaatctgtaaagcttacgatgttgagcacccagaagctggcgtggctttccgtggttcattcctgatcgacgaagaaggcatggttcgtcaccaagtagtgaacgatctgccactgggtcgtaacatcgacgaaatgctacgtatggttgatgcactgaacttccaccaaactcacggtgaagtgtgcccagcacaatgggaagcaggcaaagcaggtatggaagcatctccaaaaggcgttgcagcattcctgtctcaatactctgctgacctaaaataagactcttaaccccgcgctcaacacgggtggttggaaataataaagcgaaaacgctacgccaatcagttaagaagtaaagtcatcaaaagcccaaagcactgctttgggctttttctattcttcatttcaccgaatctgtcccacacttaaacgagatgacttgctatgtagtggccgctaagcagcaggaatgagatatccctcctgcagcttcaagtaggaagggtataaatgggtaattcgggtcttaaactttacccctattcttgcgcattctgcgcgatatctgctgctatgatactgccatttcctttatccaaccggagttaacctgatgaaatatcaagttgaagtctgtatcgacaatatcgaatccctgcataacgccatcgcgggaggcgcaacccgtattgagctttgttcatcccttgcgctaggtggattaacccctagtgccgggttgatgtacagcgcaggcagagtgtcaccgattccggcttacgcaatgatcagaccaagagaaggggattttttctatcacgatgatgaactcagcattatggcgcaggacattcgtacggcgcatcaagcaaacttacaaggcgtggtactagggttactcaatgccgatggcacgattgatgtgaaacgcagcaaacctttaatcgaacttgctcactccctcgggttaggtgtgacgtttcaccgcgcatttgaccactgtgtaaaccctgaacacgcgttagaagagatcattgcgctcggttgtgaacgcattttgacctcaggcttggcgcgcaacgcttatctgggtattgaacgtttagcgcaactggtcaaacagagtgctgggcgcatttcaatcatggcaggcgctgggatcaatgcgcagaatgtggctgaaattgcgttagccaccggggtcaatgagctgcatttatccgcgaaaaccacgcgtccgagcgagatgctgtttattcgctcggagagcaaaatgggcgcggcggactgtgatgattttattatcccggtgaccagccgcgatgcgttacagcaaaccgtacacgctctggcagcactcaattctgtcctacattaatgatgtatacccaaacgacttggcgttgcaggtaggcggcaagtgagttcatccccatgagcatagataaacgatgtgattggggtgaacgaacgtagccaacaccgctgcagtttcaagtaggaaggggaaaatacgatcatccgccacggaacttcgccgctcccactgctatgcttaacctagcaaaggagagaatgcgatggcgaaattggataagaaagtctacgaacgtgaattagagctgctgcaaattgagctagtcaaactgcaagagtgggtgaaacaagaaaagctcaagctagtggttatttttgaaggacgcgatgccgcgggaaaaggtggagtgatcaaaaccatcaccgagaaactcaatccgcgggtatgccgtgtggccgccctcccggcccccaccgaaaaagagaaaacccaatggtattttcagcgctacgtcgcccatcttccggccggtggcgaaatagtcttgtttgaccgcagttggtacaaccgcgcgggagtcgaaaaggtgatgggcttttgcagcgatgaagagtatcaagaatttcttcgctcttgccctgaatttgaacgcatgctgcaacgttctgggatcatcttactcaaatactggttttcagtatccgatgaagagcaagagcggcgctttatcgagcggattaatacgcccctcaaacgctggaaattcagtccaatggatctcgagtctcgtcagcgctgggcagcctattcgagagctaaagatgagatgtttgcttacaccgataccaaacactgcccgtggtgggtggtgccttcggatgacaaaaagcgcgctcgcctcaactgcatcagccacctactcagtagtgttgagtatcaagagattgagcatgctccgatcactctgccggaaatcaataagcaaggttacgtacgcccacccatcgaagaccaaacctttgttccacagcgctactaatcctctacctacaaactccgtcaatttgctgctcaacggcaagttgacggacagcgccgcttacaaactcggcttttttagcacatcgtcgatcccttgatcgccaagatggcgcacatccttacctttcacaaagtagatgatgtattcgcagatgttttgacagcgatcgccaactcgctcaatcgcacgcgccgaccaaatgacttgcagaatatgtggaatgtttttcggatcttccatcatgtaggtcatcaactgacgtacgactgcttcgtactctttatccaacctatcatcttgtttatagatttccgctgcggcttctacatccatccgcgcaaacgcatcaagcacttgatgcaacatggcaatcgcttggcgacacaaaggttcaagtgaaacttggaattgatgctgtttggccggtggacgttcgatggcgatataagccatcttagtcgcagaatcgccaatccgttccagatcggtaatggttttgatgatcgccataataaggcgcaaatctttagcggtcggctgacgtttggcaataatgcgcgtacacgcctcatcaatcgagacttccatcgcgttgactttgtgatcgtcggcaatcacacggcgcgccagtttttcatcatcttcatgcaaggcctgcatggctaaggtcaactgctgctcaaccaagccgcccatcgtcaatacttggctacgaatggactccaattccacattgaactgacctgaaatatgtcgaccgaactgcatggcatatccttactaaactggctgaaaaattgcttaaccgtatcgccccgtaatgtagtcttcggtttgctttttcaatggtgacgtgaaaatagagtccgtatctgcgtactcgatcaactttcccatatggataaaggcggtgtgatcgctcacgcgcgccgcttgctgcatgttatgtgtgacgataaccacggtatatttggttttaagatcgtggatcagctcttctatggtcaaggtcgagatcggatcaagcgctgaagttggctcatcaagaagcaacacttcaggttcaatcgcaatcgctcgggcaatcaccaaacgttgttgctgcccacccgataaaccaaatgcattttcatgcaaacgatgtttaacttcatcccataacgctgctgcacgcagagattgctccgccgcatcatctaacgcacgactatttttaatcccctgcaaacgcagtccatacaccacgttttcataaatcgatttaggaaagggattcgggcgctgaaacaccatcccgactcggcgacgcagcgttggcacatccacatccggatgatagatgtttttgccatgcaatttcacctcaccttcaacacgcgttccttcaaccagatcgttcatccggttaatgcagcgtaaaagcgtcgatttaccacagccagaggggccaataaacgccgtaacctgacctttggggatacgcatggaaatatcactcaaggcgcgactttgctggtaatacaggcttaagtgctcaatcgaaatcgccgtctgctgatcggtaagattattcacgtccagcggcggtacatagtagcccaaagtaggattggcggagtacataactagtcttgccccaaagttcggtatttttcgcgtaagttattacgaatactgatcgcagttaagttgagcgccacaatcacagtgaccaataaaaatgaagtggcatacaccagtggtcgtgccgcttcaatattgttggtttgaaaaccgatatcgtaaatatggaaacctaaatgcataaatttgcgttcaagatggatgaagggaaattccccatccacaggcaaactggaagccaatttcaccgcaccgaccagcatcagcggagccacttcaccggctgcgcgggcgatcgccaaaatcaatccggtgatgatcgcagggcttgccataggtagcacaatacgccaaatggtttcaaactgggtcgcgcctagtgctaatgatccatggcgcaccgaaatcggaatgcgtgataagccctcttccgtcgccacaatcaccacaggcagcgtcaacacggctaacgtcagagcagaccacagtaacccaggtgtcccgaaggtcggagtgggcaaacgctcagcataaaaaaggttatcaaccgaagcgcctatggtgtaaacaaaaaagccaaggccaaacaccccatatacgatggaaggtacccccgctaagttgatcaccgcgactcgaatcatccgagtaaacgcgccctcttgcgcgtattcatgcagatagatagccgcaatcacgcctaaaggcatgacgatgatcgacatgatgatcaccagaaacaccgttccaaaaatggccggaaacacgcccccttccgagtttgactcccgtggtgattccgataaaaagcgccacgcttgcttgccccactccgcgagtttttgggcaaaattcatatcattgggataccagaaatccaagatttcacttagtgggacggagacggtctctccttgcatatcaacaagatagagaaattgcttttctaacggtgcacggagcgcatctaactcagtctgaacctgtgcgagctctttctctaaacggcttttgcttaacacgtagtgttgtaaaaactcatcactgagctgattattcaattgcttacggcgtttttccaagcgcaacctttctaactggctactgatcacccgcacttgctgttcaaccatcttatccacttgatcgcgaatggtttctgcctctaacaatgcttgacgcagatgacgctctagcggcagatccagctcgccagtcgtagaatcgaagcgaagcggtttaccaaacagttgcccgcctcggctgcgctcaatcaccgcccaaccttgtggcgcgcctttaaattcggtttcaaactcaagtaaagcaataaaatcagatccatacagatcccgattagcgactttgatattgagccgtgtcgccaaccctgccgcttgcactttttctggtagcggtaaattcatctcttttaaatggctaaccggcacactttcacgagcgtacagttgacccaccacggtttttccatcgggggtttgccattgcagcaagggcgctggccagaaataggttaagccacgccaaccaatcaccagtaataggccaagtacagcaatcaagctgacgctgacggctcctcctgtcagccagatccacggagcaccggatttaaaccaattcaacatattgctccatcataaagaacggtatttttctcgtagccgttgacgtacccattccgctagggaattcaccgcaaacgtaaaggtcagcagcagcagcgcggccaaaaataggatacggaaatgggcgctttgcacttccgattctggcagttcaacagcaatcgtcgccgataaggttcgcatgccttcaaaaatattccaatccaacaacggggtattacccgtggccatcagcactatcatggtctcaccgacggcacgcccgagccccatcatgatcgccgaaaaaatcccagggcttgccgtaagcagtaccacataaatcaaggtctgccatggtgtcgcccccagcgccaaagagccatctgacagatgtttcggcactgagaaaatcgcatcttccgcaatggtaaaaatggttgggatcaccgcaaaccccatcgcaaaaccaacaacaagcgcattgcgctgatcgtaaccgataccgtgctgcgctaaatacacgcgcagatcacccgcaaacagagcgttttccagctcaccactgtaagacagaatcagggctgatataccaatcaacactgggattaaaatcagcgcatgccaaccactggggatacggcgcagccaagctttgggtaagcgcgaccaaatgaacccgagcactatggttgaaggcggtaacaaaatcatcagcgccaatactgcgggcaaatggctctccacaaacggtgcaaaccatagccccgcaagaaaaccgataatcaccgtgggtagggcttccatcaattcaatggtcggtttcaccacgcggcgcatcgaaggcgtcataaaataggcggtataaatcgcgcctaataccgcaatcggcatcgcaaacaacatggcaaaggctgcggcttttaaggtgccaaaagcaatcggcactaaactaaacttagcttcaaaatcgtccgttgctgcggtggattgccaaacaaactctggttcagggtaactttcgtaccacactttttgccacaacgcagaaaaggagacttcagggtttcggttttccacctgcgctaaccgaattttcccttggtcataactcgccaaatacgcttgattctcggacatcgccaccaactgtggcgctcgttgataagcacgctcaaacagcaccaacttttcactcgtggtgtaatggctttgcaaagtgccattgcgatagaagctgtagaaacctttcgtgttggtatcgggcaacaaaaactgcacttctgaggcgagcttaaaattgcggatatggtttaaatgacgctgaccatcgcgcagcacatcaaaccactgtgacaccagaccatcttcgtgcaccgccagtaaagagaacgcccctgataacaaatagagttgcgtgacttgatgacggctatcgccttcactgagatcgacgatttcgcggatctgataactctgcttatccagtaatgcgacgacaagctcagatcgggtacgcaaatacagggtcttaccatctggggtcagcaataactggctgagatcgctgaacggcacactcaaactcagacggctaatctcttgttgcgtcgcgcgatccaaacgcaaaatctggatctgctgcgcgttatcgtacgtggcaaaaataagcgcttccgcagttaaggcaaaagcgaattgttgcagaggctgctcacttaagcggaacgcttccggcaaggctaaacgttccaagctcggggtgaattcacgcccctgagttgtcattgaatgggagagctgcggatgcacaacggccacttggttatcctgacctaccaaggcaaaccaaccttgagcagggggtgtttgtgcccacagtacaggcgtaaagcctaacgattgggtctggataggttgatcgctgacagaacgtaatgaccaaaactgcccaacgccatcatttgacatcaaaaacgcgttttcaccgtaagcacctatggtcatcagtaacggatctgttgttgataccgtcttaaccgcaatgtcaccacgccatttcgcatcgccaaacagtggcaccacaaccatggctaaatagataaaaatcagtaccaaagctcccaacacactgacgccaccacaagtcactgcaaaacgcaccacacggtctttcactaaccgcgcgcgatcacgttctttcaatgaaaatggctgtctgaccatgcttgagattacctatagttttggggagtgtcataatattgcggttgggtgacaattatattacagctcacaataaattactgaaatcaaaacaactctatgacactaaaggcactgcaataaaagtgtcacaaaaatcacttagtttgcagctctttaatgatgaaaacgtcaactcaaaacggcataaggtaaagtatgagtgcggataagctgtacatcgacaaggaactcagttggctctcatttaacgagcgcgtattacaagaagcggcagataaaaccgtcccgctgattgagcggattcgttttctggggatattttccaataacctcgatgagttttataaggtgagatttgctgacgtaaaacgacaaatcttgatcaatcgagaacgggggggcaatgatatctccaaacacctcctctcacgcatgcaaagcaaagccctcaaactcaaccaagacttcgataacctctacaacgaattgattttagaaatggccagacggcgcattttcttagtcaacgaaacgcaactcgatgaaatccaactcaagtgggtgaaaaagtatttccacaaagaagtgctgccgcatgtcacccctatcatgctgcgtgatgacattgatgtcatgcagtttttaaaagacgaatacgcttacattgcggtcgaaatgcgcagtggcgatgaatttaaatacgcgctgatcgagattccaaccgaccaactgccacgctttgtgatgctgcctgagcaaaaaggcaaacggcgcaaaaccattattctgctcgataacattattcgtctctgtctggatgagattttccgcggtttttacgactacgatacactcaacggttacgcgatgaaaatgacccgcgatgccgagtatgatttgcgccacgaagtcgaatacagcttgcttgagcagatgtcagaaggcttaagccagcgcttaaccgcccttcctgtgcgctttgtgtatgagcgtgaaatgcctgaagccatgctcaaattcttatgctataagctgaaaatttcccactatgacagcttgatccccggtggacgttaccacaattttaaagactttatttctttccccaatgtcggccgagattatttagaaaacaaacccttgcctccgatgacttgtgctgactttgaaggctatgccaatgcttttgatgcgattcgcgcgcaagatattttactgcactacccttatcacagctttgagcacatgacggagcttgtgcgccaagcctcttttgatccgaaagtcgtcagtatcaaaatcaacatttaccgcgtagccaaagactccaaattgatgaactcgctggtcgatgcggtgcacaacggcaaacgtgtggtggtggtggttgagctgcaagctcgttttgatgaagaggccaatatcgagtggtcacgcattctgaccgatgcgggcgtacacgttattttcggtgtgccgggaatgaagattcacgccaagctcctgcttattacccgtaaagaaggggatgaattcgttcgttacgcgcacattggtaccggcaacttccacgaacgtacggcgcgcatttacaccgactttgccttgctcaccgccaaccaagagctcgccgccgaagtccgtgccgtatttggttacatcgaaaatccattccgccccgtcaagtttaaccacctgatcgtatcgccgcgtaactcacgtacccaaatttatcgtttactggatagtgaaatcgccaacgccaaggcgggcaaaaaagccgccatcacccttaaagtgaacaatctcgttgataagggattgatcaataagctgtatggtgcaagtgccgctggagtcaaaatccgcatgatcatccgcggtatgtgctctttagtccccggagtggaaggtgtcagtgacaatattgagatcatcagtattattgaccgcttcctcgaacaccctcgcgtgttagtggtacataatgatggcaatccacaggtctttatctcatcggcagactggatggagcgcaatatagatcaccgaattgaggtcatggctccaattcgtgacgaacgactcaaacagcgtatcattgatatccttaatattcagttcattgatacggtcaaagcgcgtcgcatcgacaaagagatgagcaatcagtacgtagagcgcggtaatcgcagaaaagtacgctctcagattgccatttacgactatcttaagaatgtcgagaagcagactcgtaaagcaaaagggcaacaagaaacgaatgacaacagtagtcagtaacgcaagagaaatcgctgccattgatctgggttcgaacagttttcatatggtggtcgccaaggtggtcgatcaagatctccaattgattagccgccataagcagcgtgttcgtcttgctgcgggcttggatgaacaaaaaaatctcgatgaagagtcgatccaacgtggcttagagtgtttggcgatgttcgcagaacgattgcaaggctttgagccacgtaatgtccgtattgctgcaacccacactctgcgccaagccagaaatgccaatctgtttattcaacgcgctctcgacgtgttgccttttccaattgaaatcattccgggctctgaagaagcccggttgatttatctgggggttgcccatacccaaccccaagcggattctatgctggtagtggatattggcggcggcagcacggaaatgatcatcggcaaaggctttgaagcagaactgctcaacagtaagcagatgggctgcgtcaactttaccgagcgttactttgccaacggcaagctatcacgtaaaaactttgcccaagcgattgtcgccagtgagcaaaaattagaatccattgccagcaaataccgtaagaaaggttggcaaatggcgtttggttcttccggtaccatcaaagcgattcatgaagtgttaatcgggcaaggtcatgaagatggactcatcacctttgagcgcctgagcaagttaattgaaaaactctgcgaatgggacagcattgatgatttacaactgcccggcttaaccgatgatcgaaaacccgtgtttgcggcgggcgttgccattctttccgcgatctttcatggtttaaacatcaaagagatgcatttttcggatggcgctttgcgcgaaggtctgctgtatgagatggaagatcgcttcaagtattccgatatccgtttgcgcaccactgaaaatctggccgccaaacatctggtcgatttagagcatgccgccaaagtcaaaggtcacgcgcgtgaattcttggcgcaagtcgccaatgagttgggattaccagaaggcagtgagctgtgctatctgctcgaatggggcgctttactacatgaagtggggctgagcattaacttacaaggctttcatcgtcactccgcgtatattttgcgtcataacaacatggcaggtttcaacagcgaacaacaactcgtgctctccaatttggcacgtttccaacgtaaatcgctgaaattgaatgagctggatgactttagtctgtttaagaaaaaacacattattggcttaattcgagtcctacgactggcgattgtggttaatgggcaacgcaacgacgaccctttaccaccattgaccctatccgccaaagatgatgagtggcgattggagtgtgaacagccagattggctggaaaacaataagttgttgcatgctgacttacaaacagagcaagaatactggcgtgaagtcggctggcaactgctgttttaagccagactagtcactgcaattcgatgaaaaacgcccaactcaagttgggcgtttttcatttcatcactcagtcgatgatgggcttaatgccaactttggctaactcttgctctgccaccagcgccgtaatcggcaaatagccatctttcgcaaccaaggcctgtccctgccgtgaaaacataaagcgaataaattcgcgctcaatcggcgacaaatctcggttaggatttttattcacatacacatacaaatagcgcgataacgggtaggctcccgacagaatattggcttgagttggctcaacatagtcattcccttcacgcgcaatcggcagcagcttcaccccagaaacacgataacccacccctgaataaccgagcgtattgattgaagaggcaaccgactgcaccaccgaagccgagcccggctgctcattgactcggttctggaaatctccttggcacagcgcgttttgcttaaaatagccgtaggtaccggataccgagttgcgaccaaacagttgaatattgcgctttgcccaatcataaggcagaccaagctgagaccaagtgacaatcggctgagtggcaccacagcgcaatgtggcggaaaaaatcgcatccagttgctggaaattcagccctttgatcggattatctcgatgcacaaaaatcccgaccgcatcaatcgccacacgcaatgccgttggcttgtagccgtgcatcgcttcaaacgcggcaatttcactgctgcgcattgggcggctcatcgggccaaactgcgccgtgctttctgataatgctggcggcgcagttgccgaacccgaggcttgcacttgcgcattgactgcagggtaataggcttgaaactcctccacccacagcgtagtcatgcccgccagcgtatccgagccgacggacaataggctgcccgaaataccgctgactttttcatagtgtggcagcgcttcatccaacgcccaagcggtggatgaaaccaaaaccaatgaactcaaccaaccaacgcgacttagcatgcggctcatcctttcgccaccaaccgcttaggtaaaacaaacgaaaacttactgccgacaccgactttactgtagatatccaaatgcgtgtcatggtgtgcaagcgcgtgtttcacgatcgcgagtcccaaaccactaccgcccgtatcacgagagcgggctttatcgacgcgatagaaacgctccgttaaacggtgtaaatgttgcggctcgatcccctcgcctttatcttccacttcgaggcaagcgcctttgccagtgcgataccaacgcacatcaatttgcgcgcccggcggggtatatttaaccgcgttatacaccagattcgaaatcgcgctgcgcagctgatcttcatccgccagcaccttaaggctcttatccacctcaaaatgcagcttatgctgcgcctcaccactaaggctcactgcttctttttctaacacttccaacatggctggtacatcgaccacttgatcgagttcgaccatcggtgatgcttctattttcgagagcgtcagcagttggttcaccaagccattcatccggttgagctgctcggtcatcacaccatgggctttactccacatcgggcccgcgagcacatccggatcttctgtcatttccagataaccttgcagcaccgtcatcggtgtacgcagttcatgggaaacgttagcaaagaaattacggcgcatgccttcgagctgtttaagctgagtgacatcacgcaccaccatcaggtgttcaccttcggtgtacggcactatccgcagttccagcatgcgatcactattgagcggcgaacgcatttcgagcggatcagtaaaatcatcttttttgaggtatttgataaagtccggcgtacgcagcaggttcgagataggctgcccagcatcgtcaggccaacgaaaacccagcaaatgctgcgcaaggcggttacaccacacgatattgccttcgctgcgaaacaccaccaccgcatcggggagcgattccgcaccattacggaaacggcgaataagattagtcagttctttgcgttttttacgatggcgctgctgcaagcgataaatgccattgaacagcgactcccaattccccgttccagaaggtggggtgagacgtttttcatcccacaaccaagcggaaaggcgaatttgatggttcaaatgccagaaaagctgcaaagccgtcgctgccaacagcagccacggcatacttccgaaaatccatcccaccacaacccatggcaagtaaaaaaaagccagctcccaagccagctttttccatgttaaacgttcaaccatactgatttgttctacaccctcttaggctttggttgaaaaacgataccccgcgccgcgcaccgtctggatcagcttatcatgtccagcgtcttctaaggctttacgtagacgacgaatgtggacgtctaccgtgcgatcttccacatacacgttggtgccccaaacattattgagtagctgctcgcggctatacacacgctcttggtgtgtcatgaagaagtgtaacatcttgaactcagtcggtcccatatccaacggctgatcgttagcggtcacacggtgtgagaccggatctaacttcaaaccttgaacatcaatcacatcctccaacgccgtcggagtgacacggcggatcaccgcttttaaacgggcaaccaactctttaggtgaaaacggtttggtaatgtaatcatccgcgcccacttctaagccgcgaactttatcttcttcttcaccacgggcggtgagcatcacaacaggaatgttgcgcgtcatctcttcgcgcttcatatgcttgatgaggttgatgccactaccaccaggcaacatccagtcaagcaggacgagatcaggaaaaggctcagccagcttactcatcgccgaatcataatcttcagcctcaaccgcctgatagcccttttgttcaagcacgaaacacaacatttcacgaatcggtgcttcgtcttcaacaaccagaatccttctagacataattgattaacctttgtttttcaccaacgccatgcattatgggaaatgtttatgacacttttgtgacctttgcaaacaaattttcatataaggttcaggcgaaattcatatatccaaacctcttaagcaaagcaaagtaacaactggaagatgtgcctctttttttgcattcggggtaagacattctcagcatcttcccctatcatgtctggctttctaaccaagggaaaacaacaatgtggtttaaaaactgtatggtgtatcgcgttaatcgcgaggttaacttcaatgccgatcagctggaaaaacagctggccgaatttcgttttacgccttgcggcagtcaagataaacagaagtttggctgggtttccgcactgggtaaacacggcgacatgatgacccacgtcagtgaaaaccgcattttagtctgcgcgaaacgtgaagaaaaaatgctccccgcttcggtgatcaaagattcgctcaatgccaaagtcgaagagatggaagccgaagaaggccgcccactgaagaaaaaagaaaaagacgcgctgaaagaagacatcgtcatcgatttactgccacgcgccttcagcaaaagccaactcacgtttgtgctgatcatgccaaccgaaggcttaattctagtcgatgcaggcagctacaaaaaagccgaagatgtgctctcgctactgcgtaaaaccatgggtagtctaccggtggtgcctgctattcctgaaatagcggtcgaaacgacgctgacgcaatgggtgaaagatggcaatctgccccaaggctttagcctgatggaagaagcggagctcaaatcgttactcgatgatggagccaccattcgctgcaaaaaacaagagctgagcagcgatgaaatcctgagccacattcaagccaataaagtggtcaccaagctggcgatcaactggcaagaccgaattcgttttgtcctcgcggaagattgcagcatcaagcgcctagcgtacagcgatgaacttaaagagcagaatgatgacatcccacacgaagatcgcgcagcccgtcttgatgccgatttctccctgttgtgcggagaaatgtcggttttcctgccggatctattcaatgcattaggtggcctgcctcaccctgaagcctaatcgtggactcaatttcaccacctcggcgtaaatgaggtggtgagagtttcactatgcagagtagggtttttgacgtaaaatttgcgccctttccaataccatcaggtggtattggcctgacttgagatcagattgtaagagaagcaagcaatgacaacgccaaaaacctttgttccagaactcctttcacctgcgggtagcctgaagaatatgcgctacgcttttgcctacggggcagatgcggtatatgccggccaacctcgttacagcctgcgcgtacgtaacaatgagttcaaccacgaaaacctacaaatcggcattaatgaagcccacgcactgggtaaaaaattctatgtggtgtgtaacattcagccgcacaactctaagctgaaaaccttcatccgtgaccttaagccggtgattgatatggggccggatgcgctcatcatgtctgaccctggccttatcatgatggttcgtgaagaattcccgcacatgccgatccacctgtcggtacaagcgaatgcggtgaactgggcaaccgtgaaattctgggcttcacaaggcgttgagcgtgtgattgtttctcgtgagctctctttagaagaaatcgaagagatccgcgaaaaatgcccgaataccgaaattgaagtgttcgtgcatggcgctctatgtatggcttattccggtcgttgcttgctgtctggttacatcaacaagcgcgatccaaaccaaggtacttgcactaacgcatgccgttgggaatacaaagttgaagcagcaaaagaagatgaagcaggtcagatcgttgaacagtttgaccctaatgcagcacaagccatcgaagttcaaaatgaacgtccagacaccaccatcggggccggcaaaccgattgatgatgtcgtactgctttctgagagccatcgtcctgatgagaaaatggccgcctttgaagatgagcacggcacctacatcatgaactccaaagatctgcgtgcagtacagcatgttgagcgcctaactcaaatgggtgtgcactcactgaaaatcgaaggccgtaccaaatctttctactactgcgcacgtaccgcgcaagtgtaccgtaaagcgattgatgatgcggtagcgggcaagccattcgatgatagcctgatgactaccctagaaagcttggcgcaccgtggctataccgaaggtttcttacgtcgccatacgcacgatgcttaccaaaactacgactacggctactcggtttccgacactcaacagtttgtcggtgaatttaccggtaaacgccgcggcgcaatggccgaagtggaagtaaagaacaaatttgtgctcggcgatagccttgagctgatgacgccaaaaggcaatgtcatcttcactttagaagcgatggaaaaccgcaaaggtgaagcaacagatgatgccaaaggcaacggtcactttgtttacattccagttccggaagagttggatctcagctacgcactgctgatgcgtaacctagtgcaagggcaggatacccgtaacccaacaggcaagtaattatggcgctactgattaccgccaaatgcaccaactgtgatatgtgtgagccagagtgcccaaacagtgcgatttcaatgggcgataagatctatgagatcaatcccgatttatgcactgaatgtaaggggcattatgacaaaccgacgtgtcagtcggtttgtcccatcagcaactgcatcatcaccgatcctgcccatcgcgaaaccgaagagcaactactcgaaaagttcgtggtaattcaagggctcgcgtaaatcgaaaatcccagccaagtgctgggattctttattacttcagagctaatcctttacgctgcaaatagctgagcataaatggccgagactcttcagaaagcttagcggtaatttgttctgaccatccctgctgtttaggattaccggaacgtttttggtaatactcaaccatggttcggtcatattctgcgacatcctctttattcaaaggctggtagtggttttcatgcaagatcaccttcggagccaagcacggttttaactctggctcctgagctgggtgccctaaacacataccaaacaataccgcggtataaggcggcaagttaagcaaagcatcgacttcattcggtgaattacgtaaaccaccaatatagacaccacctaaccccatcgactctgccgctaacaaacagttttgcgccataatccccgcatcaacagcaccgattaaagtgagctccatgaattcaggttttacgttcggattcaatgcatagtgccgctgataatcaatgcaaaatactaagaactcagccgcactcgccacataagcttgattgccagcaaactctgctaattgctcacgcatactgccatcggtcactcggatcaccgagatcacttgcagtaagctggatgacgaagctgcaataccagaagcaatgatcgtctcaagttgcgttgcagaaataggctcttgggtaaaagcacgaatagaacgatggctaagtatggtatcaataacaggattcatgcggcctcctcagaaatgttgtccatcaagataataagcggtgcgttgcaaaggtataaacactacagcaagatgagaatcagcaccgagcaactgacgtatctgatcagtaatcacctgtgcaatctgatcctgagtctgctgttctcttccaaaccacaatacttccaccatgggataaacccctccttcggcgaaatactgggtattaatcaactcaaaggtaaaagcatttcgagcagtactgagtagagaggaaagctcattgagtaaggtagggactagcgattcaacgatatgcgcttctactgcgcgaaaacgtaaatgaggcatgactgattttctccttttttgccatcataacagccagcatggagaggtgcgagtcatacaaaaaacaaatgataaaccattgttctaagggctcaagaagcagaataagagagttagaaggattgaataaccgagataacggcacttttatctagaaaaaaaaaccagtcctaagactgggtttcgtaataagtggcggagcggacgggactcgaacccgcgacccccggcgtgacaggccggtattctaaccgactgaactaccgctccgctgtctggttagacgtttcgtctactttttttgcctttagatttttcttaaacatctaaaaacaacaagttaaagcctggcgatgttctactctcacatggggagaccccacactaccatcgacgctgtttcgtttcacttctgagttcgggatggaatcaggtgggtccaaaacgctatggtcgccaagcaaattctgtttttgatttcactttttcttaaaagtgataaccaacaattctggaaagctgtcttcgttctcacacacattcttatgcgcttagctttgagtccactacaaaaccccttgggtgttgtatggttaagcctcacgggcaattagtacaggttagctcaacgcctcacaacgcttacacaccctgcctatcaacgttctagtctcgaacaaccctttaggacagttaaactgtcagggaagactcatctcagggctcgcttcgcgcttagatgctttcagcgcttatcaattccgaacttagctaccgggcaatgcgtctggcgacacaacccgaacaccagaggttcgtccactccggtcctctcgtactaggagcagcccccttcaatcttccaacgcccacggcagatagggaccgaactgtctcacgacgttctaaacccagctcgcgtaccactttaaatggcgaacagccatacccttgggaccgacttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactatgacctgctttcgcacctgctcgaaccgtcattctcgcagttaagcgggcttatgccattgcactaacctcacgatgtccaaccgtgattagcccaccttcgtgctcctccgttactctttgggaggagaccgccccagtcaaactacccaccaggcactgtcctcaacccagataatgggtctaagttagaacatcaaacatacaagggtggtatttcaaggacggctccaacgcaactggcgtcacgtcttcatagcctcccacctatcctacacatgtaggttcaatgttcagtgccaagctgtagtaaaggttcacggggtctttccgtctagccgcgggtacactgcatcttcacagcgatttcaatttcactgagtctcgggtggagacagcgtggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtcatcttgcgattttgcacagtgctgtgtttttaataaacagttgcagccacctggtatctgcgactctcgtcagctccatccgcgagggacttcaccatcaagagcgtaccttctcccgaagttacggtaccattttgcctagttccttcacccgagttctctcaagcgccttggtattctctacccgaccacctgtgtcggtttggggtacgattcctgactatctgaagcttagaggcttttcctggaagcatggcatcaatgacttcactaccgtagtagctcgacgtcgtgtctcagccttagagagagccggatttacctaactctcaagcctacgcacttgaaccaggacaaccgtcgcctggcccacctagccttctccgtccccccatcgcaatagtcagaagtacgggaatattaacccgtttcccatcgattacgcctttcggcctcaccttaggggtcgactcaccctgccccgattaacgttggacaggaacccttggtcttccggcgaggaggtttttcaccccctttgtcgttactcatgtcagcattcgcacttctgatacctccagcaaaccttacgattcaccttcaacggcttacagaacgctcccctacccaatgtctaaaagacattgccgcagcttcggtgtattgcttagccccgttacatcttccgcgcaggccgactcgactagtgagctattacgctttctttaaatgatggctgcttctaagccaacatcctagctgtctgagccttcccacatcgtttcccacttagcaatactttgggaccttagctggcggtctgggttgtttccctctccacgacggacgttagcacccgccgtgtgtctcccggatagtacttactggtattcggagtttgcaaagggttggtaagtcgggatgaccccctagccttaacagtgctctacccccagtagtattcgtccgaggcgctacctaaatagctttcggggagaaccagctatctccgagtttgattggcctttcacccctagccacaagtcatccgctaatttttcaacattagtcggttcggtcctccagttgatgttactcaaccttcaacctgcccatggctagatcacccggtttcgggtctatatccagagactgagcgcccagttaagactcgctttcgctacggctcccctatacggttaaccttgccactgaatataagtcgctgacccattatacaaaaggtacgcagtcacaccacgaaggtgctcctactgcttgtacgtacacggtttcaggttctatttcactcccctcacaggggtcttttcgcctttccctcacggtactggttcactatcggtcagtcaggagtatttagccttggaggatggtccccccatattcagacaggatatcacgtgtcccgccctactcgatttcacgctcgatgaagcgtcggttacggggctatcaccctgtatcgccaagctttccagcttgttcacctacttcaccgagtgcttaagggctaatccaggttcgctcgccgctactaccggaatctcggttgatttcttctcctcggggtacttagatgtttcagttcccccggtttgctctgttaacctatgtattcagttaacagtaactgcttatgcagttgggtttccccattcggaaatcgcagactcaaacggctcttactgccttatctgcgcttatcgcaagttagtacgtccttcatcgcctctgactgcccaggcatccaccgtgtacgcttagtcacttaaccatacaacccgaaggagtttcgggttgctgtttaaacaacctaagttgtctcgcgtttaatttacatgagtgcgagacagattttgccggactcaaatttgaacaagaccgaagtcttattcgataccaagcacacttgaatgtgttgttggtgtttatctttcgataaacattgagaactttacaaacaacaataaattgttgttttgtcagctttccaaattgttaaagagcaagattttctgatgaaaaccatttttaaacattctcagcgaaaacgcttaaagatggtatcccgtaggggagtcgaacccctgttaccgccgtgaaagggcggtgtcctaggcctctagacgaacgggacactaagatactcttctctaatctaaaccgaatcaatctgtgtggacactcatcacgataaccatcgtgtaaggaggtgatccagcgccaggttcccctagcgctaccttgttacgacttcaccccagtcatgaaccacaaagtggcaagcgtcctcccgaaggttaaactacctgcttcttttgcagcccactcccatggtgtgacgggcggtgtgtacaaggcccgggaacgtattcaccgcaacattctgatttgcgattactagcgattccgacttcatggagtcgagttgcagactccaatccggactacgacgtactttgtgagattcgctccacctcgcggtatcgctgccctctgtatacgccattgtagcacgtgtgtagccctactcgtaagggccatgatgacttgacgtcgtccccaccttcctccggtttatcaccggcagtctccctggagttcccaccattacgtgctggcaaacaaggataagggttgcgctcgttgcgggacttaacccaacatttcacaacacgagctgacgacagccatgcagcacctgtctcagagctcccgaaggcactccagcgtctccgctagattctctggatgtcaagagtaggtaaggttcttcgcgttgcatcgaattaaaccacatgctccaccgcttgtgcgggcccccgtcaattcatttgagttttaatcttgcgaccgtactccccaggcggtctacttaacgcgttagctccgaaagccacacctctagggcacaacctccaagtagacatcgtttacggcgtggactaccagggtatctaatcctgtttgctccccacgctttcgcatctgagtgtcagtatctgtccagggggccgccttcgccaccggtattccttcagatctctacgcatttcaccgctacacctgaaattctacccccctctacagtactctagcttgtcagtttcaaatgcgattcctaggttgagcccagggctttcacatctgacttaacaaaccacctgcatgcgctttacgcccagtaattccgattaacgcttgcaccctccgtattaccgcggctgctggcacggagttagccggtgcttcttctgtaggtaacgtcaaatgattaaggtattagcttaaccaccttcctccctactgaaagtactttacaacccgaaggccttcttcatacacgcggcatggctgcatcaggcttgcgcccattgtgcaatattccccactgctgcctcccgtaggagtctggaccgtgtctcagttccagtgtggctgatcatcctctcagaccagctagggatcgtcgccttggtgagcccttacctcaccaactagctaatcccacctgggcatatccggtagcgcaaggcccgaaggtcccctgctttgctcttacgaggttatgcggtattagccatcgtttccaatggttatccccctctaccgggcaatttcccaggcattactcacccgtccgccgctcgccacccaaggaacaagttcctctgtgctgccgctcgacttgcatgtgttaggcctgccgccagcgttcaatctgagccatgatcaaactcttcaattaaaagttttttgaagctttcgcttcggctcaatgaatactgattacattctttgcttaattaaaaagcgaagtaatgttgaattgactgtgctgaatgattgctcattcaaatggtcactcagttcattgataaatcttttttgattatcatcgacgagtgcccacacagattgattggtttatattgttaaagagcgttttgcttcggctttcttaccgaagaggctgtgcattctagcgagataattgtcagagtcaaactcttttttcaactttattcatcgaagcgttttagcctcactgactagccttgagaccttgtggcgtctgccgtgtcagtgagggcgcattatagggaggttttgcgttctggcaagcaataaaatgctttttctatgctttattagctcaagagaacaaattaacagcaaaaccactaaaaaacgcacttcatcgttcaattaacaagcaaaagagccactttgagtggctcttttgcttatgatagataaggtatctgctactggcttgcgaaaatattcccgtcttttaccgatagtaaaataggtgaaccaggcaggaacttaccagccagaatcgatttggccagtgggttttccacattttgttgaatcgcgcgtttcagtggacgagcaccataaaccggatcgaagccgacatgagcaatcagatccagcgcctcatcatcaacctctagttggtaatctcgctctgccaaacgttgacgtaggcgggccaactgaatagaagcgatcgacttgatatgctcttgtcctaatgggtggaataccacactttcatccactcggttcaagaactcaggacggaagtgtttgctgactacgtccatcacttgttctttgataccttgataatccaaccttgcaaaattttcttggatacggcttgaacccaagttggaggtcatgatcacaacggtatttcgaaaatcgaccgtgcgcccttgtccgtccgtcaagcggccatcatccaagacttgcagcagaatattgaagacatctgggtgcgccttttccacttcatcgagcaaaatcaccgagtaaggtttacggcgtacagcttccgttaagtagccaccttcttcatagccgacataacctggaggcgcaccgactaaacgagcaaccgagtgtttctccataaattccgacatatccacacgtaccatggcatcttcactgtcaaacaggaagttagccaaggttttacacagctcggttttaccgacccctgttggccccaagaataagaaggagccaatcggacgatttggatcagaaagccctgcgcgactgcggcggatcgcattcgcgaccacttccaccgcttctttttgaccaatcacgcgtttatgcagcacgtcttccatgcgcagcaacttttctttctcagcttcgagcatttttgatactggaatgccagtctgttttgaaagcacttcggcaatttctgcatccgtcactttattacgtagcagagtcatttcctgcatttcggcttgcgcagccagatcaagctgcttttctagctctggaatgcgaccatattgcagctctgacatgcggttcaaatcccccgcacggcgagcgacttccagatccatccgcgcttgttcaagtgccgctttaatatgttgcgtgccggagagtgccgccttttcagctttccacacttcttccaactccgcgtaatcacgctctttctcttgcagctcttcatttaagatcgccaagcgtttttcactggcttcatcgtgctcattagagagcgcttgctgctcgattttcagttggatgattttgcgctcaagcttatccagagcttctggtttggagtcaatctgcatccggatgcttgaagccgcttcatcgatcaaatcgatcgctttatcaggcaactggcgatcggaaatatagcgatgcgataggctcgctgccgccacaatcgctggatctgtgatttcgacatggtgatgcagttcataacgctctttcaatccacgcaagatggcgatggtatcttccaccgtgggctcatccaccaacactttttggaagcggcgctctaacgctggatctttttcgatgtattggcggtactcatctaaagtggttgcgccgacacagtgcaattctccacgcgccaaagcgggtttgagcatgttgccggcatccatcgagccttcgcctttccccgcaccaaccatggtgtgcagctcatcaatgaagaggatgatattgccttcttctttcgctagctcattgagtactgatttcaagcgctcttcaaattcgccgcggtatttcgcccctgccactagcgcgcccatatctaaagacaacactcgccgtccacgcaggccttctggtacttcattattaatgatgcgctgcgccaagccttccacaatcgcagttttacccacaccgggttcaccgatgatcaccggattgttcttggtacggcgttgcagcacttgaatggtgcggcgaatttcatcatcacgaccgatcacaggatcgagtttgccctgctcagcgcgttcagtcagatcgatggtgaatttttccaacgcttgacgcagctcttccgcattcgggtcattaaccttttgtccaccacgaatcttctctattgcttcagagacttttttctcggtcagtccaaactctttgagtaagtgacccagtggccctttgtcctcaatcgcagcaagtagatagatttcagaggagatgtaggcatcttgacgcttttgcgcaaccttatcacacagattaaacagcgagccaagcgccgaagagagctgtacatcaccaccaataccactgactttgggtaaacgatcgagcatttcgccaagtttggagcgcagttgcatcacatccacattaagcatggtgagtaatgggcggatcgggctgccgttttgatccagcagagccaccatcaggtgcacaggttcgatatattgatgatcacggccgagcgctaatgactgggcatcggaaatcgcgatctgaaatttgctcgtaaatctgtcaagacgcataccaaccttcctaacctcatctgagataaattgaatacgttaggaaagatggttatcacgaaccagattttcaagggaagttgaggaaactttcttgttgtttgatatgggtatggatgaaggcttactcttcaagccaaataaaagcggcttggcgtcctgttactccatcgcggcggtaggaataaaaacgctcagcatcctgataagtgcacaagccactatcaaagacttgttcaatcccaagttcttgcaaacgcagtttgactaattggctcatatccgccagccatttcccttgttgtgcacgaggagtgaaagcgtattcggcttgaggatggtgagcaacaaaagcggcgaaaacatcttcccccacttcaaacgcctgcgcgccaatcgcagggccaagccacaccatgacatcgccagacattcttgccgctgtgtgttcaacaatgccattgaccaaaccacgccaaccggcatgtacagccgcgacttgggtaccagtacgattggtcattaataccggcaggcaatccgccgtcattgccgagcacaccacattcggcgttgaagtgataaggccatcggcatccaacacttgctcagtcggagcatcaacatcgagtaccactgtggaatgggtctggtttagccaaatgggtgaacttggcatcgctgacgttgccaccaacgattgccgattacgcagtacaagtacaggatcgtccccaacatgcataccaaggtttaacccttgataaacgccttgcgaaaaaccaccgtggcgagtcgaactaaacgctttgacttgtttgggtgcattccagttggggagaatcatgattaatactcttcagtgcggtttagcttcgcatcttcacgcagtgcaagcgtcatctcaaccatatcatcaggcactggtgcatggaattcgagctcttcccccgtaaccggatgctcaaatttcaacatcaccgcgtgcagtgcttgacgatcgaagtcacgaatcatttccgtcagttcttccgtcgcacctttcggaatgcgtgcacgaccaccataggccgtatcacccaagagtgggtgttgcaaataagccatgtgcacacgaatttggtgggtacgacccgtttccaaacgtagacgcaaacgcgtatgttcacggaaatgctctgccacacggtaatgggtcacggcatgtttgcccatcggggagaccgacattaaagtacgtttggtcgagtgacggccaatcggcttatcaatcatgccacccgcggtcattgtgccaatcacaatcgcttcgtactcacgagtcacgtcgcgcttttgtagtgcacgtaccaagcgtgtttgcgcgggaaccgttttcgcgaccaccatcaaacccgtcgtatctttatcgagacgatggacgatgcctgcacgtggcacttcagcaatcggcgaataatggaacagcaatgcgttaagcacggttttatccgcctgaccggcaccggggtgaaccacaaagtcacgcggtttgttaataacgataatgtcgtcatcttcatacacaatgttcagtggcaaatcctgcgcttcccagcgctgttcgtcttccagttctgcctgaacggtaatcacctcgccacccatcactttggtacgcggtttggtgatgacatcaccattcacggcaatcttgccttccaacaaccactcttttaaacgtgagcgggaaaagtcggtaaataattcagccacagcttgatcaagacgttgaccaagctggctatcttttactgtttgagttaattcaatctgatgagccatatcgaactttttaaaaaaccgtgagactaatagtcactagtatggaaaaatacgccgacattgtatctgttactgccaagaaagtaacgaaacgatttgcgcgcggtttacgcacctattgaaaagcaagatttgcaaggaactccaccctgacatgaaataccagactttatcaggcctactcgcgttatccctgttatttggttgctctagcagcccagatgtggtgccagatgtaccgccatcacagctgtactctgaagcgcaaaccgctctacaaagcggaacgtggttaaccgctatcgaaaaactagaggcgctcgattcacgctatccatttggtgcttattcagagcaagtacagctcgatctgatttatgcctactacaaaaatgatgatctggcccttggcctcgcgaccatcgaacgttttacacgccttaatccaacccatgaaaaaatggattgggtactctacatgcgcggtttgacgcacatggcgcaagatcgcaacttcatgcatgacctgtttaatatcgatcgccgtgaccgcgatcctgaacccgtgaaagcagcctttgcggattttaagaaactgctccagcgttacccaaacagcccatacgcagaagatgcgcagcgtcgaatgtttgcgctcaagaaccgtttagcggaatacgatttagcgaccgcagatttctacctgcgccgtgaagcatggattgcagcgattaatcgcactcaagagttacaaaaaacctatccagataccgaagcggcacgtaaatccttagaaatacaactcgaggcttatcagcagcttggtttaaccgacgcgatagagcgaactaagcagttaatgcagcttaaccctttataaggcgctagaactcaccaacaaaaagagccacagcaattgtggctctttttgttttgatttgttattgatttggcgtagcgatgtttctcttagacgccccatcaccaaagtgacttttatcacaaaagcaacatggtgactttttatccatcaagcttttttaggtcgaaacaaagcgctaaaaaatcggaaatttttagtctctacttacctgaatctagcggttttataagagataacaagctttttctttacctcttcagcacaagctttgcgatagatcacgtttatttcacatcaagaaaaaccctcaagataaggtgatctaaatcacattatttccgcgatagcgcgctaatctgaactcaacccataagggatgacacagaggaaaaagcattatgaaaatcaacatcactggtaaaaacatcgaagtcacctctgcaatccgcaatcatatcgagggtaaactcaaaaaattagaaaaatggcaagtcgacattattggctgccaagccagcttcagcgaagagcccaacaaacagaaaaaatttgaagcagtcgttagcattccacgcggtcagttagtggcttctgcaattcacgaagatttgtatgccgccattaacgaggtagagcaaaaactcgaacgacaattgaataaactacgccacaaaccagaagctcgccgagcggataaaacggaactgagcgaagaagtggaataaatagaatgatgggagatagcgccttagggcgctatttttttgcttgacgctctctaggggcttgcttattgtgtggtgacttacttggataaatatgcattgatgacacctcattccctgtacttttttgacttcttttttctccaataatgtttggaggctcgctcgttgttcaaagacaagtcaaaaacgaacagaaagcctcctcttaagggggctttttttataaggataactttatgacagacaaacaatactcactcgacgatattcgcttacggctaaacgaactcgacgatcaactgctaaacctgctgtcagaacgacgcaaaatgagtattgaggtcgccaaaagcaaagtcgaaaccgcgaaacctgtacgtgatccggctcgtgaacagcagctactggtaaaactcatcaatgctggcaaagagaaatatcagctcgatcctcaatacatcaccaaaattttccacaccatcattgaagattcggttttgcttcagcaatcctatctgcaaaaccttgcgaatccacaaagtcgtaagccattggctagagtcgcctttttaggcgctaaaggctcttattcacatctggcgactcgcgagtatttcagccgcaaaaatacagagctgattgagctcaactgcgaccattttaaagaggtggcaagaaccgtggaatccggccatgcggattatggtgtgctaccgattgaaaacaccagctcaggctccatcaacgaagtttacgatttgctgcagcacaccacactgtacatagtgggtgagttaacgcagccaatagagcattgcctggtggccacgcaagagattcgtttggaggatctgaaagtcctctattcccatccacagcctcaccagcagtgcagcgaatttcttagccgcttaaaaggggtcaagttagaaagttgcgccagtactgcagatgccatgaaaaaagtgcaagagctcaatcgtgcggatgtagcagcgattggcaactcagccagtggaaagctgtacggactgcaaccgattcaaggaaatattgccaaccaaaccgaaaatcacactcgctttatcgtggtggctcgtaaacccgtcgacgtttcaccacaaattccagccaaaaccaccttgattatgtcaacttcacaagaggcgggctcgctggtttcgaccttactcgtgctgcaacgttacggcattaatatgactaagctggaatcgcgtccgattatgggtaatccgtgggaagaaatgttctacgtagatttagaagcgcacattgactccgatgagatgcagcaagcgttggcagaactcactcaactgactcgacaccttaaagtgcttggctgctaccctagtgaaaacgtcaaacccactcaggtgaaattcatttagcgtcaataaattgaaccttttaagctgacagcttcacccgctctgattataatgcgaccaaattatacatagagttaggtgatccaggctgtcagcgtagccaaaatattggcttttacgctattaggttatttgtcggatcgtgaccaatttttgtaacgaatgggtatcgtattcacaaatgatcaaacgctttctgtcgctgatggtattgaatactgtctgttatcaagccagcgctttggaactgaatgtctacctttgggaagatacgattgcaccaagcgtagttgaggcatggcataaaaaaaccggcgtctccgttaatctcttccatttcgataatgatgatgaacgcagtttattaatgctcaaaagcgtacaactgccctttgacatcatggttttggataacgtctccgcgttcattttctcaaggcaaaatgtttttgaagatctgaccgcccttcccaatcgtgcgaataatgaccctatgtggctacaagcttgtggcacccatgcggtaccttatttctggggctcagtcggcattgcctatcgcaaaagcttgtttgataaacctccaacgcagtggagtgaggtcgtcgatatcgctccggcgcatcgtggacgagtgggtatgcttaaagacagtgtcgaaacactactgcctgcactatacatgctcaacgcctctcccattaccgattctatcgacacactaaggcaagcgtatcgtctcttagacgccgccaatccccatatcctgacttatgagtatgtattgagctatgtacgcagccacccacaaaccgacaatctacatatggcggtctcttacagtggcgatcactattcactgaaccgcttcttcaatactcaagactgggactttagcgttccagaaggccgcccttatttgtgggttgattgtatggccgtaaatagcgtttctcccaacacagtgcaagccaaagcttttttggatttcttgatgaaacctgacattgccgcaatcaatgccgaatatattcgagctgcaagcccgaactacaaagcacgcgctttgctccctgtagagcaccgagaagatctctcgatttatctcccagagcagcgattggcggaggggataatcgacagcgaactctcggcgaaaaacctcagtctgcgtgccaaaatcatcagcagtgtgacttaccaatatgaagctaaaccatagaattctgttactgattgcaccggtgatcctgctcagtgcagccgcatcaagctacatcatttataccagtcagaaaaatgcgctgctaaaaagaaccgacagttacctgcagttgaatattgaaaagttagccagccactatcgacaagctcagtcgctcgtcagcagttatgccttcacgctggccaaaagtgacatcatccgccactacttctctttagaaaaaaatccttaccgcgaactagaactggtggataacttacgtgaaaccctgcaaattttgcagccgaatgaaaaacagctcgtatcgttatcgatcctcaatggccatgaagagctgctttattatgcggaaaatagctccgatccatttgccgaacttgaccctaaggtgatggcgtacatcaaacagcgttttgcatccacacaaaaaaactctgatatcagctacaccgtcaactcagcgggtgaagatattttggttcgctacgatatgctggatactcagacactctcaacgccgctcagttataaccgccaagacgtgttttttgtggtggtgtatgtggtgcttgagcagttcagccaactgcgcaaaaaaattgaatttgataaccagagcccgatattttttacgcactcacctccgagttaccgcacgggcttgttgcaatcggttgaattacaaccgggcttttacgccatactcgaccctgcaccgaaactgattaacgcccagcttcactccattcagcgcgaacttttactctcttttggcgtttcggcactggtgacggtactcatgctactgctccttctctatcgccatgtgatcaatccgatcctgcatttggataaacagcttgaagaggtggaaaacaaccaacgtaagaacattgaaaaactcaatactgacgatgaaattgggcggctttcctcgcgtttttacgccatgtacagcgaacttcattcaacctatcaacgcacgaaagcacttgcggaaaacgatcacctcaccaagctggctaaccgctatcaatttcaagttcaagccgatctgctgctatcacgttgttacgatactcagcatatctgggtcatgtatatcgacttagataacttcaagtacgttaatgataagtatggtcaccaaatcggtgattccctactggtcagcttcgcgacccacgttcgccagttatgtaaaaattttgaggccagccataacacctacagtattgcggcccgtttatctggtgatgagtttgctattttgctcgtctcccccaaacggtttaatgattgtgcgaagatctttgctcaacgcttgttggcaccgatccaaaataaagacaactcaccacttagccattttcccattactgccagcattggtattgcgaccttccctaaagatggcgaacacattgagaaattgctgctcaatgccgataccgccatgtatcaagcgaaaaatgcgggcaaaaaccaagtcgcttactattcgcaggcgttagatcaaatagtacagcggcgcaataatattgaacgagcactgcgcttagggttatttgatcaagagttcaatttggcttatcaaccttactttacttgctcagggaaacgcttagtgggcttcgaagtattgctgcgctggcaatctgaattgctcggtgaagtgtcgccggaagagttcattccaattgcagagcaaactggattgtttggcacgatcgaccgctgggtcatttcaaaagcttttcaagagatatcaactctacaagccatagtgaaagagccgatccaagtgtcgatcaacctctcttcggcagaactcaattcgctgaaattggctcaatttatccatcgacaggctgagcagtttggcgtctcccctgcatggatcgattttgaaatcaccgaaacgtttgccgcagattcgcaaagcttcccattgctgcacgaactctcgcgtcttggctatgggttaacgattgatgattttggctcaggctatacctctattactcagttggtgcagtatccagtacaaaagattaagtttgatcgccattttttggatacactcatcgccaccaacaaacaaaatgttattcgtccactgattgatctctgccactctcaatccatgaaagtgaccgctgaaggcattgagagtgaaactatgcatcaatggttggccgattatgagtgcgattacatgcaaggcttctactttggttatccaatgagcctaagcgagatctccccatggcttcatgcctccaatcataaaaagaagagttatgcgcaagatcattattgcttcacagaacccagccaaagtgaatgccgttagaagtgcctttagcaccgtatttccagatcaagaatgggaatttattggcgtatcagtaccgagcgaagtcgccgatcagcccatgagtgacgaggaaaccaagcaaggagccctcaaccgagtccgaaatgccaaacagcgccaccctggtgcagagtattatgtcggattggaagcaggcatcgaagagaacaaaacctttgcgtggatgattgtggaatcagaccagcaacgcggagaatcacgcagtgcctgtttgatgttgccaccactggtattagagcgtttacgccaagctaaagagctcggcgatgtgatggatgaagtatttggaactgagaatattaaacaaaaaggcggagccattggccttttaacccgccaccatctcacccgcagcacagtttatcatcaggccttaattctcgctctgatcccctttattaatccagaacattatccatcagcttagtgagtatgagttgaagctctcattcacttcaactcatcgagttcttcaaaaaacactcggcttagccagtgatgtcattaggcttctgaggatggaggcggcataagcagttgagctaatgccgctttctcatcttcactccgtgacttgagctcattcgaaccacgcgtgatggttgcaatcccgaccccaagcatttggcttatttggcgctgagagagctcgccttgcagcagctcatgcacaatattcactcgagcgactaatgcttcacgctcatccggcgtcatcaacatggtcagtagcatttcgtgctgctcttgctgcacggcttgcttaaccagatccaacacttgctgccactcactaaaagaaggttgctgtaccatagttgtactcgttaagtgatacaccggcctattgtagtgcagcaagttgaggaatcaatactttgtatttaactcatgctcattcaagaagcggccttgtacgcccatcaaatcccgatagtaggtttcaaacatcaaaatgttctgcacataaccgcgggtttcagcaaaggggattgcctcaataaagccatacgcatccagcttaccttggctacgtttcaaccaactatcgacccgactgggtcctgcattgtaggcagcaaaagccaagattcggttctggtcataacgctcaagcaaactgctgagataacggctaccgatctcaatattcttacccacttgatagagttcgtcaggattggagtagctcaattggtatttccttgccgtgtagcgcgcagtatccggcataatctgcattaagccccgtgcgccaacgggtgattgcgcatctgggttaagcgcactttcttgtctggctaaagacattaatgtgatcggatctacaccattttttcgaccatgcaaggtaaacaagttctgatgtacgacaggaaaacgcagttgattgttatcccagaggctggcggaaatggtcgccgcaatggtcatctgataccaacctgaatctgcggcatacgctgccaacatctctttttctttctgagaaactcgatcaagcaaccaacgccattcactttttgccgccggcactttatccaaggcaatcagttcatcaattctggccaacgcttttttatgagctttaatctgcttcatatccagcgttactgtactggtcggataattgaccgactgctgcaaaattttggctgccgctacgctgtaaaaactgcgttgtccaagcaaagcttttaagcgctcggtaccttcttttttcttacccagcgcgatttcactgcgaccttgccaatattgccaacgcagagttttacgctcttgctctggtaacaccgcaatccattgactcaaaccacgccaatcattctcacgcagtgctagtcgaatacgcgcttcaatcaaacgcacatcttggctagtgcgagtcacctcatcacgccatttagcaatcgcagcctcttcagtatccatcaaacggattgcaataaaacgagctactcgccctttctgctcttgattccagccttgggctttcgcgacatcattgaagacagcttgcgcttcttgaggctctgatcttgcccacttttgtaacgccaactctgctaacttttgattaatcggatcttgcgatgctttacgactgtaagctaacactcgctcaggtttatcaaatagctcaagcatgccttgcgctttagcttgtgattttttgccatccagcttcttctgtagatagacgatgaggttacggttacggccttcaaaagcgagtaaagcccgttttaaaacccaatcgtcactcaagcccccaacgcgatcccactcggcaaataacggatcacaagcatcggcgatactggcaccgttaagccacagctttttcgcaccttcaaacgcctcattacgctttccggtttgcagtttggcgttgtagtaatggcattggtaagtttcgccattgggcagttgagtttgaaattgcagcaatgccgaccattttttgctgcgcgctaaagcgtctaaatagggcgcagcgatccgagctgaaaaagggtactctttatgactatcgataaaattgcgtactgcgatcggcggcttactgccgagatcgataagaaaagcgcgataatcgagataaggggttaagggatagctatcgatctgcttacgaatacgttggtattgagcgacattcttttcgtccaaccaacgctgcgctttatcatattgagctctctgcgcttccaaatccaaagtactggcgcttgctgagcccactgcccataccgtggtgaacatcaagatcgaaacaaggctacgcggcttaaataccgtcaggcgcgtcatgagatctcatccttaaaatcagtgtgataacaaattattacgcgtaatctcgccataaatgtaaaggcaagtgaagtaaacttaacgcaaataatgcaacattttattgaatttcccactatcgcgaacgatgaaataaaatctttgcatattaatcgacttattcatcattaacaccttggtgaatcaagggtaattgtattggctgagtgcaaagagttcgcgctcaactctcattagataagaaagcgattaagaattttttacacaggctgaaatgcgggtgctctagtaacaaaaagtcttgctttggtatagaatggcgactttattccgtttgaaagattaggaacgatcggcaatggctgaatacgtatataccatgtctcgggtgagcaagattgtgccacccaagcgtcaaattctgaaagatatctccttgagtttcttcccgggtgccaaaattggtgttctgggccttaacggtgcgggtaaatcgaccctgctgcgtatcatggcaggcattgacaaagacatcgacggtgaagctcgtccacaacccggtttgaaagtgggttatctgccccaagagcctaagttggatgagagtaaaaccgtacgtgaagttgtcgaagaagccgttgcggatgtggcttacgcgcttaagcgtcttgatgaagtttatgccgcgtacgctgagcctgatgcagactttgatgctctggctaaagaacagggtgaactggaagcgctgatccaagcgaaaaatggccacaacctagataatgctctagagcgtgccgccgatgcactgcgcctaccggagtgggatgcgcaggtgaaatacctctctggtggtgagcgtcgtcgtgtggcgatctgtcgtcttctgctggaaaatccagacatgctgctgctcgacgaacccaccaaccacttggatgccgaatcagtggcttggctggagcgtttcttggtcgattacgcagggactgtggtcgcgattacccacgaccgttacttcctcgataacgcggcaggctggattctggaacttgaccgtggtgaaggtattccatggcaaggtaactacacttcatggctagagcaaaaagatgctcgtctgaaacaagaagcctctcaagaaaaagcgcgccaaaaaaccattgagaaagagctggaatgggttcgtcagaatccaaaaggtcgtcaggctaaatcgaaagcgcgtatggcacgttttgaagagctgcaaaatactgagcaccaaaaacgtaacgaaaccaacgagctgttcatcccgcctggtgagcgcctaggtgacaaagtgattgaagtgaaaaacctcaccaaatcattcgatggtcgtgttctgattgatgatctttctttcagcatgccaaaaggtgcgattgtcggcatcatcggcccgaacggtgccggtaaatcaaccctattcaagatgctgagtggtgtagaaaagccggattcaggcacgatcgagctgggtgataccgtgaaactggcctcggtagatcagttccgtgacagcatgaacgacaagcacaccgtattccaagagatttctgaaggtgcggatatcattcgcatcaacaacttcgaaatccctgctcgtgcttactgttcacgctttaacttcaaaggcgttgatcagcaaaaagtgattggcgagctgtctggtggtgagcgtaaccgtgtccacttggccaaactgcttaaagcgggcggcaacgtgctgttactcgacgaacctaccaacgatctggacgtcgaaaccctgcgtgctctggaagaagcgctactagaattcccgggctgtgctatggtgatctcgcatgaccgttggttcctagaccgtattgccacccacatcctagattaccgtgatgaaggtaaagtgaacttctacgaaggtaactacaccgagtacatggagtggctgaagcagactctgggcgcacaagcagcagagcctcaccgtattaagtacaagcgcattaccaagtaaaatactgtcgggtatcacactcagaaaaggtcgccatgcggccttttcttttgctccacagaaaccgagtttgtgattgagtaagcttatttcagcatacatccggtgatttgatgtaccctttgctatgcttgtcctatctatacgtcgtctttgtcagagagaacgccatgatcgaaaaacgtcgcttttcacgcatcctgtatcaagcgccagccaccctaagccaaggcgataaacaactgtctacttgcattcaggatctatcgctgcacgggttgttgctctggtcagaagatgaaccggatttagatactcacgctttagtggatgtggtttttagcctaccagaaagcgatgtaaccatatccctcagcgcaaaaatcatcagcatccaagagcggatcattcgaatggcgatcagccatattgatattgaaagcattgcgcacttacgtcgcttagtggagttgaatgtgggcgatgacagcttactgcaccgagacttagagcatctttctgatttaggactgcatgagtaatcccaagcccaaatggacttgggatgttattgacagtgagagtgacggtgagaggcgaatgatgcattaacctctgtggatcgcatcattcgcttgtttgagcaagttttggctctcatgcataaactgctgtgaataatcaccaaaccactggctaactcgttcaaattgagccacaaaactcgccttatcgcccgcgctcaccaactcaaccgcatcgcttaagcagcgatgaaaacgctggatcatctcaatattttctggtgatgagagaataatatcgccgtacagatggggatcttgcccaaatagccgtccgaccatggcaagctctaaacggtaaatcggtgaactgagtttcagcagttgtgccaagttcgggttctctttggtcagatgcaagccataagcaaaggaagtgaagtggcgcagtgcttgaataagtgtcataccacgatcatgttcatccgcatcaatctggcacaagcttgcgccccaaatagcaaactgttgcaagagccattggtagtgttcattgcctcgaccatcacagtaaacaatcacctgcttcgccaagcttggaacgtctggaccaaacatagggtgcagcccaaccactggacctttgtgcacttgtagcatggcggcaagcggcttggctttgattgaggtgagatcgcacaaaatgcaatcgtccggtaactggcgcagcttttcgataacaccgagcgtcaaatggataggtaccgtgaccaccactaagccagcatcactgagcagttcatccgctttgtcccaatcttggctgcccagcactttgacttgatagccagagagtttaaacatacggccaaatagtcgcccaagctgaccgttaccaccgacgatcaccacggaacgtaactcaggattaaggcatttaaagccggagtccttttcactggcgtaggattcacgcatggttcggcgcaaaatatcttcaatcagttggggcggaacacctttgctttccgcttccgctcgacgtgaagcgagcattgccgcttcacgatcgggagcataaatcggtaacccatatcgacttttcacttgcccgacctgctctaccaatgccagacggcgcgccagtagctccaccatctgcttatcgacttcatcgatttggtcgcgtaactgattcaactctacggccatgttctatccttgttatccttgcaaacgattgtgcaaaaagggaataagttcctgatgcgcacgacgtaataatgcctcagtcgttgaccaatttatacagccgtcagtgatcgagactccgtattgcatcttttcacgaggcagatccgaagactgatttccttcattgagatggctttcaatcatcaggccaatgatcgagcgattgccttcacggatttgatgaatcacatcttctgccaccaacggctgacggcggtaatctttacgtgagttcgcatggctgcaatccaccatcaaagagggttccaaacgcgctttttgcatctcttcttcacattccgcgacagaaaccgaatcgtagttggtctgtttgccaccacgtaaaatcacatgcccattcgggttgccttgtgtcgtgagcagtgccacttgtccttcgcggttaattcccataaagcggtgactggatgaagcggcctgcatggcattaatcgccgttgccaagttaccatccgtgccatttttaaagccgattggcatggaaaggccacttgccatctcgcggtgagtttgtgattccgtggtacgcgcaccaatcgccgcccaactaaaagtatccgccaagtattgcgggctaatcgggtccaacgcttcggttgccagtggaatttccatttcggccaaatcgaccaagagttgacgcccaacatgcagaccgtgttcgatatcaaaactgccatcaagatgcggatcgttaatcagccctttccaaccgaccgtagtacgcggtttttcaaagtacacgcgcattacgatgtagagctggtcgctcagctgcgccgagagtgctttgagttttttggcgtactctttcgccgcatccacatcatgaattgagcaaggaccacagacgatcagcaagcgaggatcgcgtttgtggataatgtccgccaccgtctgacgtgactcacgaataaacttacgcgccttgtcactgagtggaatcttggcttttaaggcatctggggtgatcaatatctgttcattactgatattcacatcactcaattcactttttttcatctcatcacctgtaatttattatttacacacctaacaaggtaagctgcaaacttaaacagaaaacacgttaacaggctttaaaaacaatgcaagtgtaaatttaaaccaacatttaatgtaaattaaaaattacaccactcatttaatgacacttggcacacaaactggggaataaagcgtgttttgttcgctttgagtatcttaaaataagccgtttttccgctcagacgatggacaggttatggatctcatcctctcattactgcaacagatgtgtgtttaccttgttctcgcctatatgttgagtaaaacgccgatcttcattcctttgctgaacatttctggtcggtttgaccacaaaatcagtgtttatgttctgttttcgctgttttgcattatgggcacctactttggcctgcagatcaatgatgcgattgccaatacgcgtgccatcggcgctgtgatggggggtctgtttggtggacctgtgattggttttgcggtgggcctcaccggaggcttacaccgctataccttagggggatttaccgatctcgcctgcgcgatttccaccaccgctgaaggtttaattggcggcttgctacacacctatttgctgcgcaaaggcaaagggaagttactgtttagcccaagtattgtctttgcggtcaccttatttgccgaaattgtgcagatgctgatcatcttggtcgtggcgaaaccgtttgaacagtcttacgcgctggtttccaccatcgccgcgccgatgatcattgctaactcagtcggtgccgcactgtttatgagcatcttgctcgatcgcaaaaccatttttgaagagtattccgcgacgttttcacgccgcgctctgaatattgccgagcgttctgttggtatccttgctgccggttttaacccagaaaacgccaacaaaattgcccgaatcgtgtatgaacagaccaatgtcggcgcggtctcgatcaccgatcgcgaaaaaatcctcgcctttgtcgggattggcgatgatcaccataaaccgaatacaccgatcagctcgcaaagcacgctcgatgcgattaatcgcaacgccatcatctatctcgatggcaaagaacatccttatcaatgttctttgtctccgacctgcaaactggggtctgcgttaatcattccgttgcgagctggcgatcgagtgatcggcaccatcaagctctacgagccaaaacgtaagctgttttccaccatcaatatgtcaatggcacagggcatcgcccaactgctatccagccaaattttgtatggcgaatatcagcaaaaacaaatcctgctctcgcgagcggaaatcaaactcctgcaagcgcaggtcaatccgcattttttgtttaacgcactcaataccatcagtgcggtgatccgccgtgagccagataaagctcgcgagctgattttgcatctgtcgcaatttttccgcagcaacctcaaacagaacgtcgaaaccgtcactttgcgtgaagagcttgcccacgtgaacgcttacctcactattgaaaaagcgcgctttagtgacaggctcgatgtggaaattgcgattgatgatgccctgctagaacgcaatgtcccgagcttcactttgcagcctttggtggaaaatgccatcaaacacggcacctctaacctactcgaagctggcaaagtgcgcatttacagtgaagtggttgaagggggaatgcgcgtcgtggtggaagacaacgccgggctctatcagcctccgagtgaagattatgatggtttagggatgcaaattgttgaaaagcgcctcaccaacaaatttggtcttaagtcagggctacagattgaggtcgcgccacaagagtacacgcgaatgagctttgtcattccacagcaaggcacttactaagggattaacatgttatctgcactactcattgacgatgaacgctttgcccgtgaagagctcgcggaactcttagcggaaagtggccagattgaggtcatcggccaagccagcaatgcaattgaagggttgaaaaaaatcaatcagctcaagccagatgtggtgtttttggatattcagatgccgcaaatttcgggcattgagctgctaagtatgcttgacccagagaccatgcctgaggtggtgtttgttaccgcctacgatcaatatgcgctgcaagcgtttgaagataacgcgtttgactatctgctcaagccggtcgacaccgaacgtttagccaaaaccgtgcagcgtttgctgcgccaacataagaaaagtgactactcaccactgacgcaacccagcttagaccagatcccttgcacgggtttaaaccgaattgtgctactgccgattaatgaagtggaatttgcctacagcgatatcagtggcgtcaatgtgcagactgcgcagcaaaaagcgaccagtcaattgaccttgaaggtgttggaagagaaaaccgcgttagtgcgctgccatcgccagtacttggtgaatttgaaagcgattcgcgaaataaaactgttagaaaacgggctggcggagatgatcactcatgctggccataaggttccggtcagccgccgttatcttaaagagctgaaagagatgctgggattttactgatcccagctctacttctatgaggaaaactattcggagaactgctcgattaagcgctgcatattggctgacgcttgctgccaacgctctaaacgcttcagctcactgtagctaaattgctgctttttcagcagtgcttcagcttgtggtacttccatgatcggaaggttatccagcacttcgaccgccgcctcacgcttgttacagatcaaaatcatgtcacaaccggcgaccaaagcttgatgggagcgctcaactggcccccccattacggctgcgccttccatgctcaaatcatccgaaaatacgatgcctttaaagccgagttcttcacgtaacacttgttttagccagtagctcgaaccgctcgcaggttgagcatcgtaatgcggatacaccacatgcgctggcatcatggcatctagcactccagcctcaatttgcgcacggaaaatcgccatatcttgcgcaatcgtctcccgctcatcgtaaggggtctctaaatgcgaatcggcaatcaccgcgccatggccggggaaatgtttgcctgtggtcgccatgccgacggctttcatgccgcgcagaaaagcactgctgtgcttaagtacagtttgaacatcttcaccaaaagcacggttgccaatcgctttacacgcaaagcccatatcgagcacaggcgcaaaacttaaatcaacatcgtgtgcaatcagctctgccgccatcaaccaaccgccctgctcagcaagctcaacgccattctcagcacgcgcgtaatactgcgcagggggaatgcgagaaaagccttcacggaaacgctgcacgcggccaccttcttgatcgacaccaatcaaaatcggtcttttcgccgcttgacggatcgctttattgagtgccagcaattgctggttatcgtgatagttgcgaccaaacagaatcacaccacccactgtagggtgctgcagaatttcgcgatcttcggcactcagttcgtaaccggccacatccaaccaaagcggtcccatgcttgctccttgaaaaaattggcaaaattgtcacaagccacgaggttattcagtttatttttcaattacaatgcctttgtttgaatatgacagagggataaccaaatggcagaacgcgaactctatatcggtgtgatgtcgggaaccagtttggatggtgtggataccgctttagtggcgctgcaagacgataacatcgaactgctggctcaccacgactaccctattcctgccgacctcaagcagcggctgctcaatgtctgcatcggccagccaaccaccttgattgcgatgggtgaattggagcacgatctggggcatttgttcagtgatgcggtgctggcgcttttgcagcacagtggctatcgcgccgagcacatccgtgcgatcggctgtcatggacaaaccgtgttccatcagcctaccggcaccaaaccttttaccatgcaaattggcgatgccaacattatcgctacgcgcacaggcattacgactgtcgccgattttcggcgcaaagatgttgcgctcggagggcaaggcgcaccgttagttcccgcgtttcatcgcacgatttttcatgctgagcaatcgaccgtggtcgtgctcaatatcggggggattgctaatatttcggtgctcaagcccaatggtgaagtggtgggctatgacaccggccctggcaatatgctgatggatagctggtgccaaaaagaacgtaaccagccttacgataaagatgccctgtgggccaaacaaggcagcgtgaatgccgcattacttagccatttaaaacaagaccattactttgctctgccagcacccaaaagcacaggccgcgagctgtttaatctgccttggttagaaacgcagctcgccacgttttcggttgatgccaccgatgtgcaacgcaccttgtgtgaattcactgcgcaaaccattgttgagcaagtcgcaccattcgccgaagggccacaaccacagcttttagtgtgtggcggcggtgcgcaaaatcctttactcatggaacgcttacaagccttgctgccaagctggcaagttgccccgaccacccaaatgggcgtggatggcgataatatggaagccatggctttcgcttggctggcacaacggcgtatacacggtttacccagtaatttgcccgccgtgacgggcgcatcacgtcttgcgagtcttggcgtgatttactaccccgattaatcgctacaggaatttttatgaccaacgatgcacttatcgccgcgctttctcatctggtttccgaaggtcgtaaccccgatacgatggatattgatttgctctcatcgcaagaaattgtcgagcggcttaatcaacaagacaaacaagtgccactggcggtggaagcggtattgccgcagattgcccaagcggttgataaaatcactgccgccttcaaacaaggtggccgcttgatctacttaggggcaggtaccagcggtcgtctgggtgtgctggatgcctcagaatgcccacccactttcggagtgagcgatcaaatggtgattggcctgattgccggaggcaaagaggcgatgtttaccgcacaagaaggggcggaagataacgccacgctgggcgcacatgatttacagcaaatcgactttagcagcaaagatgttctagtcgggattgcggcgagtggccgcacaccttatgtgattggcgcgttagagtacgccaatgatttaggcgcgaccaccatcgcactctcgtgcaaccctgattctccgattgccgaaatcgcccagattgccatttctccggtcgtcgggccggaagcgttaacgggttcaacccgacttaaatccggtacagcgcagaagttggtgctcaatatgctcacgactgccagcatgatccgccttggtaaaagctatcaaaatctgatggtcgatgtccgagccaccaaccgcaagctgattgcccgagcggtgcgaattgtcatgcaagcgaccgattgccaacgcgaagaagccgaagcactactcaaagagagccacaacaacgcaaaactggcgattttgatgcatctgaccggcatgaactacgagcaagcgacggcgaaactctcgcaatcggacggcttcttacgccgcgccatggaagagcacgaagagtaattagccagagcaaaacgagagccctatgggctctcgtgacttttgatcagagacacgacaatttcgccctctttcggcgcaaaactcgccacatcctgacacatctgcacccgcccacgactgtcgactgaaaacagcggcaaaacaaaactctctttgtggatttgctgataatcctgataagtgaagttttcgctcaatttggtgtgcttcacttccgcaccttggccgaccaaactcgccagttttttgtaactcacttcaccacctagaaacggcaagccatgatattcctgagcgacgagatgcttttcactgacgttattggttggattatcgttgaggcaaaacacacgcttatcgccaaaatccgataaaaactgcatacaggccatgatgttgaagtgtttgtcagggctcagagctaacacatgcccaatcccaatcaaattaaggtaatcctcggcatggctggaaatcgggttgccgtaatagtgctcaagcccggtcattcttgcttggcgaatgtagtcccagttggaatccgtcaccaccactcgacaatcgtacttagcgatcgctaaaccgacctgacgcgccacatcattggcaccgatgatcaagaagcctttcggcgcaggttcagacactttcaatgccaacgccattggtcgagcagtcgcactttgcagcacgacagtgccaatgatcaccataaaggtcagcggcactaatagcttggcatcagcgatgccaaactccatcaatttgatggcaaacagagaagagatcgaagcggccacaatcccgcgcggagccacccaagctaaaaaggctttttcacgaacattgagcgtgctgcgcaacgttgaaatgaagatagacgcagggcgagccagcagttgcatcaccacaaacagccccaaggcgctccagcccaacgcttggaaatccgccacttcaatccgcgccgcgagcagaataaacagccctgtgatcagcaaaatcgttaagtgctctttaaagtgcaagatgtgctgaatattgacccctttggcattcgccagccacatccccatgactgtcactgtcagtaggccagattcggactccaaggcattagacgcagcaaacacaccgagcacaacactcagcaccgcaaacggctgcaagtactccggcaacaggcctctacgcagtaccgccgccaccgctactccagaagcgataccaatggaaaaaccgaccaataaaatcaggctaaacacttctaggctatgagcatggctgctggatacgataaattcatacaccatgaccacaaacagtgcaccaagtgggtcgattaaaatcccctcccaacgcagaatattcgctaaacgtgcggttgggcgtactgtgcgcagcaaaggcacaatcacggttgggcccgtgaccacagtcaaactgccaaacatcagtgctaacggccattcaaagccaagcaaccaatgcgcagccgtgctggtgatcccccatgagacgagtgcgccaaccgtgacaatgctccacactgtattactgacgccgcggatctctttgaaatttagagtgagactgccttcaaacaaaatcaccgccacggcaagtgaaacaagcggaaagagcaaatcacccatcagggcttccgggtttaacaccccaaatactgggccagctaaaatccccgccaacagcaaaaataagatggctggcagacgtaaccgccaggctaaccactgacatcctaaaccgactacgccaaccgcagcgatagtcagagcaatagactcttcgtgcatcattgcacctcttatcggttattgattgtactcattccaaccgcgttgccactccatacgaaaacgctgcgcctgctctgtaccttcacaaatcccttcataatattggccgctcaagccaatttggtaagccacatcagggttacaatattgctctaatcccttttgatagccttgttcataatcacccagtttggctgagccgagctccattaagcttttatagctgcgctgggtatgaccggtcacggcatcctgataaccgatttgataccagttgccctcttgtactaactgtgactcactcgctgcacaagcggcaagcagcacaatacagcccattactatccattttttcatgttttaccttgagttagacgaacgcattttgttgatgaaatgagcatgccattgaatagcatagcctgctactcaattttcatgctcgcgtcgcggcttcaagtcagaagtgggtatattcaaaaccacttatttagctaaaacaccgcttaattcaccacacgaccactgactcggaaagccagtgaagctcgcttattgataaattactatccacagtgagcttaattcattaacaaaaggacaaacgctatgttgtggtttctaacctgtgtcgcagccctcgttggcggttactttatttacggagctttcgtagagaaagtatttggcatcaacgaaaagcgtcaaacccctgcccatacaaaaacggacggcgtcgactatgtaccgatgtccaccccaaaagtttatctcgtacaattactgaacatcgccggtgttggtcctatctttggtccaatcatgggtgcgctgtacggtccagccgccatgctgtggatcgtagttggctgtatcttcgcgggtgcagtacacgactacttctcaggtatgctttctatccgtaacggtggtgcttcggttccatccatcacgggtcgttacttaggcaatggcgcaaaacactttatgaacatttttgccattgtgttgctgcttctggttggtgtggtgttcgtttcagcccctgctggcatgatcactaacctgattaaccaacaaactgacttcaccgtcagcatgaccaccatggtcgtgatcatcttcgcttactatattctggcgactatcgttcctgttgataaaatcatcggccgtttctaccccctatttggtgcgctactgattttcatgtcggttggtttgatgacggcgattgcgttctcttctgagcaccaagtgctgggcggatttgaaatcagcgatatggtgaaaaacctcaacccgaatgacatgcctctgtggccggctctgttcatcaccatcgcttgtggtgctatctctggcttccacgcgactcagtctccgctgatggcacgctgtatggaaaatgagaagaacggtcgcttcgtgttttacggcgcgatgattggcgaaggcatcattgctcttatctggtgtactgttgctctctctttcttcggctcactggaagctctgtctgaagcggtgaaaaacggtggcccaggtaacgtggtttacggtgcttctttcggcctgctgggtgtgtttggtggtgtgattgctttccttggcgtggtgatcctgcctatcacttcgggtgataccgcgttccgttcaagccgtctgatcttggctgaatacttcaacatggagcaaaaaacactgcgtaaccgcctactgatggctgtacctctgttcgttatcggtgcagtgttgacccaagtcgatttcggtatcatctggcgctacttcggttttgcgaaccaagcgaccgcagtcatgatgctgtggacagccaccgcttacctgatgcgccacaacaaactgcactggatctgtacggtacctgcgctgtttatgactacagtgtgtatcagcttcatccttaacagcagcacgttaggttttggcttaccaatgcagatttcaaccattgcaggtgtactggcttctctgggtgctctggcttacgtagcgaaagtatccaaaggcaaaggggaaaccgatcttgccgatgaggagaaaccacaaggcgtgacgaaaaccgcttaatctcgacgcttcaatcacctgattgaaaacgaaaatggctcccaatctgggagccatttttttgtgcgatattcctttgtaaagaaattgcaaagaaaccatccattttggattcacaagatggatggagaaatgactagtcgacttgcttaatttgcagctctttaggcacttcaaagaacatgttctcttcgcggccaagcacctcttctaccgacgttgcgccgagctctttgatgcgatccaagatttggtttaccaactcttctggtgccgaagcgcccgcagtcaccccaattaactgcgcatcaacgaaccactcagggtcgatatcctgtgggcagtcaatcaagtaaccgggagtgcccaacttctcagccaactcctttaatcgagtcgagttcgatgagtttttcgagcccaccaccaccatcacatcgacttgctcagccaagatacgcactgcatcttgacggttttgggtggcataacagatgtcatctttacgcgggccttggatcttcggaaatacacggcgcagctcatcaatcacatccgccgtttcatcgactgacaacgtggtttggctcacatagtgcaggttacttggatctttcaccttagcttgcagtgatacgacatcttctggcttttcgaccagatacatgccgcctgtatcactggcatactgccccatcgtgccttccacttcaggatggccagcatgaccaatcaacaccacttccatatgtttgcgactggcacgcgccacttccatatgaacttttgtcactagtggacaagtcgcatcaaataccgtcaatgaacgctctttcgcttcttggcgaaccgcttgcgacacgccatgagccgaaaaaatcacaatgttatcgtcgggaacttcatttaattcctcaacaaagcgggctccacgctgctttaacccctcgaccacaaagcggttgtgcaccacttcatgacggacataaatcggcggctgataaagctccagcgcacgctcaacaatgctgatcgcgcgatccacacccgcgcagaaaccgcgagggttggctaacagtattttcattggtttgctcattgctagtcgttatggttggctattgtaaggaaactcactcaacagacaagatctcaacatcaaaggtgatgtcttgccctgccaatgggtgattgaaatcgacagtcactgagtcaccggcgatctccgtgatgattccgggaatttccattccgtcagggccactgaaagccataatggttccgacctctaactgcagatcaccaccaagaaacttactgcgatccatgtaatggacatgatctggattgggcgcgccaaacgcatcttgcgccgctaaagcgaccgattttttctcgcccggcaacattccgagtaaacactgctcgaaattggggctcaggctaccatcgcccatcactagcttggccggttttccttgattatgggtactgtcggcaacagagccgtccttaagcttgatcgtaaaatgcagggtaactgcagagttagaggcaatagggttcacgttatcactaccttgttattgtttaacgaacgccgcttcactttagcggcgacgagcgggcgctgatgccagcctttatagtaaaaagcgccctccgaatcaacggacggcgcttgtggttatttgccgcagtgtctttgctttacggcgcaatgcagagcactaagactgacttggtgcacttttcttagcgcgaaaaccatcgagaataatcatcgctgcgccgatacagatcgtactgtcggccaaattgaacgctggccagtggtaggttccccagtaaaaatcgagataatcgaccacaaaaccatgcacgatgcgatcaaacacattgcccacggcaccgccaatgatcagcgcataagcaatattgttccacttatcactcgccggaagacgacgcatccagtaagcgagcataccggtgaccacaaaggcaatacccgtaaatagccagcgctgccacccttcctgatcgctcagaaagctaaaagccgcgccatagttatgcacatacagcaggttaaagaaaggcagcacctcaatacggtttgcccaaccatagcccatgttatccatcacaattaacttgatcgtgatgtcagcaatgaacaccagaagcgccagccacagccagcgcaatccagattgtttaagagccagagacgaattcgacatgatggttagcctaagttacgcaaacttgcgtacttcgccttcaccctcaacgttagacacgcagcgaccacaaatggtggtgtgacctgcaatcgtgcctacatcaggggtgtggtgccaacagcgatcacacttctctgcttcggttttgttcacttgaacaaacaagccatcgatatcggtcgcctgtgcagcctcgctcttctcagccagtggcttcaccacggcttttgaagtcagcagcacgaaacgcagctcatcgcccagtttcgctagcttactcgccaatgaatcatcagcaaacagcactaattctgcttgcagtgaaccaccgatcagtttttcgttacgagcgttttccagcagtttgttgactgagccacgcactttctgaatatcattccagaatgcgttatttagctcttcgccttctgccaaaccaaacaggccatcaaaccattccgtggtaaacacgaacttgtcacgtgcgctgccgtcagcttgctgcgctggcattgcgttccaaatttcatcagcggtgaatgacatgataggcgccatccaacgaaccagagcttccacaatgaagaacagagcggtttgacagctacgctgtgcatgaccaccacgtttggctgtgtattgacggtctttgatcacatctagatagaaagatcccatctcgattgagcagaagttcatcaaacgctgtaccactgcgtgcaggttgtaatcctgatacgcttgaatgatctcttgttgcgcggccagtgcacgaccgacagcccaacgatccaacgccaccatgtcttcaacaggaatgatgtctgtggttgggttgaagccgttcaggttcgccaagaagaaacgtgcggtgttacgaatacgacggtacgcatccgcagaacgcttgaggatctcatctgataccgcaacttcaccagtgtaatcggttgaagcaacccacagacgcagaatgtcagcacccagcttgttggtcacatcttgtggagcaaccacgttaccgatcgatttcgacatcttgcggccttggccatcaaccacgaaaccgtgcgtcaatacttctttgtaaggcgctttgcctttcatcgccaccgaagagatgagggatgattggaaccagccgcggtgttggtcagaaccttctaggtacatatccgcttctgcgccgttgaattcttgacgtgcatccacaaccgcagagtgagtcacccctgagtcaaaccatacatctagcgtatccagcactttttcatagttggccgcatcttcagcgccaagcagttccgcagtatcgagatcccaccatgcttgaatacctttttgctcaaccagttgcgccactttctcaatcagatcagcgctgtttggatgcagttcggcggtttctttgtgcacgaacagtgcaatcggcacgccccaagtacgttgacgagagatacaccactcagggcgacctgccaccataccttcgatacggctttgaccccaatccggcatccaatgtacgcctttgattgccgtcagagcttgttcacgtagacccgcttgttccatagagacaaaccattgtggtgtcgcacggaagatgatcggcgttttatgacgccagcagtgtgggtagctgtgctcatacgcgtgatgatgcaacaacgcgcctttttctttcagcacttccaacactgaatcgttggctttaaatacgtgttgacccgcaaacagctcagtgtctggcagatatacgccatttgaacctacagggtttgccacttccaaaccgtactgttgaccaacggcaaagtcttcttgaccatgacccggcgcagtatgtaccacaccggtaccagaatcggtcgtcacgtgatcgcctaaaatggcaggcacagtgaaggagtagaatggatgttggaactgtactaattcaagatcggcaccagttgcgaaaccaaggttatggaagtgttcaatgcccgcgcgatccatcaccgattttgccagctcagaagccacgataatgcgctctggttgctcaccttcaacttggatcagtacatattctaaatctgcacgcagacataccgcgcggttagctggcagtgtccaaggtgtggttgtccaaatcacaatcgacacatcgcctttgccttcatggccagcagccagaccaaacttagccagcacagcggcttcatcagcggctttaaaacgaacgtcaatcgaaggagaaactttgtttttgtactcgacttccgcttcagccagtgctgaaccacagtcggtacaccagtgaaccggtttaaaacctttcagcaagtggccgttatcagcaattttgcctagtgcacggatgatgttggcttcggttacgaagtccatcgtgcgataaggcttatcccactcgcccagaataccaagacgcttaaagctctctttttggccttccacttggcctgccgcgtattcgcgacacttttcacgaaattcggccgcggtgactttttgccccggcttgcccactttcttctctaccatcaattcgatcggtagaccgtggcaatcccaacccggaatataaggcgcatcaaaacctgacagggttttcgatttaataatgacgtctttaagaatcttgttcagagcgtggccaatatgaatatcaccgttggcgtaaggagggccatcgtgtaatacgaaagattttttgccttttttagcctgacggatcgcaccgtacaggtcttcttgataccaacgttgcagcatttctggctcgcgtttggccagatcgccgcgcattggaaaccctgtttcaggaaggttcagggtatctttatactcactcatcgattcttaattccgttatattgggcgaagttagacatgttgttgctgggtggaatcaaccgagcaacccttaagctgacgcagccacacccttgctgcttcagcatccaattcaatttgttgctttagtgcctcaaaagaggcgaatttgcgctcatcacgtagtttatgtaacagcgcgacttccaactgctttccgtacaggttgccttgaaagtcaaaaaagtgcacttctagctgctggcgaacaccatcgaccgtcggacgattaccgatattggcaaccccaccgactggcgttgggcccaaaccataggcttcaaccacatacactccagaaaccggagaaacacaacgtttcagtggaatgttggcggtgggaaagccgatcgttcgcccgagtttttgaccatgcgagacacgaccgctgatgctgtaatggcgccccaacatagccgaggcactgctcaattggtcagccgctaacgcttcacgaatcgcggtgctactcacgcgcagttgttgcaaacagaagctttgggtgctcaccacctcaaaatctagggcttgccctgcctgttgtagcagcgcaaagttaccttgacgctctttaccgaagcagaaatcatcaccaaccaccagaaacttaacacccaaacgggtcaccaacaagtcacgaataaacgtgtgggcatccaattgggcaaaatgatggttgaaattaacgcacagcaggcgatcaaccccgagtttgctgagttgcacaaacttatcgcgcagacgtgttaaacgcgcgggcgcttgttgtttggcaaacagctctaggggctgaggttcaaacgtcatcactaccgaaggcaaacccatctgctgggcacgctgcaccacctgactgagcacttgttgatgaccaagatgaacaccgtcaaagttgccaatcgtcaatacacagccgtgatggcgagattgaatgttatgaataccgcgtattaattccatcggaagatgcttaaaacctatattttgattctcatggtgcgaaactggcggattatacctaaagctcgctactctgtcgccgcttttagatctttgagacgaacacccagtaacagcaaaatagccagataagatgccacgccaaggccaatcaagcctgtcagcgtcaatgcgcgctgactgattccccagctcagccatgtagccatagtgtctaactgccacaaaagcgcaccagtcattaccgctcccgccatcgccagtcgcgcaacaaaccagacggttttgcgagtcagatgataaacaccttgtaagtgcaaaccacgataaagcagtgccatattgaggaaagcggacatcgaagtcgcgaccgccaagccaacatagccgtaaaaccacgcaaagatcgcgttaagcacaatattgctgaccatagcgataattccgtaacgtacgggggttttcgtgtcttgacgtgagtaatatcccggcgctaacactttgatcaacataaagctgagcaggccagatgagtaagcgagtaacgaataggacgcttgctctacatcgcttggagtaaattccccgcgcataaacagcaccatcaacataggttttgccagtaccatcaaacccagcatggcaggaatgccgagaaacgtgaccatgcgaatcccccagtccatggtgtgggcaaagccatcactgtgcgcatcaacatgtttacgcgataaggcaggcaaaattactgtggcaatcgcaatcccaaataaaccgaggggaaactccagcaggcgatccgaataatagagccagctgatcgaaccggtttgcagaaaactggccacgaaggagtcaaataacaagttgatttgactgaccgatactccaaacagtgcaggaatcatcagtgtgcgaattttcaccaccccaggatctttccagccccatttaggcctaaccagcactccagccttgatcaaaaatggcagttgaaataaaaactggactaaaccacctaaaaatacgcctattgctaagcccacttccggctgttctagatttggcgagaggtaccaagcacacagaatcatcatcacgttcaagaaaactggcgtgaaagaggagacggcaaacttacctaaggtgtttaaaattgccccagacaaggcaacaaaggtgataaaccacaaatagggaaaagtaatcttgagcagtaagctcgctaactcaaactttcctgctgcaggccccccattcagccagtctaagaaccaacctgcgccaaataatgcggtgactgcgccagagccgagcacgccaattagcgtcactatggtcactaaaacaccgagagttcccgacgctcgcgcaattaaatctcgagttttattgatatcacccgaggcgtgatattcggttaagaccgggacaaatgcttgagagaaggccccttctgcaaataatcggcgtaaaaaattgggaattcggttggcaaaaaagaatacgtcagcactggcacctgcgcccatcaaattggccacaaccacatcgcgcactaaacctaaaacacgagaaatcaaagtcatagcacttacaatgatgccagacttgagtaagcgtttactcacggtaacctcgaacaaagagtcaaaaccacattatctgattcgaaaggataagaatgtcatagtgagatcagataagtattagcattggtaaaaaaatgctgatagaatccccgccatcttaaccgcgaaggctcttcgataccaagtttgtttggtccagttgggtttttgcacaaatcatttgacattaaagagcaaatcggggatatttcccgcccttaaaatgtcaccgaactaagtttttgggagttagacccttggcaaataacaaatctgctaagaagcgcgctatccaagctgagaaacgtcgccagcacaatgctagccgtcgttctatgatgcgcacttacatgaagaaaactgttgctgcaatcgctgctggcgacaaagaagctgcaactgctgcattcgctgtagttacaccaatcctagaccgcatggcgactaaaggccttattcacaagaataaagcagctcgtcacaagtctcgcttctttgctgctatcaacgctctgtaatagagtttgatcttcagcaacaaaaaaccggcctacgccggtttttttatacctttttttcgaccaccctactgattcgcctgacaataaagacggtgcaacagttcaatcatcgccttcacttctgtactgctcaacgtataaaacacagtttgcgcttctttacgtgtattcactaaaccatcacgacgtagccacgctagatgttgagaaagagcagattggctgagttccaaacggctactcaattcccctaccgacagttcattgtccagtaacatacataaaatttgcagtcgccgctcattggccatcgctttgagcaaaactaccgctttggcagaatttttttccatctcttggagattcattggtgccccctttaaatacggcattttaattccaacccattcattcacttttctctgtcgttctaatcaccgatgtcgtaattcggttgagtgatcatgatgggtcgaaatggtgaaagcggagaaaactcgctgataatgataaaaaactaatcaagaacgctagtttattgttttcacttatcattgggtagtgatcaaagacttaacagtgataattattcacaaaaataagttagtaaaatcagcatcacagacattttttactgctgggtgctggatcatgcgttcagcgaagatgacataatactcctctttaatctcatccacatgtccgatgagtttcaatgatgattccgcatccacttctgagacataaaaagagggagccataaacacggcatcactgtgatagatagcaaacgctttcattaaagcagagtcatcaaattcaccgagaatatgtggttgtaacccttgacgatcaaaccactgccgcactttacgccccattgcggttcgactgcctggaactaacaattttttactctgcaacaccgcggggaatggcgcaaaatccacgtcaccaaagctgaaaaaactcatgcgactctcaccgagttttttactaaataagccgggactttggctcgaatccactgggcaatcagataagatcatatccaacttatgctgggctaactgctctaatagcatctcatgggttgattcaaagcagcgtagatgaatccggttatcaccgggtactgaggtcagcaatattttgctcaccaatcttttggataaggcgtctgccacacccacatcaaacaacaagtttgaacgctggctatagttaacgatatccaacatttcataactcaagccaaacatacgatcagcgtatttaaagaccaactgtcccaattcagtcggctcaatactgcgcccattacgtttcgtcaacttaccatcaagtcgatcttccaaagctttgatctgccccgtcacggtttggggcgttaaaaacagagcatcggccgctttggttaccgagccttgtttacacaccatccagaaataatagaggtggttatagttaagatgagacatgaaatcgactacccgctagaaatcccgttttccttataacagatgcgatcttttacaacaataagttcggataaaccgaaacaataaaccgtttagttaggatttttcataaacaaaaatacgaactgtcataaactgatagcacccgcggcctatcgacaagctcattacacactttgttacaacccaaccaccaagtggcaccggtcacaaacccattataaaacataaagttaacaaaacccttgtcactcattttttaagcatgttgcaatattgacgaataactcatcagttacaccgaaatgtcatattagtgaaatatttcctctctaccatcagcctcgaattcaacaatcgaccgaacccttaacaacggtccacggagaaaataatgataaaccaagcaacttcccctgcagcgccgatttcgctgaccacgaaaggcctacgttgggcaaacttggctttcatgctgtatttactacttcttgcagtcgcgatggtcggcagcggttttaaatgggcaaccggcgatcaagccaaagttctatttgaatttgcttcccacccaattgcaggattgatgattggtttagtggcaacggcactgattcaatcctcaagcacggtgacttctattattgttggtctcgttgccggtgggttaccggttgaaaccgcgattcctatggtgatgggtgccaatattggtactactgtgaccaatactctcgtcagccttggccatatgcgctgtaaagaagagtttcgccgtgctttcgccagtgccaccatccacgattttttcaatcttctcgcggtgctgatcttcctacctctagaaatgatgtttggaattttagagaaagtctcacactggctcgtttcgcctctgcttgcgactggcgatatgagcatgaaaggttttgactttatcaaaccgattaccaaacctgtcataacaggtcttgaaacccagctttcggtattgggtaatactttcggtggtgtcgcacttatcgtattgggtatcgcgaccattttcgtcgccattacggtgatgggcaaactgatgaagagtttgatggttggccgtgcacgtgaaattctacaaaatgcgattggccgaggtccactacacggtattgcttcaggtacagtggttacggtattagttcaatcatcctcgaccacaaccagcctaatggttcctctcgtgggctctggcgtgctgaaagtgcgtgaaatctacccatttaccttaggtgcgaacattggcacttgtattactgctctgctcgccgcaaccgctgtctctggtgagtttgccgtgtttgctctgcaaattgcgctggtgcacttaagctttaacttgatggctacggtcttgatttacggtattcctttcttacgcgaactgcctattaaaggtgctgagctcatctcaacttgggcttgtaagagcaaaatggtggtggtgagttacttattgggtgtgtttgtcgtcatccccggcagcattcttgccctaaccgcttaagcgttaaagcatcatctgtataaaaaaagctcccgaccttcgggagcttttcctatgtaaaacccatcaagccataccgcctgaatacgggattagactgaaaacgggtattgaataggatcgtggaactgatatccggtgacgtcaaaatcatccaaagtgacccaagtttccaaatcctgcagtgttttaatctttggattgatatggaactgaggcgctgggaatggctcacgttttagctgcacatcgcgcatcaattcgagttgatcttggtaaatgtgcgcattgacgatcttgtgatacgccaagcccggctttttccctgtgatctgtgccatcagcgcaaggaacacataaacctgcaccatgttgaaattcaaccccaagggcacatcacatgaacgctgagtactgttgagatacaaggtatcacccagcaatgaaaaatgatggctgtacatgcaagggcgcaaacaccccatgtgaaattcacccggattgtagaagttaagaatttcacctcggtcatcaacgccacggctcaaatcatcaacaatctttttcaactggtcaatatgaccaccatcaggcttagcccaagctctaccctgaactccatacacgcgtcccatgtcatcctcacctttacggtaaggattgttgagccatgcttggtttaaattggcattagcatcccaggttttggtacctaattggcgaaaatccgccgcattatcgtaaccacgaatatagccgagcaactcggccacggcggctttccaaaaactcttgcgtgtagtgactagaggaaactgattgttgcccacatcgtaggtcaaatcggcattaatcacagtcaaacaacgcttgcccgttcgttcattttcaacccaaacaccttgatcgacgatgcgctgacaaagatctaaatactgtctcacctaactaccctattttgctgctacacggtcttgatacaaaccgcgcttgtaagaccaaaccatcatcaaaataccgatgatcaccataggtaaggagaggatttgccccattgaaatgaaaccaccaaacagccccaactgagcatctggctcacggacgtattccacaaggaagcggaatgtaccgtatccagctaaaaacagtccggatacgctgcctagcggacgaggtttaccaataaaccaattaagaataaagaatagaaccacgccttctaaggcgaattcataaagctgtgaaggatggcgcggcagtgggccaccattagggaatacaaaagcccaaggcacatccgttactcgtccccaaagttcactattcataaagttaccgatacgtcccatccccaaaccgaatggcaccaagggggcaacaaaatcggccacaccaaagaaggtgcgttggtttttacgcgcataccagaacatggcggtgatcacacccaataagccgccgtggaaggacataccgccagtccacactttgaataaataaagagggtcagcaaggaacagatcaaaattgtagaagatcacataaccaactcggccaccgatcactacacctaaaaagccggcgaataacaagtcagagacttgctcacgcgtccaaccactgcccgcgcgatccgctcggcgattggccaaccacatagcaaaaaggaaacccaccaaatacatcaagccataccagcgcaccgctagagggccgatcgaaaacaatacggggtcaatattgggaaactgcagataaccctgaggcataacaaaccttctctataaacaatgagtattactggaacaacatggtcacagcgacgcacattaaaaaaatggcaaagaatcgcttaagccttgctgttggcatttgggtggcaagtttagcgccaattcgcgtggtaagcatcgatgttgtagcaatcgctaacaatgcaggtaaataaacataaccaaggctgtattgtggtaagttctccacttgataaccgtgcaaaataaaaccaatcatgcccgatatcgcaatcgcaaaaccacagaccgatgaagaacctatcgcctttttcatttcaatgccatgtcgattcaaaaaaggcaccgataaagaaccgccgccaataccggccaaacttgagatcaccccaattccggtaccgcacaaggtggtaatccatgcacttggcattggatgattttgtaatgcacgtatcgaacggtacatctgcacactcaaacagagcacaatgaccccgaacactttgggtaaatattggcttgggatccattctgcaaccactgagcctaaaaacccaccgaccaccacacccggcattaaccatttcacgacaaaaacatcgacattacccagctttagatggtttagtgccgatgagcctgatgtgagtatgatcgtcgctaacgatgtggccagcgcaagctgcatcacaatctcggtcgagatgccagcataaggcagtaaaaacagtagagcggggaccaccagtaagccgccaccaatgcccaataagccagcaagcacacccaccactgcccctaacagcagcagtatagctaagagttcaatattcacatttggttcctattttttgcctgcacggacaaaacctgcaaaaccgtgtttttcgatataggcgagcatcatattgtagatttctcgtccataaggttgggttaatgcctgctcagcgagctgggttaattccgccagttcagagtgtcgcaccagatatttcactttagcgacgttagacgtgttcatacttaaggtggtgtagcctaaccctatcaacagcaaagcaccaatcggatctccggctaactcaccacagacacacacgggtatttgatgggtcgcgcaagtctgttggatctgcttcagtgccatcaccaccgcaggatgcatagattcatacacatccgccacacgcgcattgttacgatcgacggcaagcagatattgggtcaaatcgtttgtaccgacagagacgaaatcaattttatcggcaatcagtggcagcagatacagcatcgaaggtacttcgagcatgatcccgatttgcggcatcaccacgcgtggatcttgttgcgaaacttcttgataggcttgatagataaatttcagcgcatcatccagctctttggcaccggaaatcatcggcagcaagatggataaattccccgactccgcacttgctctgagcatggcgcgcagttggataataaaaatgtcaggatgatctaaggtaaaacggataccacgccaaccgagaaatgggttgtcttcttcaatcggcaagtaaggtaaaggcttatcaccaccgatatcgagcgtacgcataacaacacgttgatgagggtaagtgttcagcacatgccgatattgctgagtctgctcctcttctgagggaaatcggtgctgcagtaagaaagagatttctgtgcgatacaacccaacgccatccaccccttgattgacggcaatactggtatcggcactcaaaccggcattcagtaacaattcgattcgtgcgccatcaagagtacatgcgggctcacgaatcgcctcattgaccatgcgcgacagctcacgctcttcattcgctaaggcacgatactcattcagaattgttttcgaaggcgaaatgaataacttaccgctgtagccatcgacaatgccttttttgccattcagatcgcgcaggttaatcgatacccccatcaccgcaggaatgcctaacgcgcgcgacaaaatagccgcatgggagttggccgcgccttcaagagagacgacagccagcagcttatctttgggcagtgcggctaacacgctcgcggtcagctctcgcaccaccaagataaccggcttatcaattttgggctgattggtttcggtattgagcaagaaaaacagtaaacgttgtcctaactcacgaatgtcttgcgctcgctctcgcagataaacatccgacatgcgcgcaaaacggttcgaataactttcgaccacttggcgcagcgcccaatcggcacgatcccctttttggatctgcgctttgagatctttccgcagcataggatcgttcaataagtgagtgaacagatcaaaaatggctaacgcttctttgttgatatccccatcgagctttttacgcatccgacgaaaatcggccagcgcattctctactgccaaggcaatacgctcttgctcaaaatcaggatccagagctgaggcgggtagcacttcggacagatctggctgggtatcatcccaccaaaactcaccaatcgcgaccccagaagaggcggcaacacccgtaatggcctgctgctttttggataaacgccagtgaccttgcgtttgagcatgcgccaccagcaccgcgagctgcgcagcaagggtaactaaaaaggagacttccatctcgctaaataaacggggagatttttgctgcaccaccagcacaccaagcacctgtttgcgatagatgatcggtgtaccgaggaaggagtgataaacctcttcacccaactgcttaaaatatttaaagctcggatgttttgaggcttcggctaagttaatcggttcggcagaacgtttaaccaacccgaccaagccttcatcaaaatcaatatggatcttatcgcccttgaacttcagaccttgtgtggccatcaattccagacggtgcatctcttcattcgctaaatagacagtacaacactctgtgctcatcgcctcacaggtctgctttacaaaaatatccaacgcctgatagacgtcttcgacttttgaaacttgttctactatgtcccttagctgagaaagcatgcttaacctctgtgagtgttgcgtttgcccttcactttccgttctttaaatggcatcgctaatgaggcgaactctttcattgcgcggcgataaacatcacgcttaaacgacaccacttgcctaaccggataccagtagcttacccagcgccaaccatcaaactcaggggaactgccacgttgcatgttgattttcgactcatcacattccaaacgcagcaagaaccatttctgtttttgtccgatacagacaggttgagaatcccaacgtaccaaacgctttggtaacttataacgcagccaatgacgactggttgcaatcactttgacgtcttttttggttaacccaacctcttcgtatagctcacggaacatggcttgctctggagattctccatcatcgattcccccctgagggaactgccatgaatgttgcccgtatcgtttcgcccagaaaacctgaccatggttgttacaaatcacaatcccgacatttagccggtaaccatcgccatcgatcactggcaaacctctagtaaattctttaattgcgttgatttttccacatatccccaagcggagcaaacttactattgtgattagcccgatatttattagtaaatgggataaaaaaggataagttctgtgccagttctaagttatcaacaattttatgagacataccgcgcatttattcacgttttctgtgaataaccgtgtgaagaaacttgggggctgtgtaaaaaaaggcatttatcaacaatgaccaatctaacaaccagaaagaaaaacaacaaaaaataactgaaaaacaaaaggttaaatcaaatcattccataatcagaaacttaacctaccagaccacatgaagatcctcaccagaaggttaaagatccatcaattcgtcatccttacacctttgtgggtgctcaatcgtcgagagaagcatcaatccaatctcagtaggccctctctgggtactgtttattgatccataccttagcctactctcaagccaacaaaataaagctgtggataacctcatcaatagacctcttaatctcatttcaagcatcaaaaatcgttcatccatggcaagcgcaagcaaaatcagtacaatccccactgtgattatccaaaccgaaagcctttatgaaaccagcaccgacgactcaacaagaattactcacgcgagcccaacaaattgcagggctaagttttgctgaactcgccgatgaagcaggcatgaccgtaccgccagatctgcgtaaagacaaaggctgggtaggccagttactggaatggcacttaggggcgacagcaggcagtcgtccacaacaagattttgaacatctcgggattgagttaaagagcattcccatcagttacaccggaaaaccgttggagaccactttcgtttgcgtcgccccactcaccggagttcatggcttaacatgggagcaaagtcatgtgcgcaataagctctctaaggtgctctggatcccggtacaaggtgagcgcgagatcccgctcgctgagcgctgtgtgggctctcctttgctgtggagcccttctcccgaagaagaagcgcggctcaaagcggactgggaagagctaatggaatggattgtgctgggtaaagtggcacaaattaccgctaaacacggtgaagtgctgcaactgcgccctaaagccgccaacggtcgagcgctcactgaagcctatggggccaacggacgcccaatcaaagccctgccacgtggtttttatctgcgtacccaatttactgcgcaaattctgcagcgctattacgcctagttatcttcacaacgatcttttttgttttcgcagtgtcgtgactcgcttatagtgaaaaaactgtctccctcgtgactgggttctctttgtggcgacagcgcaaacctctgtgatttttcttatttcgaatgtaacgaagtcgccaccatcactcggcttcaacttccaatacaagggaatatcattcgttctttggctctaagacaaggaagtgctatgcaatataccaagctgcctcattccagcctcgaaatcagcaagatctgtttaggtaccatgacttttggtgaacagaattcgcaagctgatgcctttcaacagctcgattatgctctcgagcgtggagtgaattttatcgatacggcggagatgtatccggttccgccaacggcacaaacccaaggtaaaaccgaagagtttattggcaattggctggctaaatccggtaagcgagagaaaatcgtgctcgccaccaaagtcgctggtccacgcaatgtgccttacattcgcgacaaaatggcgctcgatcatcgcaatatccatcaagcggtcgatgatagcctacgtcgtctgcaaacggattatatcgacctgtatcaacttcactggccgcagcgccaaaccaatactttcggtcagctcaactacccttatccagacaagcaagaagaagtaacgctgattgaaacactggaagcgctcaatgatttggtgcgcatgggtaaagtgcgttatatcggagtctctaatgaaacgccgtggggagtgatgagctacctgcgtcttgcagaaaagcatgaactgccaagaattgtctcgatccagaatccttataatctgctcaaccgcagttttgaggtgggacttgccgaaataagtcatctggagggcgttaagctactcgcttactcgccactcgcctttggtgctttaagtggtaaatatctcaatggtgctcgtcctgcgggtgcgcgttgtacactgcatcaacgcttctcacgctactttacagaacaaggcattcttgcaacagaagcctatgtcgcattagcccagcaatttgggctcgatcctgcgcaaatggcactggcgtttgttaatcagcgcccatttgtggcctcgaatattatcggagccacaacgatggagcagttaaaatcgaatttggatagtttggatatttcattaaatgcagaacttctgcaaaaaattcaggagattggaaccacttattccaatccctgtccttagtgatgtgggggctggtgcacagaccagccccttagcattacgtcggtattcgcgcagctaacactcgacgaatatgtctcacacggcgttccgcgacaacagcatccggtaaactcaagccgattggacgaccatccgtttccaagccaatatcacgcaacaaatgcggattattccaaggtagatggtaactacttctgcgcactttacgcttccacactcgctcctcacgacgcagctcagcacgaaccagtaacacagctaattgtaagtaaatagattgacgcatggtattttctccagtggttttgctggggaaaatgacgatcgaaagggaaaagtcagaagacactcctactcagctgccattttccgcagcctaataagaggttacggattaattcagtgatctttgctcaaatcattgcccattgcgcacacgggaaaatctcggagtgcagtttgggttgaatcaagatcagaagcgcaaagcaatgatgcagatacgaaatgtgccatgatgcgcctccaagcaaagtcaattaatccaaaagaaaggtgatattgagtaagtgaaacttacgattaaattctaaacaactcaggtaacaatattcaacatcttattacacatgctcgaaaaaacagcgtttttcgctaagtcagagtttttatcgcgtttatgaataaaatattcagccaaggaataaacacaaggcgctatatgcatccaaagattgatactcggaataagccataacactgaaattcgctgtagaaagacgtcccaaaaacagtctgtactacaaaaaattcagccacttaaccaagtggctgaacatgagtacaaggtaaatcagcaaaacttagaagttttcatcggtgatcaagttgtgtttattcagtaagcgatacatggttgcacgcgatactcccagctctttggctgccgttgaaacttgcccagagtgcgactccaacaccagcagcagtgcatcacgctcggagcgttcccgaatgcttttcaggctgcgacggccatcactgcgcttgggaagatcgagctgagactcatccagcaccacagtatctgacattaataccacacgcttgatctggttcatcagctcacgcacattacccggccaatggtagcgagttaacccacgtacggcatcatcagagaagctacgcgcctgggcgttgtactctttggagtattcttgcaaaaagtgtttagcaagtagcacgatatccgatgcgcgctctttcaaactaggcacattaatccgcaatacgttaatgtagtggtacaactcttcgttaaaatcaccatcgatcagcgctttttcgatgtctgacgaattggcggccagaatacgcacatcgactgcacgaaccccttggcgcgtctccacagtcccttcttgtaagaaacgcagtaggttcaactgttggcttttaggcaaggtcaaaatatcgtttagcagcagtgtgccaccatccgcttgcagcaaaaagggttgttggccttcctccgtttcgccaagaccaaacagctcgctttcaaggcgcttttctgacatagctcggcaattaactgaaatgaaaggtttttgtgcacgcgacgatgttttgtgaatcgccttagccaccgtttctttcccagtaccactttcgccatagatcaaaatactgacatcggtcgggccaatgcgtttgatctgatcgcgcaaacgcttcataggcatagattccccaatcaagcccatgttgccggccgagccaaaatgtggccaaactttcttttccaacttcagcatgccaagttggtgaccaatggtgctcaacaactgagcatcagggatcggcgcagtaaaaaagtcgatacagaagttaacgataaattggcaaatggtatctgaactgagctgcgcctcacgaatgaacgccagccaacggacttgcttatggctactcaccaaattcgcaatcccgttaaggctaaattcatcatggcttaaatccacaataccaatacatggcccagtctcgacaaataacgcatcggctttgcgcaaatctgctacttgagtacagcgccaacccactttttccaacacagccagccagggttcataggtacctcccaccacaacaagagagccaggtactgaatccatacggaattgagtgctcatgaacctatattccttatttttattgttacgatgcggattattctattcgcacccactacatggttacggacgttacattagcgagactttgcactagaatctgtctcacagataagactagccaacaaatgcccatttttctaatcaacttatgggagaaagtcataattcagtaaaaagaatgacttagattgcaccgacttggcacgattatttcttgaggaaataaaaaaagccgctcaatagagcggctttttaatcaatctacagtgattattgctgagggcgcatcgctgggaacaaaatcacatcacggatagtgtgagtattggtcaggagcataaccagacgatcaataccaataccttgacccgctgttggcggtaagccgtgctctaaagcggtaatgtagtcggcatcatagaacatggcttcatcatcaccagactctttcgcttccacttgggctttgaaacgcgcatcttggtcttcagcatcgttcagctctgagaagccgtttgccacttcacggccaccgatgaagaactcaaagcggtcagtgaagaacgggttgtcatcgctacgacgtgccagtggagagatatctgctgggtagccagtgatgaaagttggctgcatcagtttcggctcagccgtttcaccaaagatctcttcgagaagctgaccacaggtccagaaaggctccacatcaacgtgaacggatttcgcgatagaaaccatgaggtcacggttttggatgtcttcttcggtcagagcttggatctgcgcgtgatttgggttgtagtgcttgatcgcatcaaacatgctcatacgcgcgtatttaccaccaaattcaacggtatgctcaccgtaaggcatggaggttgaaccgagaacttctaacgccacagagctgagcagctcttccgtcagatccatcagatctttgtagtccgcgtacgccatatagaattccatcatggtgaattctgggttgtgacgtggagaaagaccttcgttacggaagttacggttgatttcgaatacacgatcaaaaccaccgacaaccagacgcttcaggtacagctcaggcgcgatacgcaggtacatcggcatgtcgagcgcgttgtggtgcgtgatgaatgggcgcgcactagcaccaccagggatcacgtgcatcatcggcgtttccacttccatgaactgttttgagatcatgaagttacgaatggctgacatcaccttagaacgtacaatgaaagcgttgcgagagttttcgttgacgatcaggtcaacgtaacgctggcggtaacgcatttcttggtcagtcagaccgtggaatttctctggcagcgggcgcagtgctttggtcagcagttggaattgctccatgttgacgtacaaatcgcctttaccggatttgtgcagggcaccttgcacaccgatgatgtcaccgatatccaaaccttggtatttatctttcagctcttgttgcacttctttcgatgcataagcctgaatgcggccagaggtttcttgaatcaccaagaatgggccacgttttgccatcacacgaccagcgatagacaccacgtgattgagcgcttccagttcttccttactcttttcaccgaacttcttctgcagatcacccgctaggctgtcgcgacggaacgagtttgggtgcccgtttgctttacagttcttgcggatgtgatccaacttgctgcgacgctctgcaatcagtttgttttcttcttgcgcgatttgctcttgattaatctcgttttgaacagcatcagtcatttgcatgtaccttgtttgtcggtaaaaagcttacaggcctgatttcaggctagcttcgataaatttgtctaagtcaccatcgagtaccgcttgcgtgttgcggttttcaatacctgtacgtaaatccttgattcgtgaatcatccaacacgtaagaacggatttggctaccccaaccaatgtcggatttagcatcttcgttagcctgtttctcggcgttctgcttttgcagctccaattcaaacagtttggcgcgaagttgcttcatcgcttggtctttgtttttgtgctgtgagcgatcgttttgacactgcacgaccgtattggtcggtacgtgagtgatacgtacagccgattcggtggtgttaacgtgctgaccaccggcaccagaagcacgatacacgtctatacgcagatcggcagggttaatttcgatatctatgttttcatctacttcagggtagataaacgccgaagcaaacgacgtatgacggcggccacctgaatcgaacggtgatttacgcactaaacggtgtacaccggtttccgtacgtagccaaccatacgcgtaatcaccaatgatacgcactgtcgcagatttcaatcctgctacgtcgccttccgacacttcaatcacttcggttttaaagcctttagcatctgcccagcgcaagtacatgcgcagcagcatcgacgtccaatcttgcgcttctgtaccgccagagccggcttgtaggtcaaggtagcaatcggaagaatcgtgatcgccagagaacatgcggcggaattcgagctgttcaagtttcgcttctagctcatccaattcaggaccaatttcatcaaacgtttcttgatcttccgcttcgatggccagttctagtagaccttcgacatcgtcgacaccacgatccagttgatcgatggtatccacaaccgcttcaagtgctgaacgctctttaccgagggcttgcgcacgctcaggttgggtccagacatcaggttgttctaattcggcattgacttcttcaagacgctctttcttggcgtcatagtcaaagataccccctcaggatatttgtgcgttcagacacatcctgcaggcggtttttaataggattgatttcaaacatgttggcttacgggttatgaatagaaattaaccgcggaattctactgaaaaatgtgatgaagatacaggaaaaaatacgttatcccgccttagtaaacagaataaaccgcaaaagatccctataaaaaagcggaagccaaggctcccgcttaatctgctattgaagagcgttatgctagctcttcttctaaaacaggggatgatgctgaaggaataaagaacatgcagatcatcgcagcgcacgtcggtagcaaccagcccataccgtactcaaagaaaggtaggaagctgaacgcagaaacatcaaagcccgcaacttttgccgcatccagtaacgccaccagcagagaaacggacagcacagcacggtatgctacccgtgggtttggcagtttgtgacgcacgaaagtcaatgcgaccagagcaatcgccacagggtacagagcaaacagtacaggaatcgagagtgtgatgagctgcgccaaaccaacgttcgccaccacaccacacgctacaccattaatcactacccactgtttgtaagatagcgacgtgtgtttgctgaagaaatcagaacacgctgaaatcaagccaaccgccgtggtcaaacaagccagcataacgataaccgagagaaccaactgaccatagctaccaaagagagcttgtacgtattggcttaaaatcgcgccgccgttgttagcccccgccgccacacttgagctggttgcaccaagatagaagagtgagccgtaaaccaacgccaaaccaattgccgcaatcaccgctgaagtgatcagataacgggtagtcgccgcacgatcggtaatccctttgctacgcagtgcatcgacaatcaagataccaaacatcaacgatgcgaaagtatccatggtgttatagccttccaagaagcctttggtcagaggttggcttaggtactcaccttgcgcagcaatcatctcaccttgtgggttcatgaacacgcccagagcaaggataatcagacagataaagagcgctggtgtcagcagtttaccaatcaaatcaaccagtttgccttgcgaccatgagaagaacatcgcaactgcaaaaaacagcacagagaaaagcgtgagataagattgagtgctctctgcaaaaaatggttttactgccatttcgtaagccaccagacccgtacgaggagctgcaaatgcaggaccaatgacgatcaggatcagtgcagccatcagcacagaagcttttacaggcagatctttggtgagatgctcccagctaccacccgcaacggcaatcgcgatgatagtgatcagcggcaaacccacagcggtcagcaaaaagccgaacatggcaggagtaatgttctcacccgccaactggccagcgagaggtggaaaaatgatattgcctgcgcctaagaagaaggcgaacagcataaagcccaaagctaaaatatctgctagttttaacgtctgcttcacagataacccttatttattaaagtaatgaatgttgtgtatgcatttcgctgcttagaaaaatgtgatgccaagcggcttatggccgaataatgacgaatgcgcttgtatttcgcaaccgcaaagcaaaaaacacaacaataatttataatcacaacaattatgcagtgtcatatgctagctgactgtaaaaatacagaattacaacctgctttataagctcattttttcaccagtcaacagaataaaatattattaactatcttcagaagagagcttttcgcttaactctcgtttgacctagaatctcgatgaaaaccaataaattaatcaataaaagctttcgctttaaacaattctctatagaagaaggcacatgcggcatgccaatcagtaccgatggcgttttactcggtagctgggcatttagcctctctccaacgacgattttagatattggctgtggtacagggcttttgagtttaatgtgcgcgcagcgcttccctcatgcccacatcaccgctttggatattgagcaaactgcatatctagcggcagagcacaatcggcagcagagcccttgggctgaacgcatcgaatgccaacatgccgatattctgcactggcagcccagcaaacgctttgccgcaatcatttgtaatcctccttatttcaacagcggagaaaccgctcaacaccaagtcagagcgacggcacgccacactatcagcttgcagcaccaagccttgattgagcgcttacctcagcttctcgaacccgatggcgtagcgagttttattctgcctaaagcggaaggtgaagatttcatcgccctagccagacaagctgggctctttgtggggcgctattgtcaggttcaaccaaccacggacaaacctgtgcatcgtctattatttgagctgcacctatccccttgtttaccagtagagacaagactggtgatccgtgagcagcagggttacagtgaggcgttttgccagttaactcgcgatttttatctgaagatgtcgtaattaaagatgtgatctaaagcgtgatccatctataatgtgcgccctgttttaagacagagcctttcaacgcttgtggagtaattatttgtgattaaaacctttgccgacctcgaactcgatccaattttgcttgaagcgatcgaagaaatgggctttagccgcccaacccaagttcaggctgaagcaatcccgcaagcactggatggtcgcgatgtcttagcctcagccccaacaggcacgggtaaaacggcggctttcgtgatcccagcgctgcaatatttgctcgatttcccacgccgtaaagcgggtcctgcgcggattttgatcctcactccgactcgtgaactggcgatgcaagtagctgaacaagcacaggcgctggccaaaaatactcgtctgaacattttcaccattaccggtggtgttcagtaccaagagcacgccgatattctggccacgactcaagatatcgtggtcgccacaccaggacgtctgctggaatacattgacgccgagcgctttgattgtcgtgcgattgagtggctgatcctcgatgaagcggaccgcatgttggacatgggctttggcccaaccgttgatcgcctttcgaccgagtgtcgctggcgtaaacagacactgctcttttcagcaaccctagaaggccgcggtgtggaaggctttactgccgatctgttaaaagatcccgcccatgtcgatgccgagccaccccgtcgtgagcgtaagaaaatttcgcagtggtaccaccgcgccgatgatatgccacacaaagtggaactgctgaaaaagatcctaaccgagcaagctgaacgttctatcgtgtttttgaaaactcgtgagcgtctcgcagacctgcgtgctgagctggagaaagcccagatcccttgtgcttggattcaaggtgaaatgccgcaagatcgccgtaacaatgcgatcagccgtttccgtgaaggcgatgtcaatattctgctggctaccgatgtggcggcgcgtggtattgatgtgccagacattagccatgtgatcaactttgacttgccacgcagtgctgacgtttacctacaccgtattggtcgcaccggacgtgcagggaaaaaaggtattgctatttcactggttgaagcgcacgaccagccgatgatggcgcgtgttgaacgttacatcaaagaagaagtcaaagagcgctttattgatggtttacgccctaagcacaaaaagcctgtgtttaagaaaaagaaaaaagacatcaagaaaaccgcagacaaaggcgcggtgaaaaagaaaaccaccagcaagccaaaagcaaaagcgaccaagaagaaagccgcgaccaaagcctaagcgcaaccaaagcctaagtaagataggcaatccagttacgaaaaagccgatgaattttcatcggcttttttatttggttagagcaacgcgcactaaattgagcgcgcgtttctgttaatccttaatgttcacgagtcgcgcggaatttcacctcaggtgaacgctcctgcgccaagttcaaattcaccatggtgggtgcgatatacgcaagattatcgcccccatccagcgcaaggttgctctggtttttgcgtttgaactcttcaaacttcttcacatcgtcacactcaacccaacgcgcggtcgcaacgttaacgccttcatagatggcttcaacgttgtattccgatttcagacgcgataccaccacatcaaactgcagcacccccaccgcacccacgatgaggtcgttgttttggagcggacggaaaacctgcaccgcgccctcttccgaaagctgtactaagcctttcaacagttgcttttgcttgagtgggtcacgcagacgaatacggcggaacagttcaggcgcgaagttcggaataccagtaaatttcagcgtttcaccttgggtaaaagtatcgccaatctggatcgtgccgtggttatgtaggccgataatatcgccagcaaatgcctcttctgcgcgtgcacggtcgcccgccataaaggttaccgcatcagaaatattaacctgcttaccaaggcgcacatggttcatcttcatgccttgcttgtaggtgcccgatacaatacgcacgaaagcaatccggtcgcggtgtttaggatccatgttggcttgaattttaaacacgaagccagtgaatttctcttcgctcgcctcaactacacgctcagccgcctgacgaggcataggtgatggtgcccattgggtcaggccgtccagcatatggtcaaccccaaagttacccagtgctgtaccaaagaataccggagtcagttcgccttgcaggaacaactcacgatcaaactcatgtgacgcgccgagtaccaattctaactcttcacgcagctgcgcggccaagtcagcaccgactgcttgatccagctcagggttatccaagcctttgataatgcgttcttcttggatggtgtggccttggcctgaagtgtacaaaatggtttcatcacgatgaatgtggtaaacacctttaaactctttaccacaaccgattggccatgtgatcggcgaacaagcaattttcagctcattttccacttcatccatcaactccatcgggtcacggatttcacggtcaagtttgttcatgaaggtcacgatcggcgtatcacgcagacgggtcacttccatcaacttacgggtacgatcttcaacccctttcgccgcatcaattaccatcaaacaagagtcaactgcggtcagagtgcgataagtatcttccgagaagtcttcgtgtcccggagtatccaaaagattaaccagacaatcgccgtacgggaattgcataacagaggtggtcaccgaaataccacgctctttttccatttccatccagtcagattttgcatgctggtttgagccacggccttttaccgtgccggctacttggatcgcacgtccgaaaagcaggactttttcagtaatcgtggttttacccgcgtcagggtgcgagataatagcaaaggtccttcgcttattgatttcattgagaaaatcttggtttgccatgtataaattcttttagtttgtacacggatttgtacacacttttggaagtactctcttttcagttcttcgcttgtcaaatccgtcgtgttaatcgtaattggccgctattttcgctgatcttgactttataaacaatcaatggttatctgatctgttaccatttactctcagcgtgcgccaatgctcagttgtagctgtttgcaatcgttgcttcttcagctcatgaacaactgtggctaaaccacaaattccttcgctaccagaaatcgatgatagcttgtcgtactacaccaatgatggtgcagttgccgttgatcggtattgccgggtattgggggttcaaaggttttaggtacttctgttcaccatcaataaccaactgcttaaaggttgcttctttcgaatcatccaaacgcgcaacaaccaatgaacctgaagagtaaggtaactcaggatcaacaacgatcactgctccctcaggtatggatttttttccgcttggattttccatactgtcgccttttacgcgaagtgcgaaacaaccctcatgtgctttccctgtgacttcacgccactcttcagcatcttcatgggcaaatccctccgctatttcagtccaatcaccggcctgaacccagttaatgagaggaattcttcccttaatgtcaggcccaacttctacattaccgacccccaagccaatctcgccatcacctgtggcgagccaatgagcattcacgcgaagcgcttccgcgatctgcatggtgtaacgagacctagccgatttaccagagcaaatctggctgatcgactgctgtttgataccaatgcggcgagccaactcagactgagtcaccccagtaagctgcaaggcatggtttagtcgttcggataaagttttcataagcccgtattctacaaataaaactgtagcctttcaacaattttaactgttgactaatctacagtttaaactgtaacattcaatcttgtaacagttattattgtaacaggagacggtatggaagtgttcaacacaacacaaaaacatctccgccgtgccattgacttggtcggcgggcaatcagcattagcacgagccatcaactcaaaacagcaaaacgtctggttttggttgaataaatcagggcgtgttcccgctgaattcgttttacccatcgaacaagctacgcaaggacaggtaacccgatctcagttaagaccggacatctatcccgaatgcccaagtgagctgaaagccagtaaccagtaggattaagggcaaataatggtcagcattttacgtaaacacaaaagcgagttccttcatgcgtgattatggcaaggtctatacccgcttttggctaaagcaaaacgttttgtcctggagtgactcagcgaagttgctaggactgtatttgcttacatgcccacattgtaatttgcttggctgctttcgattgccgattggttacgttgcttctgacttgaattgggatgagcaacaggttgccaaagctctaaatgagttagaacaagatcagttcctcattcgttgcgaggaatccggttggactttgattcggagctttctgaagcacaacccaatcgaaaacccaaaccaaggtaaagcagcctttcggttgcttaaagatgtacctgccgacttcattggtatggcatcgcttttgaaatctcttgccgcttttcaagctcggcttccagaagaattttcatcattgtttatgcctgatggcaacccggtaagggactctcaacggtcggatgactctgagagaagcaataagccaacagttaaaactgttaaccagatacagttcgaagacttctgggatgtacaaatacgcaaagaaaaaaaagcgaaagccaaagaagaatggcttcgcatgggcctcaatgaagaccatgaactcgccttggaagtgctaacacgctggaaagagcaacgagacaaccgattgcagtatcaagatcggactaagacccctatgccacataactggcttttaaaccggcaatgggaagacgagtacgttcgcattgatgaagtacagcaatcatcgacgagcctaaagggcagcaatcaccaattgaatattgaagaaagcaatcgccgcatcgctgaaagctgggccggaccaggtattcgggaggttcgttcaagtgcaggaggttgataaacgcgagtttgctgaggtttggggagccgcttgggccatgtatggcaaaagcgtatcaccgcaattgctatccatcgcatttgaagcccttcgtgcttatagcattgaagaagtgcgaatcggtctgactcggcatattcaatcaccggatactgggcaattttttccaaagcccgctgacgtcatcaagcatatcgacggcaactcgggctcaagagccatggttgcttggaacaaagttgacaaggctgttcgtcaggttggcgcttggacatcagtgatgtttgacgatgcgcttatccaccgcgtgatttcagatatgggtggatgggttgaactctgcaaggttgatgacagggaatacccctttaagcaaaaagagtttttaacacgctaccaggcttacttgctgcgggacgaagtgggtgaatacccaaggctattacagggtattgcagaccatcagaaccagcaaaaaggatttgatatgcaagcgcctgttgccgtgggtgactggtcaaaagcggcacaagtttacacgagaggcatcgccaattttagcgcagtgcctttgaaaagaataagcccgaaagccattcaggcgcttctcggaaatcaattagaggacaaaaatgaaaacgattaaagcaaaaaccgttgccttagtgatagccatgtccgcaagcacttcagtctatgcgtttccgggctatcagtgggaaaaagcagcacaaagcgttggtattgatcctgtcatgctctacgccgttgccttggctgagtccgcctcacatcgtggtctcaacatgaccagcccatggccatacgcaattcgcaatggttcaaatgcaacctacgccaaatctaagacagaagcagagcaactgttaaaccaagcactgcaagagagtgaaaaataccagctcgatattggccttatgcaaatcaatttgcattggcacggacatcgggtgagctcagcagcagaactgctagaccccatcaccaacctaactgtcggctccagtattttggccgaagcaatcaaatcttcaccaaacgatttagagcttggcataggccgctatcacagctggaacgaagagcgtgctcgctggtatgggcaaagagtgctttctatttatcgcaatattttacatgaactggaggtccgtcaatgacaaccaatcaacaagacttctatcaattaaatttggcatacctacacgcagcacgggaattggcgcgcattgatccgcaagaggcggtcttgcgctttggacttacacgcgatgtggttgatgcgctgattaatgctggtgttgacgacctgcaacgagtggcgacctcatcattcatgctgtttcaaccaaggggaaaccagagccaactgattgagatggtgaagagcaaaggcacaggtatcccaagaatcgcttatttattatcaaccttaaacaacaaggggggtgcatgattgataacctgtccaaaagtgagctgtttacccgagcttcgctgcttattaaatacggatttcgaacaaccattatcgcgctcgatacaggtttgccaatccacattatcagaaggctccacaaagaagtgactggcaagtcaccttgtcctggtcaattgccagaatctgatgccatcgttaaaagtagaagagccttggttgaaggctccctgctgatggcgctatatgtcaatattggtggtgacaatgtctacaagcaattaaatattgatgctttgatgaaggcttacgatgcgtacttggttgcaagaaaagaagcagatcttccagctgaaatcccctggaaaaaactaaccatcaatgaaggttgggttctagctcgtgatttaagatcacagcttgcatccttacaccggtgtcgatgcggtagtctgtatttgacggtatctcaacagcgcattcagcttaaatgtcctgtgtgcgaaattatggccgagcaaaccactagagcactttttgagaactaacatgctgatgcatgatttgattgtgcaccgtctgtgcactttgagagtactaagaagatgacaaacttacttaaatctttaccagcacgctgctggtttatatcactggggctttttctggcgactttggcagcggctcatttttttccatcagaaatatttacggcatctgccaagttagcggctttgccatttctgatttgcaccatcgtttttttcagctacttgggattcaaagcaactgctagtcctatcggccttataaccatcaccactatgtgtttagcaatcgcatattggcaagcgagttgggcaattttatgtgtcggtttagctttcttaggcttaagcggactaatccatttatttcaaagacaactgaaagataccggtcgagaactaagcctgagcgaaaaaaaatattggtactgggtaaacgaatttgcagacggtcgctcatctatcctccccaaaaggccaaaaaaatagccagcccatcacaagctggctaccttctgtttttagttccttcctgaagcctggttataggccctaatatcgatcaagttgttctgagcataatctccagcaagggatgcatttgagatcactgcaatctgcttatccacaaatgctttatcttcttcggacacactgtcggggatgtaagcaccgctctcatctttttgacgatactcatttagcatttgctcccttagaccaagcatttcaggcgaccaactcgatgagtcttcagagttgaaaacgcgccccgccaaaccttcattgaaagcttgagcgaacacttgactttgaatcggggtcaatcccattctctgcccttcgctgtatgcttcctgtttaaaatcatcggcatactgttctaagaactcaccatatcgattgttaactgccgcaccgaatgccccagccaacatggcttcagacttagtgccccagtttacttcggaggcatactgcgaactcgatccactgtatgcatcattaaacgccgtcaatgggttttccaaagaggttccggcgtcaacggctgcttttaagccatcccaggttgatttactggccaccgttgcattgtgcaagaaacctcgtgagctagggtcttcaagtgcttgctccttgtaactctcatagtcttcgccaaagtgattcaaggtatgcagtgctgcatcagtatgcttgccactgaagtcaccaatagcactggcgctgttgaagaacatttcagcaccagaaactccgctatcatcagccataatgcgagatcgccactgagagccagcttcacggtttagtccagattgataggtacttgtgtcagaaactacggcctgttgggcttgttgttgatgcgcatttagttgtccatcaacaccagacaaattagtttggtaagctgattgagctgcgttgaactgagtttgaacagttgcagcatcctcgtagccgcccaatacacccgattccacttggctttgagtgccaccaaaagtaggtgcagttgatgacaagccttcattagagcgtggctgaatagatcgtaaatcggctccggtagccatggccataacagtcattgctgcttgatagtcattgtctcgttcagcgggcgtcgaggagttgctataggttaaagactccatagctgcggccacatacgcctgattatcatcaggtagcaagcgctgatacattggaaggttttcacgtaatcggttacctgcttcaacatgctggttcatatagcgacctaaataatccatgacttcaggattatccgctgctaatcgagttaacgtcgcaccatccgtgttcctttgtcctgatagactgtagctggcctgatcaagctcactaaagcggtttgatgccgtgataacgtcttgtgctgaactctgaagtgactgatagtcttgattagacaacgacatctcaacgccagagcgtcttgaatctgaaaggtccttaaccattgcatcgcgatactcagcacgtcgtgaatcacttgatgccaagctttgcatctccccagtgagcgtatttgcggtcgttgaccgagaactgccctctgatgactcaacttggccactaaagttaccacctaaatccaagcctgctcgtaaccgtgatatttttggcactcttgatgattcaggcttatccactcctggtaggttgccttgtggggagtcattccctcctgtactaagtaatcttcccaagaaccctttatctgctacttctttatcaccggtatttgtaatggttccatctccaccgaccctaaggcctcccgataacacgcccgataccaagccacgtacagcgtcttttttatcgtctccgaaaccataccgtgtttgcaggtcatcagtaacctgattaacaacggcgctagatgcggaattagaagaaccgatctgacgtccaaccgaagaaaggttgtcgtaacttagcttttcaccaaaagttcgactcatggtattgccaacttgacggctaaaggcttgagttgcctgagtcatggattcttttgcagaaccgaccattgaacccaccgcatttccgacagagaaactgcttagtaagtttgacgcaccggtcattgcagaacctgtgagggctgaattttggaacattgactgtgattgcattaccggggcatttttcgcgacatctggacttgccatcttttcatcaatggcatcaccgttttgaagacgtccagccaagtgggtagcggttattgctgagccatacacgagcatgagcgaaattgccggaacactcgacgccaacatgccgccagtagctatccaggtttgcagcactgaatccatctgcatcatcccagcaaaagatggcacttctgtacctgcaaaggcatcaagcgacgacattttccctgcaacggttaaatgaatatacaggttaatgatggccatgacaggcatccaaagttgaatccaaagcaggattaacaagtacttcccggccattcgcatcccgatttggccaagggcaatcacaaaggccatcaatggggtgatggcgtaaatgaaaccctcaaaaaacgtcatcatcggacgaacgatactttggaacagggtctgctccgcagcccattgcgtattgcgctgctcaatcgcttggttaaccatcacggctgcggtgaaagcttggtcatccatatatttgcccgtcacgctttgctcataaataggcaaaagcaccgacgcggtcatgtactcttgggtgttaaccgaagccaaaccaaggttattcagtgcatttcggatcacgtcatcagtgtccgttgctgacgaagtccccaatgaggccgacagaacctgtttaagccttggtatgaaggttgattctgtcatgagtttcagttggctgtaggcatcggtgcagtccagatcgctactgctaccactaagcatgatgcgtgtgccataaatacgcgaatcaaacctaatcgcagtcatcggattaggatcactcagcacctgatcgaggttcttttggccaatgtcgataccaatcaaggtgcactctttgatgtagttaaaccacgattgctcgatgtccgagccgccgacacgatttgcatcacccaacccagagcgatccatcacctgttttctcactttaatcagtgactgtaaactggatgcaaagccgtattccgtcatggcgggagttgagaaggcggtttcaaacaatcgcgtgatttgaaagccaacagtcgaaatcgtactgcctgcggcagcaacaccgatgggcacattatcaaccactcgaacttgtcccgtgtacgcatcctcaatgctcactcgggtactgggcccaaacatggttgcaaagactagccatgagactaaaacatgttgaaagttaatcccacgaccaccttgcattaaggcctgaacagagaccatcaataccccaatgagcaagccaatgcgaaccattgaagtaaaatcgcctgtaccagtgatcatcgcgacagcgttcaagacctgctctaaaaatgccgaatccccgatggaatagatctcccacatgacctattcccccagtgccgtagatttaacggtgtaataacgctgcttgcgaatggtctgaatcacctgattaaagtgcgccagcaattcttgctctgagccgtatcttcgctgcaacgcggcgtactcctcattgatttggcgacgtgcacgttcaagatcttccgttaacaacttcgcataggcatgatcttccacacccgatgtgcttctagctgcgttgagcatgtcttcaaccaatgctcgggccatctcaacagcaataaatggtgcagctctagaagcaaacgacctagcagccccttcatttaatgcagaaagagttcgaatcatgccgccaatgcttgcaggagccgaggtcataaaagccttttcggtggtgctagctgcccctgtatttcgagcaaacttaaaaataatgccgtgactagaacctgtaccaagaagtaaattttctacctgagttgataacccggtaagggtcacgttagtgattgttggattaaggcagccgtcttgtgtcactgtgtcacatcggtacatagcgacgttaccaccatgaattagatgctcaatagtcactttattgccattcagtctggtcagtttcggggcttttccttgaccatcagcggcattggctaaatcaccaacgatgatcgaaccagtcaccgacataaccgcttcaagaaaacggtcatccccagatgcaaaccagcttgatgccgagtgacgtttcagtgctcgccaaaccaagttgcctttaatcgttttgttcacatcagatgccgcgacactcgaagcgttctcgtatgggttcttaccattggactcactccaactggtaaaaacgtctccagcccctttaagtgagctcaacatgctggcttctgtttgcccctttttaccaaaagcagccaaggtatcgttcacgactccctgagccatttgacaggaattgccaaaatactcgttcaactgctggattttcttttgcagagtctccatgtgctgggaacatttctcacacatagcactgagcgccaattggaatgcgtaccccttggcatttgccgctacagagcgaagcaattgaacgaactgatctgcattaacaaatgacaaacttccagcgaacatatcaatgccgccacaaccggcttggaatgacggaggcaccatagagacgaggttctcgttcatgatcctgttacgaacaacaacacttccgccagatataacgccacgccgctgactctcgaatacaccaggcgcagtgctgttggtcattgaaccaaacaactgattcatctcctgttgcaagcttgcttggctcatagacgaaaaaccaatcgcacaggcgattagcgatacttggaatacttttttcattgttataaccctccttgtgcacgcagatagcgaacaaggaactcagggtcctgtaatatcttttcgttaagctcttgggctgacatcgcgagtgacacgccgggttgaacaggtctggtggcatagtaagtttgatcgtcaatccaaccggcttgatgggctgcaagaatgattcgattattgagctcatcaaggctcattgcgccttggccaatcggagtgatgacattaggcggatcaactaagaacacggcagggacagtcgtaacggacaaggattgagcttgtcctgaatcgactttgtaattaggaaactctccaccaggtaaaggcaagccatcgactgcaatagcaaacacctcgaaaccatagttcaaagccatggattcgatgataggcgcttgagcatggcagtaagggcaatccgaacgatagaagaagaacaagccagcccgttttgctacttcacctaaagcaatatctcgttgagcgccagcttctcgatccatccgattggcagcataggtagccaagggtctgcgactgatttcatccaaaacaggatcacccatgacaacctgctgactaacatcagcaaatagtgagcccttatccatcataacgcgctgaagatacagataggctcggacgttctcagtggtcggctcatcaattgccttatccatgaacgactgcatgtgctcacgaaaccaagcagcactgaaaggctttagcccgctctgactcgactctgccgcacctgattccggctttataggctcttcatcctccgctggctcaggaatgacctgataccaaaaccagccttcctgaccacgctgatagaattgcccatcactagcatgggcgggcaggatgaatagaaagaaaataatgattgggatggtcacccataggatgaaccaagggaacaagggggttctcattgtcagctccagaaaatttcatagagctaacatgctaatgatcccggtaagagcgattggccagatagatgaatgaatcgtgtgtttttctgactagctgttgtgaccagtaacaacagctaattttaacgagccaaatttatgattggaccgctttgagcgaaaagcagagattcagcacctcaacacaatccgcatgcgaatgaccgcttttaccgcaaaaccggacatgaagcccggtttatttaaaacgaaattatcggtctatagggctaattgtccctgatgaatgttgaccgatgacatgtgtatatatttgagttgtcttcaaatccgaatgccctaacagctcttgaactgtacgaatgtctgttcccgcttttaaaagctgcgttgcgaaagagtgcctgaatatgtgtgcggtaacgtgtttctgaacacctgaccgtataacagcgctccttaatttctttgttagggacgtccaatgcaagtgatggcggcaaacatatccatccactggatgcttacacctgacagatgatgggaatataaattgccacttaaaatcagaaattgcgtaagggtattttcgagcgagccctgacgggagacttgttttaccctcaccttcgcaaagatccttttcatgaagatcacgaaccttttcaatatgcaatttaaggggttcaacaagcttttcaggtaacatcttgactcgatctttaccgcctttgccacgaaatacatagacattccttgactcaaaatcgatatctttaactcttagcattaatagttctgctttccttagcccacaaccatataaaagcgaaaacatcagtttatagctaccggatagctgattgatgatactcattgcttcgttatgagataagacggatggaacccgtttaggtgcgcgtgcttttatcgtatcaggtagtaaagtaagttctctctgaagtatatgtttatacatgaagacgatagcgcaaagcgccaagttttgagtagacgccgtaacttgtcggtttacggctaaatatgtcaaaaaattagttacctcttgttcccccatgttcttaggatgctgttttttgttaaacaaaatgaagcgttttatccaaagtaaataggttttttcagtctgaattgagtaatgcttggtccgcataacctgtctgatgctttcaaggaaaggtgaacgagtcatgtaagctcctttgttgattatcgagtgtgttactgagacttcttagtaacacctgatgataaggaggctaaatcaagataaggcattgatattaataatatcaccccgttttggggtggagacattactgagaagtctcagtaatgtcgtaaattaaaagtaaattaagtccttaactagcttcttaagttattgattttcagtaaactcataggtatatatttgttttgcctttcggatgttactgagaggtctacataataactttatcatgcggccgcactcgagtaatgataagcggagcttaactcagtgggggagttcttgttttgaataattcggccaaagttgagacgataatgcccaacaaggcactgctgtcggacaaattttccgctacgctccaaatttgccgcagagtgcggcgttctgctaacacctaaaagcggactttacagccttaaagttggaatgtctgcaattggcacataagtaatattcataaagtgcgaatactacattagcttactttactgcaaaaaccgtaaccaatgtcttcattgagtcacccgtaatcataacaaagtacatcttgctctccacgtgctgccagaattcggcctcttgtgcatatttttttgcttttttagtagcgacgctttctggtaactcggctttagttagcgcagaacataacagctttgtgcacaaagccttccaaggatgcttaggtacaccgtctgaaagcctttccacgaatctttctagtgcatgacgagtcaccacgacaggtccaatgttcggaacatttattacctcatcgatttctctcacagtagcattatcgacgctgtattcttcaaaggaatatgagagccaatcttcccgtttctctaccgagatctgtgcttcctggtaacgggtgagcaagaacctagtcaggctgtaaagtgaatgctgagttgagcgttgtttctgtaactttttgatggctcctttactgacccggatttgaagcccattaccgcttcggttactccccatcacctctttcattgacagtaggtgatgaatagcataaagctcagctgcaattggcttttgctgctcaggtagcttgtcgtattgctcacctaaattgacctttagctcaccacctcttcgaaggccggtcttccagtaaaccgtaaactcaccatcaatctgctttgttaacagggttaataccatcatgtttgtttctcctattgattatctatttttcattctccatgttttttcaaatatgcaagacgcaaaaaaaggggccgaagccccttggatcagatatgaactttcggaaaccccatggcaccgtaaacattcagcacatcattccaatcccaacttttcacgccgagtgacgttggtatcggagggatcaagacttgtgtcagaatgcctttttgccaggcttttttcttgagttcattcgctgcattcaggccggtctcagagagatcgtgatctgcccagatgtacagcattttcacattacttggtggttcaaacctagccagtagcgtagcattcacaaccgaccaacatgtttgccccgttgctctggttaccgctagggccgtttctataccttcagaaacacctagtacttcacccggctcacctatcggaatggcaccacctgtgattgttcggtcacttggtatcggcatcatctttttaggcttttcaaccggcgctttgaatccatcttcacttaggtagatccgatggaacgtggccgaacgcccttgctgagtaacgattttacctagcagcgctgggtagctatcgataaacagaccatcttcatcatggtaaggcaagcttggatgaaacctcagcaccgaatcccattcaggacgaagccgcgtcacaatgccacgacgatgcaagtagttccaaactggttgcgcacgagtatctgcaagagaaaacgtttctccccaggtttgattcaagcgatggataatcgctttgtcctcttcctgctttttagccttccaatcaacagcgttacgcgttattgcccgagaaggtgcttgtatttgtccgggttgaataccaagaacctggccgattgcttcaatagactgagcaaagttccacccattaacccaagacaacagttcaaaaccatcatgaaagataccgcaggtgttacaaacgccacctccggtatattcagcatctttgaacagcctaaagccatcacgaccgccatgaacagggcaagccacatgacggccttttcgagcaatagcggcatcaagttctggcaccaacgccgccagtatttgaagccattggccattaagatatggccttactgtttcaatttgtaaaggtaacgccatataacctccttaagtaaaaagccgactcctaccacaagtgataaaagtcagcttaggtcctgcattagccgttcggttaatacaggaacgttagtcaagctggataccatgtcgtcttaatagccacatgatggagtcacgaagcacatcaggatcgacaaccgcagccattgcgcaaacacgaaagcaaaatggcgttaattcgtcattttgaatccacgacaacacatcctttcgcaatcgagtactgacacgaccgtctagcaatacacggatcgcatccaatagaatgccttcgcgtaactgccagatttccgtgtcagaccaagtgactggggcatcatcaaactcaaatagaaattcgagctgtgatgacgtgtgttgatgggactgcttttgtgatgaaggataatgggcaatgcgcctattcattaaagataaccgcgttcggcaagcgaaacgcagccctcggatgcgaccacgacatggtcaagcgttcgaatatcaacaagtgacaaggcgtcacgaagtcgatgagtaatgcgtttatcagcttcactgggttcaggatcacccgatggatggttatgaaccagtatcactgctgccgcattaagttctagcgctcgttttgttacttcccttggatacacgctcgccgcatctaaagtgcctttgaacagctcttcaaatcgaatgacgcgatgctttgtatcaagaaacagcacaccaaaaacctcgtgctcatactcgtgcatcagtgtttgcaggtatgagaacgccgacgatggctgttcaattttgcgacctttacttaatcgaccacgggcaagcttaagcgccagatctaagatatccgcttcagtcacttgctcaggaacgatataagtaccggcatcttcgccagctaagaactttctgtttttcataggagtctcccaaaaaaaagcggagacgaacccatgcccagacggggacggaatcgtccccgcagggtggtaaaattgatgtggttactgaattaacagttgttgtgttacttcaaataactcacgctttagatctttgacgtcgttaatcacgatgctttgtggaaagaatctctcaacactgcgtgtttgaatccctattcccagaagctcaaagccactgcgtctgcaccggtcaacaatgtcatgcgtggcagcccaatcatctgggtcaccatccgttagcactatcattagctttcgcttctgtttttgcgctaacaaactgtttgccgcaaaccacattgcttgtgccataggcgtacaacctcgtggtttttggtcaaaataggcggcccgatgtcgaaccgattgcttgggcaatagcgcgacagaaacttcctgatgaataccaggaaaataactgaccgcaggtacaacacccggtatgccttccagtgccatgaccaaagccaaagcggcttcattggcaacatgaaagtacttgcgattaccttcgccaatgggcttacccattgagcccgatatatcgaccagcaagtgcacagcagcattgggcgcaatacgcggctgcctttgaataaacaatctcgattcacctgcttgtgaggcggcaagacgatgggttgcaactcgaagaccgtgccgtttggcatgattccgattgtcctgactggactgaatcatacctctaagacgggctcgaatttgagccgactcagacgccgataaggtcaagatagcctcatcacccaacatagcctgctctgcttgaggcaaactgagtggtgtgacgccctgatgtccttcagcttgttccgacaacacttctgccacttgggcaaaggtatcgggttcaaactgagcggcactggcctctaaggcttgtcgcaaattgtcagcttgatcagagttatctgaatcccccgtttcagcagcatcccccattgcagacgatgctgcttctggggtttgactgtcactattgttattgctgtcattactcgcatattgtccaatgtcatcacccccatcagaatcagactcatcctgtggtggacgagattcttcttccaacatggcaacgatggcatcgacaagtttcagcacttcacctgtagatgccaggctaggcactgctgtcagcatggcgcttaaccggctcatcgctgcggcaggaaagagttgtctcactctttcatcaacagcttgatacaaaggcgtcagcgctttctggcccagaaaatggcatctcaagcggaacaacaaccaggcttgcaagttagatgcaggctcaggctgttcaggtacacacatttgctgtgtgtccaccatgtactcaatcacttgcgaaatactgcgccgggttccggggtaatcctttgccaattcgttttcaatgcgcacatcctcaataatattgagaagtgccttacggatcggcttagacgacgccttcttcaccatgtcaaaattggtatgccgaatatgcgccgcttcatgagccagataaccccaagctatctgttgatagtgtgggtcgtctgggtttgctgttgggatcacaatccgctcaccatcggtaaacgcatcttgtccttgaataagcaccttcacaccaaacttttcgccataagcggcggcaacgattggcagtgcgttttttaatggatgattcatgggagtctcctaatcattagggggaatactccctcagcgggagcgtttccccgctgggaatgtggatgtttaaacctgtgcttttagcttatccaggtcgtatttttgacctaaccaagccaccaattgagctggactctcgtgctgctcaaatgacgttttaagctggtctaaactcaggatgtcatccaatgtcagaccgtactggtcttgtaactgagtagacacctcgtgttgatattgcagccagtcccgctcaaaagcggtttgctgcaatgccatgtttggaacaaataccatggccgttacccaaactccttgtgcgtccgcatctgcgatcaaaacagggttcttggggatcaagacactatgtgttgagtacgaccgttgtactaacgttcgacaacacgccacttctggtatcgattcactttcaaccgcatcagtcacaccacgaaaatgtgcttcaaactggttcagttggctggagttatggatggttgattgcataatttcctcttacatagttcagaggacatgcgcccttaagggcaacatgccctcaaggacgttagaaataaaatgagtttggtacagtcgaaccaaggtttggtctgacggttggttgtggtattgcacgtaagttatctgcctgagcagatactggctgtgcgggtttaggttcaggtttgggcatcagttgtctgatatccaattgaccttcaccgtgcattctcatcttgtctggatcagacaaaattaaaatggtcgccatcagttcgtgatagagattgtctgtcacagggccggtcttcggcagacgaacaaataaattgtccatcgcttcaaccatcggctgaactcgatgatccaggaaggacaaaccatccaacttgtctcttaatcgcttgagcggattaagggctcgctgactgatttgattcttgcctgcaacggaacgctcaaacagttcattggcatcacgagccacctccctaaagagggtgtgtcccataccattgaccttgtcatctaagcctccagcttgttcagccggttgcattcgatagatggcataatcgaactgaagccgttgttccacgtcttcgatgggcgataatgcacgtcggattgcatctgcaaattccgggtgtttcgcaacccagtcaaacgtcacctgatcatagttgtccaagaacaactgcttacactgcgcaaactcctgaccgatccggtcaagctctggaacaatctgatcaattcggtcttcagggacggcatagccacctaaaaaccgcacaccgacttgctcacacaagcgctgcgcttctttcttaagcctttcaaagttcgccaatgcctcagggtcgcaaatttttttactccctaagctggcaacatccttcggtggaagttggctgccattggctagtctgaaatcttcaggccttagtttttttctaccgctccagatggaacagtcgatgtgacaaatcaaaagtttgtcgagggtttgaatactcatagtgcttcctcatgcgagatggggacgcaccactcccaacaggagcaatggcccccatttgggtggtagtagttgacgcgctaatggcaacatcactatcagaaatagtaattttgcgaatctggcgacgattggttgagatcgattttcacaggcattaagtccagtgcttcagctatcgggcgaacccgctctaaatcactgcctagcaaccgcaatacatctttttccaacttcagttggtcggatacttctatcccttcaggactcgctactgtgagcgaacacagtggtggtaattgacgcttaaaggccagtaacagcaacaatggccacgggccatcatccgtgttaacaatgccagcgccttcacctgacaccatgctgatttgattggtactaggtaatccgcttttgcaaaaccctaatgaccattctccaatcctgacctggttatcatcaataacagccaagccataggcttcaagcagctttgccatatcgaacaacgctttttgcgccagcgatatttggccattgacgtccttgcgagtacgaaactcccaactgacgttattggcgcacgcgacactatctagcgcatttgagagttcaaatggccgcccttgatgatcaataccgacgtgtccaacaaatcgataacccttgttgattttctcattgattcgtcggtctgcttcagcgttaggatcagtcgaatcaatcaatcgctgctgcgataattgaccggcttttccaaaccgaacttcaatctccttggtatctgatccaacgtaaatggcccattctttggctgtcccatcagaatgactgtaacggtaaagagcaaagcacttttccatcatcaatcctcccaatggtcaccgaagacatcagcggcaatacggtgaatggcttctcgttgctccaactcagcacgagccgtcaaagaccgaaccagtgcatactccactgcgttaggagcgcctttaaaagcaagtgttaactttgcccagcgcaccaaggtcctagtggacatcgtgatactaagctctgctccgccatccgcgcccccaataaaaagacgacgaatgtcaccggctactttcaccattttttggcgaaagacttctggcaagcccggcgcaacattctccagaatggcttcctctacagatggctctgcataggtagcttcaatgattctaaagcgatcaaggaaagccaaattctgttgaagcacaccttgatacaagcccgtctggtcaccgctgcccgcactgttgccggtagcgataaaacgaaacttgttatgtggcatgatgatctctccgccattttgtgcgatgaccaacggggcaccttccaaaatgtcattgagcccagccagttcagcaggctcagcaagatccatttcattaatgatcagcaaatggccatgcttgacagccagtgccagcggcccatacacaaaggtcatgttgccattaaccagtgtgtggtgaccgataagatcggacaactccaatcgaccgtgcgcagtaatttgctgaacaggccaattcaatcgagaagcaacttggcaaattagcgaggtcttaccgcatccagtggggcctgtaatatacaaaccgtcaccgtctgggtgagacaagaacgccaatacgtcacgtaagtcttcttttctaaaaacatactcgtccttgcgaacgggaatgtttggatgggtagtgtcggcaccatatccttccagaacgaaagcatcaggagccgggacattgaacgcttgattcacttgaaccaaaaatggggattgttcagtcatggtaaacctcatcagttttaacgaggccccatgccccaacagggaatgaagtccccgtcgggtggtgtgttgattgtggtatggctgtgtatgtaagagttcagctcgctctatcattcgtacccagcattggctacgagtgaaactgctttctgatgcactcgatgtaagcgcatgagaaaggagccgaaatcggctccaagtgaacgttaaaagtaaaatgagctcggcgagtcacctggcagaaccaagttatcttgctcaagactgattttgattggtgtttcaacgggctgctctggcttattggtgctgatacgcaaccgctcttgtggcgcttttcggtaagcggctaaaacctgttcatccagctcgcctaatttatcggtggccaattgcttatagtccaccgtgcccgccatcatgtagcggctgagtttgaccccagcatagtcggcatgagcgtagttacccatcatggcgaccaattttgactgagcgtctcgcatttcctctttcaaagatttaatgtgattttccagtcggaccacttcggcatgtgctgagcaatactgtcgagacagcgatgtccaacggtattgggcttcacccttgggaacaaaacaatcttgctcagggcattttgacggttcttttttggtctgtactaactcccaaaactgaagcgctgtttcttgcaactcagttaagaacgccgcgtctcgttgtatttcaaactcaatcagttgatcctcaaaatagaaaaccaaccaacctcgcgtgctattggcgaccagtatttgatgctgtacttgcacccaatacaactggtacgcctcgctttgttctcggtgagcttgcacatcctcaaaaactgactggcaaggacatttcagttcaacgggttcgcccgcatcgttgatgccatcaaagctggctcgaaagattgcgttatgatcggcttctgcacataacggcagaagaaagtcattatgcgcattctcaaatgctcgccttgcttgaggctccaaccttataccgcgaagcacatttggattattcgacaggtcttccggtaatacgagtccggttttttctgcccataatcgccaaggtgttttgtagggtgaacgccccataataattggggcttcagatgccgtaacccctgcaatgcgccactggtgccatgcaggagtacgctgtgataggtcgataaccttcatattgcctcctttgaggggagactcccccgaaggagagaactccccttcagggttaagtggttactttgcagcttgtgctaacgctgtttggtgctgaacaacacttgcttgaaccgaatcaattgccgctttaccggcttgaatcgaacctaagacaagggcaacaaccaatacgaagcgaatgagtgaggctgatttagtcatggaagatctccaaaaaaagacgagaccttccccctgacgggagaataatcccgccagggttagtaaaatgaatgcgaggcgctaagaagctaaaggctgtgtgagcgctttggctgcttgttgctgtgcattaaatatttcttgtttcgcaaacgtcagttcaacaccttgaaaatgttcattggcatattccaatgcactattccaagcgtttgaagcttccgcccgctcgataagcttgtaaacaagccctcgggttcgatcatcaacttgctcgggtggaatcacagatggctcaacaacgtgtgttgcttggccttcgataattcgctccgcttcgtcttgatcgaaaattcccacaaagccaaacgcaatgcgggaacactggatcatggatttatgtcttagcattcgcttagtgtgcgtctgccatggaccatccacacggtaagggccatttttgccgttaccttcaaaaggcggtcgatagacttcatccaggtattcagtgattttgactgggtgcgaacggtcgcgccggtagatgatgcattccatccattccgggcattctttcgcaccatccagtgagactttgttttctgaagtcttgaactccatgccatcaaactggtcgtgttgattgatgatgcgagaccatccatcgacacctaccactggaataatcccagcttgtttatcagggaacgcaaaaatctctttggtgaaagggttcaagccgtactgatctgcaaccaccaagagcgccatcatctgctcattggtcggtgcactaccgtcacgttgcttgaatgctgttgcttttagggtatcgaacagtttgtttggatcgacactaaagcgctcagcaaagcgttggattagctttggtttttccattttggactccgacaatcaaagtgggagtctgcccctgacgggaaagtactcccggctgggttaaagcgtttttgctcggttaaaaatctggttcaggataagtttgtgcccaattagtttgggagcccgcatcatccgtcgctgatggctcagatgctttgttcacactatcaagaagcagaaactcgtccgcgtccacttcggtcaatcgatgcttaatgccatctttctcccatgagcgcgtgcgctgaggcccttgaacaaaaagcttcgctcctttttggattaaatcttttgccctgagccctaacttaaatccaccacgatctcgaaaaacgacccgatgccattccgtatgctctttgagctcattggattgacggtcgcgccatttctcagaagtggccagcgaaatgctggtcaccaaatcacctgatggataggctcgtgtctctggctcagagccaacgtagcctatgagtgttacttggtttttcatgatgttctcctcgtcttagttgaactctgtgcacacagtcgtttctgccaggttaggcaaagaagactgacggcgcagataggttggtatttcgagcaaagccatgtcgtactgatgtggctctttgtaaaacgcaggtgtcaaacgtggcataccaggagctttaggcaccgccattggacgacgttttggtgttggtgtgagcaatcgcttgatttgagtaagtacaaatcgaaacgggcgcacgctttgacgagcaaccaatcgcaaaagcgaccagctcagttttgcaagcaacataatgcctgcgacttggataataaatccgaagatatattccattggtgactccttaattaggttgtgaaggagtcacccccaactggggaaaactcccccagttgggtggtgaaaaggcgaaccgcaaggaacgcatggttgagcatgtaaaaacatgcaggctatttgtttaaggaggctagctacctcttagtaccactgagaaaactcagcggcgggcttcctttgagctcatgctctcaggcgcagatatcactgaaacagatcagcaatatttgatagtcagtgtaaccgtcttatccagacaggatagttagaaagatgctcaattcttccacctagctgaaaggccattacctcacagaggattaggctagggactgattattgtcatatcaggagcaaacttatggcccaagcaaaacccaattactcgaagcccatctttgaacaatcattcacaattaatagcttacaggcgcaacgtgtcgttgaccgtgtttttagacggacggtcagtgcgctttacggaatcgatgtcatcctgcgcatcattggcgatgataacgaaattgatgaagtggagcagatcattagccagttgatcgaggattgcgctaaggcggtagacaacgaacaagctcgtttggacaaactgatggagaccaacggcatcgatgaagtacctgactacaccgacccgattaccttcaacgccaaaatcagctcgcctcaggttggccagtttgtcggcttagtgcgcaaactcgatgcgttgatgatctcaatggacactctctggttgtctagcgtgcttagcaacaagcaacgtgttgatggcaactacgcatggcaacagcgcattatcaaactagctcgacgcattatagatatcgaaattcgagcacgaaaatcagcccaagctaagggtaaagaagcagaagttgagcaagcggtgccgtcaaccgatgacgatatcactgaaaaggaaacagatacccccgccaactagccaactaggctcccatcaaccagcccctctcgaaggggctcttcatcttgctgtattttctatcaaaatcattaaaatgaatttaactgtcatttttggccaatttacatgaatagaactaattttctcgttaccttcttaatagcgttgttcgctatccctgcatttgcagaacacccaacatcgttcagccaggcaaaacgatttgcccgagaaatttaccaagacaaccagagtacgttttactgtggatgtagctataacaatgatggtgcgattgatgctgcatcttgcggatatgaaccaaggaagcaaccgaaacgaggagaacgcttagagtgggagcacgttgtctcagcttgggaaattggccatcaacgccaatgctggcaaaacggtggacgtcggaactgcgaaaagaatgatcctgagttttctaaaatggtttcggatctccataacctcgtaccatcagtaggtgagctcaacggggatagatcaaattttcgatttggaatgattccgaacgaatcaagggcctatggtcaatgtgatttcgaagttgatttcaaagaccgccgagcagaaccaccagctaaccgtcagggtgatattgctagaatttatttctacatgcgagatcaatacggcctaagactaagcagacaacaaactcagctatttgaagcttggtcaagaatggaccctgttgatgagtgggaaaaattacgtgatttgaggattagaggcattcaaggtaagtctaattgctatgtatcaggcagctgctagcatgtatccacaacctaactcaagtttttattcagaccacgtaattgtaaattgtcaccaggttttttagacaattaagatgtattgagtctcgcccagaaaaggtttgtaattagcaacgtatctatggcgactttgagaggaacggcggctatcaatgttcatgaatgagtggaaccgtcaaaaaaataagggaattaatattgattaagaatgaactcataagatttatgcaaacgttaactggtgatgatgtagcgataggaatacgaaaaatcgccaacctcgttcttgaccatttggatacgttggagcctttaggtacagcgcaaagccgacgcgcaaagaaggttgtagatttaacttcagacaattgggataaactatctgatgtgatcgcggaagctgctactgaggatagcagcagcgaaaataccattaagctgcttaaatcaattagcgttggtccatttcgcggatttgctaaagaagagatattaaacctcaataatcttcttgtgctaatttatggcccaaatggtgctggcaaatcaagtttttgtgaggcgctagaatttggtttgctgggggctgtagaagaagctcaaagcaaacgttttactcccgcgcaatacttaaaaaatgctcatgttaatcgctatatcgctcctgtcattgagggagtgaacagtaaagacgaaacggttgttgtttcaccagatgagtctcgatttcgcttctgttttgttgagaagaaccgtattgatagcttttctcgcattgcggcacaatcacctgccaagcaaacagagttgatttcaagcttgttcggtctggaaagctttaacatctttgtcaaagattttagccgtgagcttgatgaacgccatatcgatttagttggaaaaaaaggtcttcagctaaaagaaaaacaacagcaactagcagttcatcatcagactataaaagacaatcaagaaaatctaaaagtaacgactgttcatgagcaagatctggcaacaaaacttgaccctaaaattgattttcagcaaatgctcgtgactttgggaagcgaggaaaagccaggtgaaattcaagccttagatgcagagttgcagaaaaagcagcaagagattactaacctgtctgttaaaaagttagatgaatgtaaaagaaaccttgagacagcaaatcaaaacttgatagaaaaatctactgaaattgccaaagcaagcgaaagttgttgaattgcacccagaagtgatccactaaccccccagatttgcatcgaaaactgatccacatttttaatcaatcctgtccggttctggcaggagaatgtggagtgttagatgtggcccttttaagcgttataagacgatggtatttccgtgaaggattgtcgaaacgggagattgccagacgtactggtttatccagaaataccctgaagaaatacttaagccaagagcaggtcgagcctgcgtatccccagcgagcttgtgtcagcaagctggatgcatttgaaactctgctcacagaagcgcttgagcgagaggtgaaaaagccacgcaaacagcgtaaaacggtgaaacagctgtatcacgagttggtgccacaaggctacaccggttcgtacgacagggtggcagcctttgcccggttgtggcgtcagcagcagacggtcagcaaacaagtgtatgtgccgctacagttcgcgccaggtgaagcgtttcagtttgactggggcgagaactgggtgtccattggtggcaagaaggtgaaagtacaagtcgcgcactttaagctctgtcacagtaaagtcagttaccaacgggcctactggacgcaaacccacgaaatgctgtttgatgcgcacacgcaggccttccgggtgtttggtggagttcctgagcgcggtatttacgacaacatgaaaacggctgtcgataaaattggtcgtggcaaagaacgggtggtgaacaaacgcttccaggcgatggccagtcattatctgtttgaagctgatttctgtaatccggcagccggttgggaaaaaggtcaggtggaaaaagcggtgcaggatggtcggtatgcactgtggcataaagcacctggatttaactcgcttgaagcgctcaatgactggctggaacaagaatgccaagcggtgtggcaacaacaacagcacccggagtttaaacctcacacgctctggcagtgcttgcaggaagagcgtttgcacctgatgcacatcagcagtggctttgacggttttatcgaacacagcaaacaggtctcctcgacctgcctcatcaccttcgaaaacaacaaatacagcgtgcctgcaagctttgctaaccgcagagtcagccttcgggtctatccggccgtgctccatatcattgccgaaggcaggaaggtgacagagcatctgcgtgtgtttacgcgagaccacaatgcgccgggtcaggtgctctacaactggcggcattacttactggtggcacagcgtaaaccgggttcactgcgaaacggcgcccccttccaaaccttgccagagagctttaagcaattgcagcaggtgctgctgcgtaaaatcggtggtgaccgacagatggtcgatgtgctggctctggtgctgcatcatgaagctgaactggtggagcaagctattacggaagcactacaaagtggctgcgcctccaaagaccatgtcatcaactgcctgcaccggttgattgaagcgccgccccctgagcccgtgcctgtagctgcccatctgcaactgagcattgagcctttaagcgataccagccgttacgagcaattagggggtggttatgcacattgaggccctgcaagcactactgaaacagctaaaactctatgggatgcgtcaaagcgtgcaggacttaagtttacaaagcgctccggcctggcaacacgcactgcccatactggatatcttgctcaaagccgaagtggctgaccgcgaagttcgctccgtcgcttatcaaatgagtgcagcccgcttcccggcgtaccgggacttgtacggttttaacttccaggaaagcgaagtggatgaacgattggtacaggacttacaccgctgtgactttatccaaagtagccagaatatcgtgctggtgggtggtcccggtactggtaaaacccatctggcaacagcactgggcgtccaagccattcaacatcatcagttgcgggttcggtttatctcgacgttagagctggtgaatgcactggagctggaaaaacgcaaagaccaaaccggcaggatagcctcacgactgagcggtgtggatgtggtcattctggatgaactggggtatgtaccctttagtcaacatggtggagcgctgctcttccatctattggccaagctgtatgaaaaaaccagtgtcatcatcacaacaaacctaagcttcagcgaatggcccaaagtgtttggagatgcaaagatgacgaccgcgctattagaccgcctgacccatcactgccatatcatcgagacaggcaacaatagttatcggtttaaagaatcaagcagaaaggctaaaacagcgaggaggtgatgcttgagaaaacccaaatctcatgcccataatggctgagtaaagcggatcaaaattcgatgcaaacagtggatcagttttgcctgcaaatcaacacgaaagtctatcttttaagcaactatatggcgctgtgcttgacttaagaggtacgagtgaaaaccagtgcccagcttgtaaaacgcctctagagcaggtcacacagaacccttttgtgttagccacatccgaattagagaaactcggctacttagcgaaattagagacagagcaggctcaggcaaaatctgagttttctagagcaattcaatcggttcataccatagtttctgcttgtgtaaaatataatggagacggtgaaaatcctcttcttgctcacattgttgacgacagtattaaattagattggtcttggtgggaggctctgactcaagaacgtgaagaagtggtatcaccgtgggctctgttagctgaacaagttaaaaatcttgaacagcgcgatgttgaagtcaaacaagcaaatgaggatagaaagcttaaacaggaaaagcttaaaaaacttcgtgaatttaaagatcaggcaacaaagttacaagttcagagaactacttatgaagatgcgataaagaaagcgcaaaaagcgatcaataccttcgatgaagaaaacaaagaactaattactgaagctgaagcagagcaagtagttgtagaaacgaataaacaaatagcagtcagctacaaaaaattcgtcgatatgctctttgattataaagatcagctacccagtaaacttgttgctgatttaggtgaacttgttgtgcagttatacaatgcctttaatcgttatgatgcacctaaagatcaactagctggaataaagttaccgttggtttcaggcgaacgtattgaaattgcttatcagtctgagccaacaaagttctttgatgctttacacgtgctgagtgaaggccatattcgctgtattggcctatctatcctgctggctaaaaacttgaaaactaacagtccgcttctcatctttgatgatcctgttaatgcgattgatgatgagcaccgtaaagcaatccgagaaactctatacaaggatgaatttttcaaagagaagcagatcattttggcctgtcatggtgaagaattcctcaaaaacattcatcaagatattggaagaaaggcagccagagagtcggcaacatacaaatttttaccacaacgtggggaatcacacattcaggtcgcatctttctcttgcccacctaattatgtgcttgcagcaactactcattttgaaagtgcagaatatcgtaatgcattagcctcctcacgacgtgccttagagtacttaagtgaaaaagcttggcatcattacagtaagtactgtgataaacgcgatgatatgataagtgtttccaagagagctccaaacttgcctcacgacttaagggcccttactgaaaatttaaaggctaagattagtcgttctaaagcagacattcctaacaagttacaaattgtagaagcatttgaattacttcttggggtcaacgggcaagatcctcattggctgtatttgaataagggaacacacgaagaaaccgatagagatgagtttgaacatgggactgttgaaacaatagtttcatctttggacgctcttgataaagcactgcttggccactaggttgcagataaagctttgctggaaaactggtggaaacactaatacaactagcccggcgtttgctgggctagtgaggatgttcaatttctattaattattccccgaaatttcttccgtcgcctcctgacgcagtttctgggcatccattccgtttagccgttcaatggctctttctgtggcactttgacggtttccatccacgtttagcgtacttcctgagccagtgagtctttccagatccagtgacggtacttcgggtaggttgcccgtgatcgacaaaatacctatccattcatccagattgacttggctccaatctaccaggtttaactgacttgcggtcaaaccttcgcagtttggtgactttgcactgccccagccaaggcccaactgcggacgaacttgttcttgaatgatccgtgaaagcggcgaagtaaagcagcaatatgattgccgtttctcaacacaggcacctaagaacttagacttgcagtaagaacctatatagtggcaactcttcaatacccgcttggcgttcatttcaaactcactctgctcacatttccagataagttgaatgaggatcatggtgactgagtaaatcatgtaggccgtcataaccgtactcagaaccgcgcccgcagcgccacccagcgcaaagttaccacccgaaacgacaccatcggctccaactgcgccaccaacgttactaaacagtgccgattgcgcccccgaaccaaaggtcgtgcctacccactcagccgttttgttggtcaacacctgcataaagccagtcgcagcttgctccgctcccgcgccagcagccgttgatggcccagcccccatgagagagtcccatgcagacacaaaaggctctttgaccgcactccaagtgctcgtgattggctccctgagcgtattccacgaaccatagatagctgacgacggattcatggccatgactgccgtatcaagcttgttaaccgccactatcatcgtgatgtaatccgataacgacacgccacttggcttttcacagcaatccactatgccgccaacggcttttttgcactggccagcattacctttaaagatcgtacactcaacgttatcttggccatcagctcccgtacaagacatatcattggtcataaactgcgccgcattaagcatcgctgcggcttctgcaaagttagcctgcttgattgactctggctctaaacaatctgtgcccatacagcgaactggcccctcacagttgtattgagtttccattcgtgcattttgcacttcaacgctttgtccacagtcatacaccaaactttggatatagcagaaaccttcatgaccagccccgccttcagtgcattcggttctgacatactggcaggccgggttttgctccagcgcggcacacgtattggtggtcgtgttttgtccgttattaacgatggtttgtgtattaccattggcatctacccagctatctgagctgcccatgttgaactctggatgagcagtcgaagcattgtaggtcgctcttgctctccagcatgagagccccagtccatcagagctgccacgactggttaaatgagcaggagacgaaacaaccgccggataaaggcttccaagattggccaactcgccactaccaaccgttaacccgtcgattcgttttgtgcccgtatccaaacactgccactgcaccgcagtaaactgatccgtttgcatcaagcattggtctatgcctggatcacttgattgatgaacaacgtcttgctctaagtacttgccggagaaggtcaaggaggcactcagtttcgcaggagccaaacacttctgaacttctcggctgcaagtatcgaaatcgactttgttccagccggactcacatctggaacgagtgacctcctggggttcatgccacgaaataatcgacccattaacgactttacacaatgaaccaaccaaggttccttttggacacgtcatttcagggtatttaatggatgacttcgtctcagtcaccgtctccttgttgcccgtcaatgagagtgtcgttttccaaccatttgccttagatggcgactcggtgatttttatctcagtattttgattatcaaaaatcctcagtgtcgcgtttccagtttgcatagtactgctgtgctgtggaacaaagctgagcgtttcagagctaaagcaaccgcgctcaatggaccagctttgttgatgggtttcagcagatacacgtcgctctaactgacactgagtaagcgtgctgatcttctcgcacacctggaaatccggtacatgcttggtttcagtaaatggcgtaatcgtctgagtaggctcacaggcctcaaaactactcggcataagattggataccacgcactttggatcgctggtttgcaatccacagtcataggtatcggtaaaacgaatgcattcacctttatcattggtctcggcacattctgacgacatgaatccacaggaaggattcgcttcaagcacttggcaggcctggttttcaatccccttatagctttcatcatccacactcacttgaacacgccgacacaaaggcgatatgccagccactgggcttagggcaaagtaggattcacaaactgaaacaccattgaccaccgtacatccgttggttgaagacggctgatccgtgcattgaatactgtagtctgaaaacttcgtcgggatatccgctgcttgttcgatacaggactgtggtgaccaactatcattcatcaccaccttggttggatcaaagcgcaccttgatgcgtgcatagccctcaccactacccgtaaccgatacgcgaatttttaccagtacttctaaacctggttctaccgcttttagcctggcagtgagatcggtatttggattgcgctcccaactggtactaagctcgcagcgacctgccgtttctggtggaaagttattgttcggcccagaccagactttctgatcgccaagccacacctgcatgtagtcatcccatttggcgtactcgagaacggctgaggtaatcgcatcggggttcacgactttgagtgtgatggcctgttcgaacactttacaactaccactccagtagttgtcgcctattcgtccaatccaaacttcaagacatccctcaccacaagagcgaaggttcattggtcctgaaacatgctcaataatgcctgccgtgtaatcgtgagtaatagtgcagctgttaaccgctgtattgagcctgtcgcattgctggtaatttgggctaccttcaccttgagactcacagcctgggaagctttgggttaatagattggggtcagtttgaaccgcatcagttaatgcccaaagcggatcattgaccatatctggccgagacctgtctttgatttgctgtagcgagcgaaacgcctcacccgtagcgctactttcggatgccatgctctcttggcgctgcgtccccaattgattcatgctggtatcagagccataaacgcccgttaagacatccaatgagccctgatccataccagggaaaagctcttgcaagttaatggactcatgaccactgccattcggcaccgacaatgtattgccattgagtgcgggcatcgtccagttttgcagcaattgcttaccttcttgttgtccgcttaagccggattggcgctgcacatcagcggccacaccatgtaagggcaagcacgccatagtgatagataaaatacccgctaacactcgggtaaaaaatgttggtttcatagttaacctcccgagttacagcagtcttgccagcgccacaaaatgtagagcgcatcttcaccggcaccggggatcgttcgccactctccccatttcatggtgctttcaccgatgacatgcgcactttcagtttctggtacagggaagaacatactcatcttgtattgggatttcggtagcatgggttcgataacaggtcggcatagcgcactgttccccattgttcgtctagcaagaccacgcctgtgttgagccgcgattgcacgcgccgctaaatggctggtgttttctgctaatgagccgaaggctaaggtgtggccagataacgggtagagatggccccaactgccagcacaccaaaacaactggtcgatgggtttaccaagcgttgatgaagcagcgtcagcggtacaagcagatatagccaatggattggcaacggcagccgcttcaggctgagtaaaaaaggccagttcatcgttcagccatgttgggtccaattccgacaaatacatcaagtcaaagtccatgtaaccatcggcattgcaattgccatccatgaataaatcgagcatgaccaatagcggaaaggcgtaataatggtaatggtagaaagcaagatcaccggtgtcgtattcaccctcgccatgaccaccttgcagtcgtctatcacctaacggtaaacgaatccctcccagggaaggcgaacaacccggcgttctgaccagttcaatcagacgcgctggctcccacatgctggtaacaatacctggccttggcacgcctaagttatcttcacataagcaaaatgacttgtttgatgcgccgcttgggacactaccagagccaagaggaagacccgccactcggataggaaaaatgcatgaccagcaaacatccgtcagcaacttaccggacaataaacccgcgtctgggcaggtcagttcggcttttgcaggaatagatgcgccaaggacaaacatgacaacgagagtcagcaacagacgatacgtattattgagctttttcatgaacaagctcctttgctggaatttcttctatttcaaacgcgagccccttcgcttgaacaaacgatggggtgacttgcagatcaaagcgctgctttagcgaggcattgagaaggtaaaccggactatccaatgtcttttcgagcgcattgaggcgattccagccttgggcacggtcgagctgcgtggtgataagcgtaatgcggcgcagtgtcctatcttgcgtctcaagccaatgcgctactgcgtccacttcttcagcgttcaacgcattaaacaccacaagctgctgagtgaacggcaaggcttttagcgggttaatacgcgttcctgctgggatcaatgttcggccattggcatccaatagtggtcgctgcatgacgatggttggatcaaccattcttatccgatactgcgtggctttgggtaactcagtaaatgtttggcgagaccagaaacgctcaatggcttttttctttaacgcgcccagatcaatcgactgtaaacgctgcatcgccacttgcatcaaatccggttctaaaatcgaatgaatcggaccgcgttgacccaatgaaccggtattgccggtttcaatttggagttgcaaccagtccttgctgtaaacccctagtgcacttgcagtcaccttgtcatcgtctatgcgaaaaatggcaggcacgctagtcacccgccagtgcacaaaggctttcggatcgattcgaacctgaggaacaggatcaagtcccgccatcagggtatgccaatcacggatagccgcccccaaggtctttccttcaggaattccccgaaacaacacaatagcaccggtaacactggcctctttaaatagttgcttcagtgacgaatcccccaatgaggacgacgcaaatatcaaccattcatcgttgtgtttgagcgacgcaggttgttcaatcggtgaaaaaggctcgataaattcagatgaaccatccacagcactttgtaaaatgctgcggctcatttcgacgatctttttgtcctcgtcagacaacggaaaaggctcttgtgcccaggaaacttgaacccaagacaatggagcaaccaacaaaaataagagacatagtctttgcatcatctacctcctaccaaagcggccaagcgcgaccgacaatctgctcgcgcttaacggcattccaatagcgggagtcgaaactcgtagcagcctcgccggaaaaccaatattcgttttcttgcagcgtcaatgagcggctaaattgtgattccgccacaccaagacgctgggctaattccatgccggtagagacttcagcaccgttcactagcacatgctcaggcgtcacattgacttcatccccaggcatccctgttaggcgtttcagcatacgagtaccgtcgttatataacggagcaagtccttttgagtggaaggcatacaaaccatccttaacgggctctttattccataggtcaatcagatacaccgtggtatcaggcaggcatcgctcttgctgggtatcaatacctattcggtagcgcatcatggcgtaggtgcctaccaaggccatgattaacgcaagaacggtcaaccggatgagatatggccgccaaggcattcttttacggagtatctgcatgagacacctcctttgagcctactggcacaaatacggaatcatcagcacccaccaccgcctgggcatccagcacgataaaaccggctgcttttagcttttcaatttgctgattggtctgaagcaacctagattcgatgtcttgttcgctggcattggggcccagtgacaacaccgcctccccaaaatccacgactgcaatgggcgtacttaacgccaactggctgtggatgggttcgagtgttttcattaagagccaactggtcattaaaccgctaccagcaatagacaaagtaatagaggccataaatggccaaagcgtggtcttattcatagcctcgctcctttaacaactgggagatggcatcagcaacagaaaggcctttgcgcgttaactgcttaatcgcgtttacatcttctgcacgggacgagtacaacagcttgtgaaacggatcgacgataaggcggccaatcccggtgcccatctcggtaataaagaaaatctcggaatagacacccgtgacggtatgaaccgttttcaggtattcgtagccgccttcacctaatggcaaacggccttcttttttgagcgcgttgatggtttcggctttttggccaagcaggtacatattggccgagttttcagcgatggctttacctgtaggactgtcgtataaatcgttgaccgactgcgttactgttacagcactgccgccatattttcgaaatcgacggtaacccgtctcgataaacttaccgacatcaccttgagtcagcagatcccaggcttcgtcaatgaacacaatcttgcgacgatcccgctcacctaagtacatctcctgttggatttggtagataagctgaagcaacaccacttgttgcagatgcttacgccccttgagctcttctaactccagaacggtgaaacggtttttgaagcgaatattgttgtgaccattaaagaagcggccatattcgccctgtgtcgtaaacggatagagctgctcacccacgtcctgcacacgtcggtcttcatgattttttaaagcctctgccacatcatcaaccaacatggcacgaccttttttctcccacagttcacgggtctgacgttttaggttggccatctgaaaatcggttaatgactgcgtaggtgcggccattgcggccaataacccaaccagtacatccgcttcttcgtcatagtcctcaacgatttcaaacggatttaagcaaatgccactgtcccgcccgaactgtaaaaactccccgtcatagacttcacacagcttttcataggagcggccaacatcaatcacccagcattgcccaccttcagataagtaggaagagatgatttcgttcaccaggaaagacttgcccgatcccgattgcgccgcgatgcaacagttgtaattactgcccgagtcataaagggatacactcatgatctggccattgcgggaaacaaagttaatcaccggcgtacccgtgcctttccaatccgcaaacaaaggcaacagagggatgacatgccgtgtcgccatggtcttgaatcgaaacaagtcgttcatcgcctggcggtcagcaccaaatggcaaggcattcaggaaaatgggcaaacagaagtacttgtcttccatcagctcaaatccgagttctttgaaataagttcgagcatttgaaacagagctgatcgacgcttcttccgttggtgaaaacagcgtcaaagtcatatttgcccgaataggacgatcaccttcttgcaaggcttcaaaaaggacatcaaatccctttttcttggctgcaagcaccggcacaaacttgagcatcgggccataggcctgattgaccgcccattgacgcttcgtctctaaacgagatcgcatggcctcggctgaaggaaagtgaatggtgacattcagcaaaaagctgccgcgtaaacctcgactgcccgtcatcatatcgcccgcaaaacttgcggcatgaccaaaccagatccgctcaggcaggcgcttaaatgataaggttttgactcggtaatcgcccagcatcagaccttggctatccaccttgatagctcggtcataatccaacacttgctctcgaagtggtttatcagcctcactgcggactggtgatggattacgccaggaagcatcttttccccagttaagctgcgcacttaatgctgcgagccaatttcggtcagtcatctcattaactcgaaaaccaaccgttgccagcgcctgcgagaaagaagcccgaagcgcggatgctcgactcaactcacgctcagtcggtataggactttccaaaggcaatttgcaggtgacgatcagttgaaagttgcgtacctgagtctgggtcgattcttctatcggttgaaccgtgccgccatcgaggaaatccgcacgtttgcgtatcgacgccctaagcaatggatcggattgacgatgccgtaagcccatcatgcgctgaaggtcggtttgaatatcaggcgaggcgtacaggccaaattgcagtaaagtgtcttttggccagtcgttgttgagtagaacattaaccctgtctgcaacagactcatcaccaccgggcaaggggtcacatagaaaaccaaaaccaacactctggtcttccatgaaaaacagttgctcatcgtctgagtaggccaacacaggcaatagctcagaagcgcgttgccctgaatacagagaggctttcattaacgcccctccaaccaagcagaaaggtcataaggacgacctctgctgatgcgaccatcattggcgacaatgaaaggtacaccttgaatgcccagaatttgagccgtcaccaaagtacgctgcattggctccaagttgcaggcatcatcctgttctaggttaccaatccggccattgagcaatgcatcggtggccgctttcttgtcacgcgcacagccaagctggcgaacctgacgctctgaatcaggaccaagcactggcacagggagaatttggaaggtgtattccttggttagcggtagggcttgtttcaaaagctcatggcaatgcggacaccggggatcaacaaagaccaccactttctttttgccttcacccagcgtcagtggattcaaatcatccatttttaagccaagacgacttaagtccagcgtgttacccgcttcacgaatttcttcaaggctggtaagcggctttttcgaccaggcatcatagagcgtgccatcaatgacgaaccggccactgtctgacatgaaaacaatacggccattgctttcgaccgctttcatacccgtgaccggcaaagaaaccatgccgtcaattttgccaacgggcgacacttcagacacagattcagcttgaaccaatggagacagcgcaagcgccagaataattggagatagttttcgcatgaggagtcctcgttaatgtaaatcgaggctccagtctatgcagttgtcctatgtggactcggttagatagattgaagaaatcgcaatctaactagggggcttatagctcgttgaggtttgttataaacgaattactcggcgtttgcgttaacaagccaatcatcaagcacttgcttcaatttatctaattgctcttggtgttttgcttgattctttgccaatttgttaatgttctgcaatttccaacgaatcgctggcaagtctgctgcattaggatagtcaaacaatgcccagtcaggttgccctcttttgaatgacataaggaaagcatgatccctttctgtgaaatgtttttgcagttcaattaacatcatgggcctaacagaggctaagtcttcgcattcaactttttcaaaagtcattccgtcaaattctgcctgaaatttctcattcagaggctgccagtttggcgacatgacttcattaataggccgagggtgacttaatgtataggttaaaaaacccaccaaaatctctctcgaaatcccttcactgccaagtaacatacgcacatcaaataagtcgcgaggatgttggcgatccattgcagcacacaatttcccaccatacagatcgggaagactgactacctgaatctcagcataaccaaactcgtcttcaacagactcttgaactggcattatttctgcactatgcaatgtacctctggcgacgggcgacacttcaattttgatcgtcgcaaccggacttgatacaactattctcagttcatcagctttattatcctgaaatgccgctctgatatctggttgagtattgattctgtctgtaatgcgctgcaatgcagccctgacattaatcaaagcctcatctcttggttcaagtggaagataagcaagatcaatatctacagataaccgaggaaaatctctcacaaataaattaatggcggtgccacctttaagtgcaaaaaccgtctctgttgctaccacaggaagcattcttatgagcaaggaaacctgtttgtaatatgggctatctttatccattatgttgttcaccttttttgacgcttaatatctctggcactgtgatttgatatcgctcatcaaaacgtcctttttcgacaacctgccgctttcctgcccccaatttaattcttgtttcatctacgcgattgacccactggtgatcgtagtatcgacccagaaatagaaatattcggtttgcctgaacagagctgcttcgttcaagaatatcttgtacttttctagggctaagattaactaaaccctgaaataattctgcgacatgctcaaatgaaatcagctttccaatcgcatctaccacttcataggcagcaagttctgcacagctgacagtgagctctttctctttaaccgtgatccttttcaaatctttctcgggattcacttcaagcttatggtttccgcagtaaaaccaattttgataagggaattcacgaaaccatttcggtaaggacgacttgtttttaacgcaaatccaaacttgctctttgttcagctgcaaatagtgactcagtccttggtgagttaagctgctcaatccagccaaatgaactggaacgcccaattgcacatccaatgcttgaatggcatcaacccaagttggctttatatcgccctgcgcatttggacgatagtacacaccagaactaagcttcttcagccaaccgttctgcgcgtacttttgagccaacgagtagctcacgccgttttcagtcagccattgctgaagtactagcgcaccaggagaagtatgagcaacaagccagtttattttagatgacattttaacatccaaagtatgaatatcacgaacagtataaaccatatagtttattacgataggaattttaacaccttaggtattaatataccaaataatgtaaaccaagttcgttaatgtggcgtcgctgaaatgaaaaggtctacacaacatcaccaataacccgatgttgtgtatacctaagtttgattgccttaagtgaactgcttaatatggctcacattcaggtgcccagtaagacgacgctgattgctggaactgttgtgccaatgacttcttgagtgctggcaacaacaggtaaagttgcagacataacactttcaacgactgttggcgtattgtagagacccataccgccaccaatgcccaaggcaaaagccatcaagctttggcgagcgataccgcccacaatacccaccagaaccatggctcccgctacgatccgtcccaaagtaccttgggtccaatcttttagggtatcccacacatcagtgaaagcatcaccaccggtgcccgcaaatgagggctccgaaatcattaacgccatcaaaccaagcgcaccaatggtcattaggcgcaaagtctgaatgctgcgaactgcatttgtcattcgttagtttctccgtagatactcaagttatcgcgcttaccatcagctcccgctgaggctgaatcgctttgagtctgaagtggacgtagcactggcgaaaccgttcgaggtgcggacaccccaatatcccaccggcgcggttcaatttcggtaaacacgtagctggataaattcagatctccacggtcatcctcccaaggcgcaatccaaattcgcatcacccttgaaggaatgcgaataggtgcagattgctgcgtctcaggtaatgctggatggctcaacagtcctgtttctaaatcagattgtgaatacccagagggagaaccaattcgagtcgccacagcatcaatcgtcttgggtgcagcgccattactggtaagctcatagacttcacgagcggataaacagcgcacaccgtcaggcatacctgggcatccatattcactactcccaagacccaatgaactacagccagacaataaggttgagccgactgccaataaaagtaatccagctttagaccactgttttgactggtgctttgggttgttctgcattgatgtcgtcatggttaactctcctctggatacacatcttattatctgaagcggacttcgatcggttagcaacatgcaggattttttcatcttcttgcacctcccccttgtgaagtggccaatgacaacgaggccccacgagtgactatgacttcaattttccttgcagcgtctacctctatgactgggaacatattttcagccatgtccaaatagaacttggccactcgatccaatgctttacctgtgcctttaatcgcagcgccttgtaatgcttcttggctcatgacttgctgatacagctgagtatcaccggcattacccgtctgaatcgtcggaacaggattcacatcaaatgcgcctgccaagccctgaaggaatccggccatcatcgatttggccaccagctgaccttgtttcgacactaatcggccacgaataccggctttgccgtcttcacccacggcataagaatccagccgtgtttcaatgacgccaccatcttctctcacacatgaaatggtttcgcctcgcaaataagcacgctcagagctcaaatcaccgtaacctgcggcgatcaagaaacactctttgatatccgctctaaatcggttgggtaaaatggcttccttttgaatcctcagcaatgcaggaaaaggctcgcgtcttgcggactcgtgagtaggtgcatccaaacccgtgatcaaagtacccgagataatgctgcccgccggtagatacaaaggcggcgcttcttgcacaacaacctctggttcagcaaccacttcaggctcaatcatacgaatcgtgattggcggcaatggaacatctcgtgctcgtgtaccttgaccattgactggctgctgatagagcggatcaggcagcggcgcattggcaaaatagtcgtctgggttagacggcagtggcttttcgtctttaggcaattccatggcagataaaggcacttcaaaacggctatttgtgccttcaactgctgcatcacctccagcgcgaacatcatcaagttccgctcgaaggcgagccaactccgcattgacctcacttggtatagaaggcgaacctgggcttagccgtcctgaatcgacgtcacgacgcaagcgttcaacttcacggcgtaactgctcgttgcgctcactgagtagttttacgttcgcagccaaactatcgaccccaacatcacgagtattggtatccgtaagaatgtgccggatcgtttcctgtcggttccgactgctcgcgccatcatcaggattaggtgaaaacaccatcaccataagaatgagaccaccagcaataccggcaaccgataggccccgcttcatgttcgggctcatttgttcccattgtgctttcatcgttattcacctcccacaagaagcgaaggtcgctgactttccaccgcttcttcacgatgattgcgaacaaccacatacaactcagtcttttcacccggtaacaagatattgcgaggccagtaggcgcttgccactatatctggtgcatgacaagctatttcactggcttctatcggctcatcggcaaagctttcaaccagtcctacatagacggtgaagtaatgtcccgtcacaatttgcccctgcttaaaaccaaactttaagccaggctgaaaacatttcgggcttgtgtcagtttggccagctaaacggatgtcatagccttgtggtaactcatttagtgcaaggcgtctgagtaaatcacgtaagatatcgacgtatggctgagccgtttcccaagtggcggctttgcggttcacgacgcccttaataggccactgctgaccatcaatagctaaggtgatttcacgcggtggaatacgacgaggcactaaggtgactgataatgcgggcgcttcctgaccaggcggagtgatgtaaagtgaaaccggtgattctttgtccgtggccacatatacaacattccccttgatttgcgtctgagcatcactggttgttctcacctgaggcgattcaaacggcgtcacaatccgattcagatgcccaagagctacagggatcagttcattaacccccggtgtcatcagtagcattgttggcacatccgttgaaaccggattggtttgaacaggtggatttgctgtagcagactgcttcatcacactggctggcacaatcggcaattccacgtctgcatacgacgcttgagataacaggacgccactcaagctgattgcgattaagcttggtgtcatccatcgactaattttggttcgcatcattcaccctccggttttgctcttgggtcaacttttcacgaacacgcttcgttctagcttgcccctcatacgtatccatccaactgagctttggacggtattgctcaatatcgatgtcaaactcataagtgcgagtttggcgctgttcatctccagatggtccagagaccaaggaataaccggtcacaaagacatggccggtttcatactcatactccacttgtctgggttggaatttgagcgtgactcggtcttcacggatctgtcttgcctgaatctccagtgcatcgaccacttgctggtaaaccgctggagaaagtagcggctcaatggcaacccggataaaagacacattacccggcgtcacgttgcccataagctcagccaggtagagcccccaggattccaagtaaggctgagtagcttggtttcgtgacacttcagccgtttcagacaaagttggcggttgaatggctaccacggtattgcgagaaaatgccgctaccgcaagcagcaagttagatagcaccagcaccgcaatcaggaaccgttgccatcgattctctaattgcgtgccttgccatgattttaaaaacacgtcgaacttcacggcagatagctcctgataaatgggttagggattgtcttggctttggttggcaacagcccggcccagtagatggcgtgaagaataaaaccatctgggcgaccatcacgaaaacgccgatagagcttggttgtcaccaaccccaacaggcataaaaccaaggcattaccggtaaaaatgccgatcactagccccaacagaatgggagccatctcatcggcactccaaagcaggaagtgcggcgggtcatcgatataggatggaatactcacaggttccatagtcactcctcgttgtttgaattgagaagtgaagaatgccttgggattgtcaggttcagtggtcagctagatgccgaattcttgaatgttttgagggttctattcagacaatactaacaattgatctttttgatgcggttgatatgatgaggatattggtcgtgtcgagaccagctgcccactttagcaaacccggacgggacgacatgcaaatcaaatttattttttgcttaggttttttctgcgacctcggcagtgggcaccgtattcgctaataggagaaactcaatgcaaattactaaaatcatttcctctgccacggttgaacgtttaaagcaaaaagcacgaaagcttaaacgtgaaaaacccattacacacactcaagcacttgatgaagttgcagtatctgctggttttaatcattggcatcaagttgtgcaagctaatgacctacttaaaccatcagaagtggcgttatcttctggatgtgtcatggcttttgatgtcaaagatggtatggatgtcgataccagtgatggggttttaattgaagaccacttcttggaaatgctcactgaaaagcagctatttgaaatttatgccaattcccctgatgaggaagatgagcaaaacaggccactaaaagaaacgctatcggattcagagcttcatgagtattttcgagatgattgctcattcatgtactttcgcctagccgagtctcatgcaaacaaaccgttaaaagaagtattggctcttatacgacagtactcattttggatgccgcaatatatttggcttcaaggtcaccttattgatacttatcatttgccagcggaagacgagaatggcaatgccgtaggcgtcaggttttagctctacaagatgaggcctaactggcctcatatcttcttctgcaagtgacttaacgccaaccccgccatcaatgccaaaccgatgatcagcgacggcaacaccaccggtggaatagccagcggggcgaacaatcccataaacagcaaaatgacacctgagcccaggataatcatgctgtagcggtgaatgattgggctcgaaaaatcaaaggttgtcttcttaatcttccaggtcatcaagccgtcccacagcgccggtaacatgagaataagcgcaaagggtaaccagaccatcagtaaagcaaatcgagtaaacacttggtacaacacatcaaaaaatgcctgaatacggtcttctacccacacaaaccaaaagcctcccatgttctccatccctttagaacgctgtcgttgctcttcagtggggattaaaaaatcacgcacagattgctccatctgcgtatccacaatccatgactgataccagccatggctagtttgaccaatccaatagcttgtttgtgcgcccaattggttttggagcatctgcttctctttactaatgacccggccagtccaatcaccgggcactaacacaccaatggcaataatctctagcatcagtgccagacacagtagccaaaccgacttatgcttgctcatgccaaacatcctcttctactcgggccagcatggcagcaacggttggcgtcataatccgggctttaatcacttgttgaagccgctttgtcgtcgtatggccactgacataacgcacgtcgatgcgtccttcagccaaattcgccatccgatttggacgattacgaatccaggtgtggaaatacacaccatctacggcagcccactcgaaatggtcaggatcacgcaggcgaatccccgttaaagcactggcggcagtccaggtcagtgcctcaatgaaataccaaaggcgaacactgtcatcatcacaactgacttcttcataactacccaagccattgcacagacacaaatcaaagatggaatggccatctaacgtgagcgcatccgttaagtagtccgccaagcaatacaccgaggccaaagcatgaggccagtcggtttcaagcagtcttaaggtttccttgaactgggggttatgttgctgccactgagcgagcatttctttactggtaagtgttgtcattttcagacagacagaatgatgcatacagactccttatgctgcctgtgtagagctggttaaaataggaatgcggcctttgatcacgcggccacctgaaagcttggcgatgtactccaggttgggaagctggcctaataactgcggtggaaacatatcgccttcttcctccatcaagcgttcgccatgattgccggtaaacaacgcggggctgtccgagttggacgacataccttgcgtttgcatgatgtactgcaaccgagtcttaggcagattgtcggtaatgtactgctgcgtttcggcatccatcacccgaagggctatcaagttattgatgttacctaacacctggcgagccttagcttcactgcctgttcgagctgcaaagtcagcaaaggtctgagtagcaatcacacaacgcatttttgcgccacggcctttgttgagcagttgaatgaagggatcgttgacgacttcagccgcctcatcgatgaagatatttacgggacgattttcaacaccatagttatagcggtcaccggccacggcggtgagatcggataaaagcaacgaaccaatggcgctgccaaccatggcgtcggtcaatgaatccaagccgatatacgccacttgggcattgttgataatacggccagaatccgtaattaaccggctgtcatccacatcgtttgcaatcggtgatagcaatggacctagttcacttgatgtgagcatattgagcaccggcatcaatgaggccaccatctttgaatagtgggttctgtcatgctcaaacatactcaaaaggccctccaaatcagtattggcggcaacgggctgaatgcgttcgtagtagaaaagcagcatcgccatggcttgtttagccaaggtattggccttttcggtaaagcgcttgatctccacactaaaattgggatacacctgctccccccaggctgtgacggcttttactaccaagccttctgggccaccttccaaaaaacgcctcagtgttttcagatcaggacgttgtgacgtaagcaacaaaccttgcacgatgttattcagtgccatttggccaaaggctttaaatggatcagcaccggtttcggatgggattaaggccgcaattcggctggcgatttcagtaccccggttaaagttcctcaggggattaagccgtaccgaatgctcaggaaaacccggatgaaaatacacaaagcgctcaggactaccggcggcaatacaggctcgctgcgcattatccttaagttccttgtctcctttggggtcaataataatcacggcttcattacgcaaaatggcctgagtgatcatcgcatcaaagcatcgggtttttccggcaccggtcgttccgacaattaaggtatgcccctcggtgtgaccaactggctggtacacatcttcttctttgggctcaacaccatgaatccaggtcgaacccatttgtttgccgtgaccttggttaagcaaggttttcttatcccgctttaagatttcataagcgcgttgagcatgacgttgatcccactcaaagccataccctaaccacaattcatcaggatgttttgccatcaccttttgcaaatgcgacagctccataaatgccaatggtttaccttttagccccatctgcaacttataaaggcgataagcctcaggcaggcggtacaacgccatgcccgaggaaatccctgtcatccaccaaaatggctcaggtggtagctcagtcagcatttctgcggcaattgccccagttgcaccaaccagccaacctgctgcggccatggcttcatagttcgtgcgccaaggcatctcgtatgcgttttctttcattcatgctccgcaaaataaccgtttgcaatccgattaatttcaaatggattaacgttcagcgtgagcggtaaacagaaccgtttccccctcatcaaactggcattggtcactggccgagatcccccgaagcagctgtccggctggaatgccatgctccttggcgacttggcgtaaggtttgaatcgtgacgcgaataccatcggcactatgatccacgtctgggtaatcgccatcggtcagtaagatgggcaaatctttcacaaaattaaccatctgttgccgctgcgcgtgtttggggtctgtgcttgagttcgcattgggcgcaatcggcttttgcttacgctccgctcttttggcgggctctcttgcttgggcattggttgtcttagttcgactcggacgctgtgaagcctcttcgttctgaattgctgccgctgattctgcgtcttgtttaggaaggtcaatcagtgaagtaagccctttagaaatcgatactttcagcagcaagccttgctcctgaacgccacctttcgtagtcacagttctggcctttcgtgtcgggtttgcgggatctaattcaagccaatctaatcgactgagttcagcaagcagttttcggggagcacaccaatgtcttacggcatcgggatagcggatcaggacttgctcaccaaccataaccaacgcactgctggcctctgggagccacaccaaagattcagggagattcaatgcttctgcatcgtgctggtttacgttatttgagatagcgccatcatatgaattgttaggcttttcatatccatcacccggaacgttttcattttcctcaaggtgattaacatcactggcatgacgaagttcatcatcttgttcggacgagtttgtcgatggtgactcagtcgattttctatgttcgattgatgatgacgcttcaggcaagtctgaatgctcactggagcgactctgtggctctgcttgtgtttgctgtgttgcttcccactcagatttgctaaacagtctcacactacttggtacattcgagctgaacaataaatcggcctcagatatatgcagcatgggtaaccagatgggcttgtcgtctttgatcagcacttcaggggcaaggctttcatatcgctcattcgaggcggatttagtggccaatcctcgctcaataaggatgtccgcaagggtatcgggatctcttggaatgccaggtatcttgtctttggccaacagctcaataatgtccttagccgcgcttttccaaaccaggtaaagatgggttgattgattcgattttcgtaaccagactctggcgtctcgctgattgaccagccactgggaactggcaagtaatcgcctcatggcatcaagtagatagcgttcgactgggacaccaagggcattgtcgtcaacggaaattcgttgagctttcaggtctcgctggacactggtttggtcagcttcaatgaccaatttagacaggacatgctcgggatcagtattgccaattgcctccagcatggcttgcaaaatctcagggcccggctgggttaaccaggcgagcaactcaggtgtcatcacccggtttaaaaccagaattgaaaattgctcgtgccgcttgcaccgtccgtcgcgccaacgaatgaaatagcgttcaatgctgttattagtggcccactgggataaggtttctaaaaatgggttccactgatagcgtccatcttcgtctgtgatggacaggtctgaaacaggtttaccaatatcatggaacaaaccgccaagagccgcagcaacacgccaccttggttccagctcttttttctcaaccggtgtgccactggcaacaaagatgatcccttcagctgcttgtgccgcccagaaagcaacttccaacgaatgacgtaataaaccaccagcaccactgtgatgatgatgctcagaagctggcagcaagtgaacgtaagcagccagatggtcaatgcagggctgaattagcctttgaaaatcacgcaggttaaagccaagtacttggcgcagcttggcaattagctcgtcttgtgtggactgcaaatcctcgggtgacgctgctggcaacccctttagaaatggcggatagcgcggaatttctgcatcgagttgagatgacagatctggtaatgctttggcttgaaaaaataggtttttgaacatagtgaacctccgacacgatagtgtgaaggttcaaacagagttgtttagttcgatagcttcaagaatcttgcatcaaactgccatgtcattttcaggccaccaagaggttaatagcctgctattaatgttttacgagttcttttgatggatactttagttgccatgtttcaattagaaataacgctgcggtgcttgctgagtgaatagctaacttggctatacgggcatctagtcgggtgtatccacgctctcgaccatgagcatcaccaccatgtgttcgcagagctccgataccttcaacaatggttgccaatccagataggacctttcttacgtcatcagcaatttctggatttacattaatttcaccaggagacaaccctagtggtcgctttactgagtcaaacaatcccttaatatctttcttcttaggaagttcaaagccaagttcaattatgatcgaacgacacacactctctaacgtagaacaagccgatgtgactgcactttccggatcacgaaaggcgctttccagggctctatcaaggtccctagataccgtatccatattcaaaacttcggctttggttgagagcgttgctaacactgaagcactaacacctgtttcaattttagctaaaatttcaaacagttttgccttctcctgcgggtcttcgggtttgtaatcacatttatactgccaaagttttctgagtacttggccaaccaagtaaccatcctctagctcaataaaagatcttaaacgtttagcctttgagcccccattaatctggtacttctcttgggtaatatcaatgctaaactcatcttcaaaatactcagccattgtcctatctgaaaaatctaacagatagccatctgacatctcgaaaattttatctattgttctaatctcagaaccttttagttttggcatgagtaatcctccctgaccatacaacactgtcccgtcatgttgttagccaaataaagccttgataagcagatatgggtactgaaattaatgcactagccaatgcaattgtcttagccaaccggctttcaaaaagcctatcaatgagaacgcccataccctttgagttcgttttaagttttccatgagctagcttatcgattactttcctgtaaaacccagtcttacacagcgtagagttgtgcattttgatgaactcattgctcttgaacgcttctacttcttcctcaccagttagaaaatgccgatggatgccaccattcaaattcatcaatgactttaatcgaggatctgcaacgtaaccgctgccataacggtcagacaagatatcattgagattaattcgtcgttcaacaggaattaccgccatatcggttttaccaagcactcggtatcgatgctctaaatgttcgaaaccgtaagtcagattacgcatattccagtgaatccagtatctatctcgacgatcacggacgaattcattgaatttacttagtaacgcacgctcaatatcatcgagacgttgatggatattgtcccgactaataccaagttcttcagcaatagcatgaatagaaaaactcactgtctggtctgtagacaggtgcagtattgcaatcgacgtaattcgaggagataagccatcgttatcatcattcaagctttggcaagaatagtgaataatgtagaaattctgaggtgtgcgcttaacctcacgaatgaattctttgctgttaacgatagtcaatcatcttaccccaacaatatttaaaatcagtcaagcagtatgcttttttgcataagcatctgattattctgataaaacggaacatccgtatttccaagaactgttggtggtacatttgttagctcaactagattatccattggaacaacaaccgtcttcgcgccattctcagacaacattgttatcttgtcagcaaagttaattgacctttcaatcgcaccgccaacggatatattacccaacactgcaaggccagcctttaggttctttttgtaaagagcagacacgattgcgatataaacagccgagccaattcccgttgatattgaagcccccagcatattggtcacttggatagtgatatcgtaatttttaagcgaatgctgctcacttaaaattgttttttcattggctttaatatactgataagtgttcttgatgttttctttgactccggtgttacttacaccagaaatattgagtttcccagaacccgaggtagtaacagcttcaatacgaacgagcgcgacattgtcaccatcacttgtactggtgtaacaaacaccaggcggcagtggcgtattttcgattaagtgagatcccttttcctcaggcaagccaacaaagtgctcttcctgcgtttctttatctatgtaagaaaaattcgtatcccaaaactccattccaccgattcgctttaactgttctttcacgcgacgtcgcatttcaagagctatctcgaggtattcacgcacatcttccttggtgtattcaccattcgggtgaagcaatttaatcagacctgataccgtcttttttactggcttggtgtcacgttgttttaagtgtgaacctagcgaaaaaaagttttcaagagcatcagtgtatgtaacgcgacgaaacgacttcaatgcttctgagaagtagtctgtactgaaaccaaaattagatgtgaagtgttttggagcaaacttgatcatttcccacccaggtagataaaaatgaatacgatcaaggaatgcagtatcgttattcacttcatcagaaagaggactaaataagtgagatgtttgcaataccgtctcaactggttgatttatattgccgtttaggataattgaagcaacaccagtgatttcacctcctgcaccagctcgcgaaaacgagccagactccatatagtccttcattaaaggaacagcatccttttctttgaagatcttgtccgttgcctcatcgaaacatatcgcatcccattgaccaacggcaccaactttgccagtagaaccgtgaacaaagagcttggcaactgttccttgaccacctgatataagcacggcataaggtgtaagctctttaaaaacgaacgacttacctgttgaccgcggacctaactctacaaagttaaaattactctcaaccattggcagcagacgtgcaagtaacagcatttttacgcgggttgtcatcccttcagcatcaggctcatatccacagctacgtagcaatacattcagccattcatctctcgaaaactcatttcttttctggataatcttactgttatcaaaagtcgacagttgaataggctttatatttgtcactacaaacggatatatgttttgaccgattcttatgtcggggtcatattcaacgtcaataatggcccaaataccacccatcaacatcttctcatgctctttcacaaggccatcacggatattaccgttgttaatgttgctattttgaagctgagcccaatagatatcttttttcgaatccagtttgacagaaattttatcgattattttaaatcgacctttttctcttattttagaatgtattagagaactttcttcagggttaacgtagtgctcgctaagaattttcttaacgttttccatgcctactttaattttttcttcatcatcagtagagcaagaattagcaatcaaatattccaatacaaataccggtacgttggcaccaacttttaccatacgcactaagtctttctttaccacatagcctcgaaagtgctctaacagcttgtgatctaaatcgttcaaaacagccatcgcctattcctctatcgcattctttaacataactggccttaaaataatccgccaaggtcgcggtcgttattctttttaataagaacacggtcaagctgctgctttgtcatcgcgtctaccagttgcacctctatctcattatgaccatcaaaggtgtactctttagtaacctgaccattactctgcacggtaataacatcgctcttgttcacttgggctttgttagcaaagaacaacaacatcactttacggtctagcgtgaacatatttccttcacccgattcagcccgcagttttagctggtacagctctccagttacactgaccaagtcatgcttgttcgcaatagttacaggcagctctcccataacatcactttcttgctcccaacaaaaataaggcgtcaccaactcctgaggtgctaaaccgccatgcgcaaagccataagtgccaggggttttgaacgggttcatgctgcgggcgaagtaaagatagttgtaatctttgtaggactttgccacctcaataaactgagggattaaactttcttgcttgtcactggtccagataaagcgttcgtcaatgtagttttgccctgaaggcttaaccactattttatcagcttcgcttagcaagccagtcaacacgaaaccatggtcggtgattaaatacacttttccatagccgatattgagcaactgattaatcttttcagcaaaaaaatcgatagattctgggaaatatttcagcgccttgtgattgagcttatcacccatgtcatcaatatctttataggtacaaattagcacctgacccgaaagaggctgatcacttacctcatcaagacgaatgtaatcgatatcaatgtgtgaattttgggctgaaagatacttttctcgcttgttttgaacgggctcaaccacaccatttgccatgtagatatgactcatgttgttttcagtttcggatggacaatcagccaaaatatgacggcgagtaagtgtactatggttactaagctgcttaaccttgatagcaacctgctctgcaatctcataggctacgccatcgcctacaatcacggctattttgctgttctttcctgggcgatcaatttggatatcgcggtcaataatggcttgtaaaatgccagtttgatcttcccggtactgactgaaatactggaaccacttatctaaaaacagcgtaacgtactctttgtaaagctcttggaaaggctcaaggctgtcacgttgttgcataaattcggtgtacaaattacgtatggcagtatcaagcgggcagaaatgctttttgtaaaattcaacacattcagcaaagctgcttaaataggacatatccttcggatcaaattcgagcaaagcaataatgtcgttccaaaacacaatgcccagcgcttgtgcctgtttgctttgatggcgttgtttcagcctagcaactagttgtgctgactctactttagacaaagatttattagccagtttattgcctaattcctttaaccaagcttcatccacctgcctaaatgggtggtcgggattgacctgccagatagcactgctgttaataaacgctgaatccaacttatgtttggtgaggtatgagccaaatgaattgcgataactcaccgaatcaagccaactgttgtaaactgataacaacgttttatcacagtcattatccgccaagccctttaacatcgcagatacaacttcagacgccagggtagatgcaggtttatcgatatattcttggcctagcagctcattaaccttgcggtaaaaggtttcacgcaactgtgcgtcgtatttttcagtgacatagttttcgggatcatgaacaaagggcagcagttccttgtctaaatcaaagatttcagaggcccctttgtggcttaagtccatccagtaggtacgatccttacccacactcacttttgcagcagcgatcaactcgtctttcggcaagttaatatttaagtttaaggtccggtgaactttatctttgatgtagttctgcaaataacgaatttcgatgcaaccattggtctcacagtactcgcgtacgaaggttaagtcttctttgctgagttgcgtatagataacgtacttgtgctcagatttaggatgctcttgtaaggccttttcaacgcgatatttcgcttccaactcttcgagttctccattggtgcgatacacatcacaatctcgttttaagctcttcaatagaaactccgcctcaccgctttcatcaataaatatggccacagggtgctgttccaagatgcgcgctaaatcctctttaaaccaggtatcaatcatagtcgggcatccttaccaatcagcgttcaagtatttttttagctgacccgcatttaacacgtcataagccagcattttctttttttgtaacggcgcgatatttttgcctacaccatcatcaagaatcgggttgtaaccttcagccaatagttcgtcgattttctttttaaaggcgtcgatttctttcaattgcttaaagatgcgctctttctcgttttgcgcttcagcgctttcattgccagcaatatcactctggcggttttgcaaagcgcgttcacggttttcgatatacacagagcgcaagcgtaacaagttatcgcggctccatttatagatgatgatgtaacaatcgaagccttgttcagggccgctggttaagtgccagataaatggggttttaggcaaatacataaacagatttaagtgatctgaaagttctgcaaagaaatatttatttagatagtcatggattggccgtcctaaaacagaatcaaagcttgagtattgagcagtactaaaccctttttcgaaaaacttctcctcgatacgatcaagaagcactttctcaccggcattaggcactagtgggataatgccatcttcatcttccattagaatttcacgaatcatattagccaaaaattccatggctaacgtttgcatacgttgcttagggattactttgctttgtttgaaccaataccaaacgttaatcgggttgacctgatgtcggatacagaactcctccagatcgttgttgctctggtaaaggcttccaaatccactttcaatggcttcacgctcttcggcactaaactttttgagaggtaatgcttcgataaactcacgaatagcgtcaagagggaattccttggtagcttcagtttcagaaagataggcagcgcgagcctcaagggtaatcggcaggccaccaatgcttacgccttctttggccaataccatcgctttgtcatgttcagttaggtcatagacctcgaatatcttttcattgatgatagcctcgtttaggaggatttgagtgataaggtggttttctaggttataaaatcccgataatctgaatttaaattcaccctgcgtgaaaaatatgaaaggtgaatagagatacagagattcgactatagagaactgacacaatcttttctttatttcgacatttgtctttacgagtatcgatataccactgtcctgtgatttcgtaggtatcgctatgggaattctcctaatatcaccgacctgtctatttaccgttggattaaggcagtcgactatatatccacaaagtttagcattcatgaaccctaacaaatattcattggtaaacttctgctggatgttgaatacgcaaggaccgcctttatcaaaagagtatttattttctatttgtcggaaactaactcccttagagccagatgctgagtaggaaatgccttctttaaaataaaactctcgattgtctgttgtggcaagtttttcaccattacttgaaaaatctacaacacaccagttgtttccgtaccaacgtacaaacggtccacctttttggtatcctacccaccttttgctgtcagaggggtaatgatctgataaattggccggattaacttcccagaaaaaacgaagaaatttgttattgttaccagtcatcaaaccagtaagagctttgttgttatcgcctaaagcttcctccccaaacttcgctctaaaatcatcggaaatccaatagataaatggccatgatttgatgatttttagtttggattgtgggatggtgtaattattttggtaagctacaccatcaatcaaattatcataggcctcaacaaaagcgttgtaacgtttgccttcataaatgtggttcaactttataaaggttgagtctttctcttgtttatttttatcaaggacatacatcgcagcatcaactcgagctgactgatggaacattcctaaatagccccactccacgaatagatcgatgctcgttttctcaatcatatactttcggacatcttcgaatgtcttgatatacataaatgttggcggatgaaccatggcgaccttaccgtccttatctgtaagttcgcagcaacgcttgataaaggtggcatataagttggtattaaatttgtgaggttttttatagttgtcttctatgaattcttttaggtctggcccaaagtccgcactatccgtgtacggcggattagcagtcgccagatcatattcagtggttaacagctctaagaatgtaatcgcatctcgcgtttttccgcttaagaaagtattgcgttctgttcgagcatactgctctaccgcagcgaataagtttgcaaagaagttttctgcgaattcttggtgctcggcatagtctgctgctgcgaagagatccccttcaacaattttcttttttaacttttgtgtcgaatcaaacgtttcaccaagcgcacgttcttttacttgagatagctgttcttttaactctttatcaatatgaatcagcgagccaaacttataggcttgcatgagatcaccccataccttctctataaactcccgctgctgagccgacaccaaattgccctgttcgaagatgtgctttactgccacatactcaggcaaatagaaatcggacgataccactttgaaatgcaactcaccgactgtacggcgctttttcttagctttgataaataagccaagctgtgctaactggatagcacgatcgtctaaatctatgccatgcaggttattttcaatgatgagtttagggatgtctttttcatcatagtctgcaccatagttttcaatttggtccagataaagctcgtaatagaagtcaaaggcatacaataaaaagttgcccgagccgcaagctggatcaatggtgcgcacttcatgtaaaggcttaggtgctcgtatttgtgttgttggtgcattggcaattttataacgctgttttatctcagagtgcgggtacatctcgaggtacattttacccagagagttttcgaccaagaattgtaccacccagcgcggcgtatacacctgtgattgcagtgataccttgttatattcggttttatcaccgctgtctttgtgggcctttttcttggcgttattgtagctttcgtacatccaaccgagaacatcatcactttgccagatggtctcttctgatgagtcattagcttgcgcgtcagtatcaaccacattaaaggcgtcaataatatcatttaaactaatagcatcaggtaaaagcgcataagggtaggctttgctatacaacggcaacgtttgaccaagttcgtcaaacgctgattttaaataatcgcgaataccttccagctcttcatcacgcatgtgcggattcatttctagccaggctttatggccgaatgaacgatcaccatgctccttttgctttgttaatatgggcggaaataagctggctgcctccatcacttttatggcggcaaggcggttgaataaggtaaacgttaattcatccagtagcttttcacgggcactttcatagccaccggtttcaccgatatggttctccagcatcacggcgaagcgctcgcgcttggttttaacttcctctggtagtttttctacctgggtggcgtccatttgcttggtcttactaaaacccagtctagcaaattgcttatcgaaggcggcttcaatcagctctcttaaatggtctacgtggtcaactaatttcatgggcttacagtccttcgctattaatatctacagttagttcgatttcttcatcgggcttggccgcagcaagcgccgttagctgcgtagtcagcaaggttttatactcttgcactgtcatcaccttactagaaactttaaaagcaactttgcggggttgtttcggtgctggtgattgaactggagtcggggctggtgcaggctcgccaccatcgggaccacgattaggtgtaggctgcggtgtgggtacaggctcgggctgtggctcttctgtgataaaactactttgcacgataagcagctcgctatcttttagcggtgcttgagctgtgtaattcaaaatatcggagagagaaaaaccactatttgagcaactaatgctgaacgcaagtactggttcaccaactactcgtttttctgcgtaggcttttaaggcatcaagcttttgctgatttaatcggttcggcgccgcggggtagttcttaagttcacgaaaagcagcctcaattttaccgctcaggaccttgtactcgtgactcatacctatagatgctgtcttaactaacttgtaataagcatcttttacaacttgtacttgttgctggagattggcaaagtttttcaccagatcctgtttgaataagcgctcgaattcttcataggcttcatcaatgttattgtcactgcgatcagctttaatcagctcgcttcgaacatcgtcaataaagcgcttaaattctttaacttttggaaagttctttttaatgaatttctgagcttttaatatggcttgaaccgcatcgctgaacgtatcgctgttattaagtagatactcaaccttttcgatatagttactctcggtaactttacccgcaaaaccttgcaagtcttgttttaaacctaccactttggggaatagttcttcaaaatcttgaacagtatcactcaggttggtaatggcactgataaaatgttcagccatcaaacgaatactgtcagccaagtcaaaatcgtttgtattccaatctacctttttgccgatatggtcctgtgtttcgagttccatcagtagttgtactgcctggttcttctgcacagcggttagcgttgcagtaatcgatttgaacgacgcagatttaaacttggtggtattcgtaaaggcatcgtgaaccgctttttgctcatgagaaaaataggtgtcgccgttaaacttaaccgatagtcgaccggcacggaatagtactgcaagagtcgttactaatgttccgtagctatagccccatggagcacctgacaagtcagcttctagagatttaccatccatatagcgcgactttatcttagcattgatttcttcaacaattttaaggtgatcgccagtaaaattgccgtgaccgtcgaagaatgcaaaatcattagcggtaaataacttattcaggctttctttatgtgtgctgaaaatcttcgagaccaggctatcagaaagttgacttgataaacgcttggtgtagatgtttttcaccatttttcgctggttgtcggcaatggttcccttaaatgtatcaacgttcaacagatgctcgtcgaacatgtagatcagggatgcattgtgatatgcgtcttgaattagccctcttaaagttcgttgcttctcttctcgtataacttcaaattcacgaataatttgacgcttatcggcatctttttcattcgagtatttttcctccatgtaggcgtagcgcataacttcgcctatcaatttatcaatctgggagaactctgaagtatctggcaccaaggtaataagctctttctgatactgagtatcaagcttcagttgttcaataaaatcctgacgatcatcactgatattgaacaagctataggctgtgatctttaagtgtttgcttcctacaggtgctaactcatcgtcttggtctgacagcacgctaaatttgaatgcatcactgccatcattgtaggatgcaactgcgttaaaggttttgtagtccttcaaatacttaattaactcacgcttcttgctgaaaagttcgacatcaaaatctttcatttcttcgagcagtttgccttcaagatctgaggtaattttgtagttgttgtttgatagtagtagtacttttgcttcaagcagtagcttaagcgcgtcttcaattgctggttttacttcatagtacgacgtgatgtccgtaatgtagcttttggttatattttcaaccgttggagctactacttcagagtcggctaatagatgcatggttttgagcagtttctcgccgtcaatgctgctgccattttcttttaatattttgcggctagtatcgtatttgttgaccaatccaactggcggtgcggtttgggcttcatcacatatcgcgaaccctggcgtaaagctatacagctctttgtcacgcatttgcttacgtagtacgtcaaatgttgtgataatcatgcctcgagctgcaatttgggtagcaactaaagcgtttgagctaaacaagaacttttgcaaaatatcgaattgatatttgtggaaaggataatagaccgcaaaatcttcagctgtttccgttttcgtagggaacgatgacttcaggttggtggcgtcgctgattaggccttcattcttttggtaataagcaactaaatcttgttttgcctgttctgttttttgaagtaatcgactacgaatgataacgtctacttctgtagactcaaggtgaatcttggttttaaaacgatcagtaaccttggtcaaactactgcgactaacgttagcattgttaatcacgtcgtcgagcttttcttgtgcaatcgctatggtccaaactttattacttatactcgatagtgattcactaatcccttctaaatctaaaagggtaaatttcttttggctaatagcctcactcgcctcgtcgaaaacaaagaccagtgtttcttctgaattaaacttaaggtatttttccagttccgtcttaaatttactggcagaaaaatcctctattgaagcactgtagacgcttttagtatcttcataatctgactcgctgtagcccatttctgaaaagacctttcgcataactctagcgacatgccgattacttttctttagctcatcccaatccttcgactctagtttttggacaatggatttaaactcgtcgtatttaccatctaggagcagatcaaactccatataaccgtaaatatcatcacgaaaaccaagatttttaagcagattagcaaacaaggtgaaagccaatccacgttcagtattttgcttagcaacatcaaggaacactacgcggctgttaattgcgtcaagattacgtagggcgttttcaataagacctgcatcacttacaccttttaagcgtggtataaaacgctcacgtgcaggagtaccatttataatctggttatctattatataacccagcatctttccgaaatatgacttaccagagccataaaaacctgataaccaaacccctgtctctttaatattagaggtgaattggtttgtaaattcgtagaggtgccgcccaataccttcggttacgatgtatgactcgatttcgtgttgaatttctgtctctgaacggtcttcaaggtcaataacgtttttaatatcttctttaagatctaacgttagtatgtcatttatgattgtcatttaaattagtccctatttcactaacgtacagcgatactttgatgctggtctaaaattcaagaataaaatgttgtcttctgatattttcgatggatagaaaatgacaagtggatgctttagctgcataacatctttgtgctccattatgttcacattctctatacccgtgccatacaagcaaccacttcgaataagaaatggaatcttatccttttcacaagcctgtttaatggctgaaataatcatgtcaaaaaggtcttgttctggatcgtcagatttgaaaacaacatgtggagtgttaatgaaatctctgtagtactcggagaaagcatcccagccatcggaatctataaatctgacaagtaattggctgatatctatgaattccgctttctcttcataaatatctctcgctttgtcaatgtataaattttcctcacctggacaataggaaaacaatatactgttaccaccattggcttgccgacgaagctgatcttggttttcaatattaaagtctaggtcagcaaacttttgtttgtgatcagctataaagggcatcgcatatatccttataggtatgagttaattcgacattgagcgctacaccattgaaactcatgtcaaagaagcctttcattgaaagctttttgaatcggtcttgaatatcttctttggctataaaacttgcagggagcaattcatgctcaaaaatgctttttatctcaggtgagaataaattagagaaatatacgaaaagcactaatgcctcaggtgttgggcgaatatgattgaaagacttcccccgccctaccgtgacaaagtcaaacttggtcattaaactgaggtactttgtagcaactctatataaagtatcttctgaccattgcggaaaatcaggaccctctgaagacattttatcttttagaaaggcaatgatgtcgtcctgtgaaatctgtgctcttcctgtgaaatacactttactgaacacttgtgttgtgacttctctgaacaaccgattatttagacataggtgccataaaaagcaaaacttcttatctattaaaggcgcatctgaaagataaatttttttaattaaaagctcatgatcttgatttataaactttagaatcgccttattaatcgcccaacttactttattgcgagtttttgaagttctaatgtcaaactcattttcatcagttatcttcgagtcagtcaaattaggctcacaaaaataggcgctaattatattgaaaacaagcgtatagtctttcaggcccgcaatatctttaattgcagtgttataatcttgcacactcattttctctattaaatctttcatttgtaatatcttatttattattcataaccaggtgctatttttaaatttcccacaccatataaggcacctagatttttaagcgctagttgaaaatctcttggctctaattcggactttttagaacaatccacatgccattgacgaagcaaatacccagcggttgctgctctaatctcaacctttagaacgccccccgtcatgccataatccagctcaatcgcttcgctgtgctcaatacgtgggtgcggcactaactcaagttcaacaaatctgttccattgccggtcttgtgcttcaagttcagcctcagataacgtagagtcttcaagcacaacagctgctttaattcgagtcaggacaaagtcacgaaattcactatgcttgcggtcaaaaccacgaacgtgccagcgcaggccattgtccaccagcgtatgcggcacaatttcacgcgtggtttcaccgctcgataacgacacataggtgatactcaaggctttgcctttgtgtatggcctcggtgactttcgctactatcgataagctcggcttgttaaggtgataaggcgcttcacacgcaagaggtggttttacctttccagtgaagccatctccgtagccttggctaatggttgccagagttctcacaacgtcgtagtcgaacaagggttcaaaagcttcaccacgcttatgcaatttgagcttttggtcatattcaatattgcctggcgcaagctctcggtacatggtgaagtctttcgttgcttgtgcagcggctatgctgaagcgatcgactaaatccgcccgtaccgcttcgcccttaaacaataaagtgaaatcgatgtgggcaatgcgatccctggttgcttgtggcaactgcgctatctgcgaaagcctatctgacttcgccactaccgtttgtttcagaccatcatttgtcatgcgtcttgtttatccaattcaaccagattcttaatactctgcttataaagtaaggaccgtcatcgcgtaatcacattgaatagtgtcactcaatgcagctcttaatccgcaatgacttagcaatctctaccggttgaagctggacagatggccatagaacactgaataggcttcaacctaattaaatttattaggtatcatcctatcacaaattattttgtagggaagactaagcggcaactttttgatctggattacaattgccgctgagtcatgagcgtgaagaccttgttttgtgccaatgctgatagccgctatcaatgcgctacccgaaccagtggcaccacgatgttaccgcgatgcgatacccctttgtccgactctgtagaggtcagggctcgttgctcactctctcgaacacgcctggcaacttctgcctgggctggtagcaatggcagcatcccttcagcaatcgcgtctggggcagactcttggccacaggacatcaaatgcttccatggatctttaagaaagcgctcgaacgtgatgccaaattcaatgatgcgggcagagacgaagatttcgccccagtattcaatgtaggtgtcttggtacatggaaagattcctcttgttggttaaaccatgagttcactttccattttccagaggttttcaaatatgcaaggcttaccttgtagagggctacaaagctttaaatcgattgcgggcatctttgtagtcataatgggcatgttctgagccacgatgatacaaatcatccaggtaagtttgttcctgcggcaactcgtcttcgctgatttcgcgccaccaatgtttgttggcacctttaacaccgtcatgccagcggtaacctcgctcttttaaatagtcctttacgtcaaacggcgcaccaaacgcacgaactaacacagttcgcctgtctgcttcagacaacaagtttgcaacggactcgggcaacaaatgaaacaaccaggccatcgccaaacaatcggttgcagctcggtgtccttcatagaaccaacctaagcgaagcagcaggtactcaagctttcgactttcaaaacccagcgccttccaatctatgccactggctgaacaggcccaagatagatggccaaatgcggcaaaccgcttttcaaagaaaggacgatcaaactgtgcattgtgtgcaaccaccagcggatcatcggataaccaactcgctaccattgcatcatcaatgcgctggccttgcactatctcatcggtgataccggttaactcggtaatcagttcggggattggcttgccgggatcttcatacaagctgatcacatcaacaatcgacacaatccgctgagcagaggggctgtaaagcaccttaaccataccaagctcaataatggactcatcatcggcagacagtccggttgtctctgtatcgagcagcaccattggctgttcatcaccgaccataggagaaagttcaagtggccaagtctgcggttcacgcgttaatggaatccgttccagcaatctaaaatcttctggtctttctgggatatccgcgaggcgctctagcggaaatggcgctggggctcttgtcattgatggttcctcttcaattctattattcgctttgggttatttcactgtgccacaggtttttctaaatgcaccttggatacctcagcgtttttttaatctttctactgggtgaacccatatatgaaggctttgactaagcctttcagaaagccttagctaaaccgtttaggtaaccctttccgataccctttacgtatggcttagccaaccccttttcaaacggttgcaaaaggcttgaactgagttcgactgagcattttaatggtgctcctaacttcgctttaagccagtaaattcaatacgaagcagaattttactaactgtttttaaaccctttgcaaagggttcaacaagccttgtttgacggttacttgacccatgcgttaaccagtagcagtaacaggatcagtaacagaaacaagagcagtaggcagaagcagtattgtccaagccttgcaggctttgacgagggcgagcaatccccacatcaagcttttcaacacaaaaaagaaatcacccacgacacaacgtcttactcgaacaactacagttttacctacaattttacttgtagaaatcagcatagcatcagatactgtataaacaaacagtatcaattctattttttcgaggttcgtcatgagtgtctcgctgataggccgtagcggcgcacttgccttcatcaaagccaagcgccttcgtattccattgttcatggaacgtgtttctgctggttttccctcaccagcgcaggattatgttgagcaaacgctcgacctcaacgagctgtgcatcaagcgaccggctgcaacgttctttgtgcgtgttgaaggtgattcaatgattgatgctgggattcacccagatgatattttggtggttgatcgttctgttcaagcagaacacggtgacattgtcatcgctggcatccatggagaactcacggtaaaggagcttcaactaaggccgtgcgtcaagctgatcccaagaaaccaggcgtatgagcccattcatattcctgaaggggcagagttagagatatttggtgtggtcaccaatgtggtgcgaaacatgcgccgtaagtcgtgactgtcccatgcctgtatttgccttggtggactgcaacaacttttacgccagttgtgagaagctgtttcgtcctgatttaaaagatacgccggttgtggtgctgtccaacaatgacggctgcgtggttgcacgctcgcgtgaagctaagttactcggtattaaaatgggcgtacccgtctttcagatcaaagccgaaatgcagcgccatggcattttggcattctcctctaactatgcgcttacagttgggaaatactttagacatcacatgttgtaatgtttcaggttgtataaattagacgtcgagatgaggggtggttacaatttttactattggttaagaaatatcttgaaaaagtagatgtatgaacgcgtaaccccctgggggaaggcttagcagtgtgaataacggatgatttaggtgttaatgtgattgaacaaaataggtcgtttccagatgacttcggctttgactattgtcttatgtggattagtacggagaaatatccctcatttataagtaggccacaccctgacagtggcgagatcatccatgacgttagggacaactcaaaaccatttgctcataaacttccaattttaatagaccccgatggtatcaatgtggtgccagtgaatctatatcttcactctttgttggcagatccagatatatcctccgataagacgattcaatcccatgcagttgcgttattgagcttctatcggtggttgagcacggaaatccccgaacatacacacccaaggactggccttctggttgatgaaaaacctccgttaacaatatatgactgcaccgagaaggtagaggaaagtccaatcgtgagatatcgagactatttattggaaaacctttataccaaggatgaaactggaaaagtcggtggttctccaagtacagcctctaactagagagtgtaaaaatatctgtgtaagtggcattcttaacctgttgaaaggaaatacagaatgccaatatcagacaaacttatcgatcagcttctagaaggctatgattcccccgatgacatcctcggcgaagccggattactaaaacagctcaccaaaaaggttgccgagcgagcgttgaacgccgagatggagcaacatcttggttacgctaaacatgcaccggaaggcaggaattccggcaactccagaaatggtaaatccagtaaaaaacttcgctcagttcacggcgaaatagagctggatatccctcgtgatcgcaatggtagctttgaacccaagctcattaaaaagggcgagaagcagctcaacggttttgatgaccggattatctcgttgtatgcgcgaggtatgacaacccgtgatattcaggcgcacttcgaggaatcgtatggtgtagaagtctctccaacctttatctctcaagttaccaatgaagtgatggatgaggtaaagcaatggcagcaacgtccgctggatgcattatatcccgtcgtttacctggattgtttggtggtacgtagccgcgattccggtgcggtacagaacaaatcggtttacctggcgctcggtatcaacactgatggtgaaaaggagctgttaggcttgtggatggctcagaccgaaggcgctaagttctggttgtctgtgatgaacgaacttaagaaccgtggcgtacaggatatcttcattgcttgctgcgatggtctgaaaggcttcccggaagccatcgaggcggtttacccgaaaacacaggtgcaactgtgtatcgtacatcaaattcgtcactcgctgcgctatgttaactggaaacaacgtaaggttattgccgctgaccttaaacgaatttacggcgcagccacactggccgaagcggaactggctctggcagagttcgctgaaaaatgggatgaccaacacccaacgattagcctgtcatggcgtaataactgggcacgtctaagtgtcttcttcgactatccaccggaaatccgtaaggtcatttacaccacgaatgccatcgaatccctgaacgcgagcctgcgtaaaatcaccaagaccagacggtcgttcccgactgacgattcagtgatgaaaatactgtatctggcgcttcaccagatatcgaagaagtggacaatgccaataagagattggaaagcggccatgagtcagtttatgattatgaatagtgaccgtgtatcaatatgataaacagccacttacacagaagatcttacagtcttctcttcagagagtgtaaaaatatctgtgtaagtggcattcttaacctgttgaaaggaaatacagaatgccaatatcagacaaacttatcgatcagcttctagaaggctatgattcccccgatgacatcctcggcgaagccggattactaaaacagctcaccaaaaaggttgccgagcgagcgttgaacgccgagatggagcaacatcttggttacgctaaacatgcaccggaaggcaggaattccggcaactccagaaatggtaaatccagtaaaaaacttcgctcagttcacggcgaaatagagctggatatccctcgtgatcgcaatggtagctttgaacccaagctcattaaaaagggcgagaagcagctcaacggttttgatgaccggattatctcgttgtatgcgcgaggtatgacaacccgtgatattcaggcgcacttcgaggaatcgtatggtgtagaagtctctccaacctttatctctcaagttaccaatgaagtgatggatgaggtaaagcaatggcagcaacgtccgctggatgcattatatcccgtcgtttacctggattgtttggtggtacgtagccgcgattccggtgcggtacagaacaaatcggtttacctggcgctcggtatcaacactgatggtgaaaaggagctgttaggcttgtggatggctcagaccgaaggcgctaagttctggttgtctgtgatgaacgaacttaagaaccgtggcgtacaggatatcttcattgcttgctgcgatggtctgaaaggcttcccggaagccatcgaggcggtttacccgaaaacacaggtgcaactgtgtatcgtacatcaaattcgtcactcgctgcgctatgttaactggaaacaacgtaaggttattgccgctgaccttaaacgaatttacggcgcagccacactggccgaagcggaactggctctggcagagttcgctgaaaaatgggatgaccaacacccaacgattagcctgtcatggcgtaataactgggcacgtctaagtgtcttcttcgactatccaccggaaatccgtaaggtcatttacaccacgaatgccatcgaatccctgaacgcgagcctgcgtaaaatcaccaagaccagacggtcgttcccgactgacgattcagtgatgaaaatactgtatctggcgcttcaccagatatcgaagaagtggacaatgccaataagagattggaaagcggccatgagtcagtttatgattatgaatagtgaccgtgtatcaatatgataaacagccacttacacagaagatcttacagtctctcttcagtggtccaccgaatgcgatttccgtctgcatctgttgaagttgggcgacgacggcttctgagcctttaccggcctcacattcaaggcacaagaacacctgccttaacagttgctccaggagattgcattgttcatcgtaatgttgccactggtactcttccacggtccgtttctgttttttcaggtaaaggcagagggtctggatatccctgtcattcatgaccttcaatgcctgttgtctgactactgagaagggttgattatcatcaatgttctcatccacaaacagatgcagtaactctgccgctttcgtgacattgtccgcggctgactgccaggacaggaacactgcttgttgtgcaaaggtgttggcagcttcttgttgcttgcggatatggtaaatgaacccatcagttaaccgttccagtgccagttgtatccgctctgtcaggtgacatagcaaccatagatgctgctgtgcgcgtttgaatcgtttgagtttactaccgtaatagttgatgagctcaccgaagtgttgtcgatttttaagagacagattaagcccatcgataacgccattgatttgcgtgcgccatggcgctaactgatgataaagggcaagctcttttttaagttcaggtacggtcagactttttgcaccgcctctgagctggttcaggcttagtccgtcatcaatggctgttatgctgtccagaaagacgtgaagttcaggactggtgagttgattaagttggtgcgccaggtcttttctgacctgctgcatcgctctgcttatcagtctctggagtacggtgtacctagggatagcaatgctgtgactggttaggaattcaatagcagtatcaaagaggtaacgcggctccagccaggcattgcccacctgaacaaggtggtcgaaaagagaattgaagtgctgactttcgtcccatttgtgataaccagcaaggtctaatacttttgcgtagagtcgatctttttgtttttgtgagggagtgaatggtctgagccccttgccgccaagcagctctttactgatgaacattaaatccttagaaacctgcgagtaagcgatatctaggatgacgggctttgatttgaagtatcccaaaatcgcgacaaagtaacatctatgagctctgagacgaattgaccgaaaaactgccaattccgcatcgttcagagaaaagtacagacgttgttcttcgattgaaaaaatgggtggggaataaagatctgcctgttctgctctcgtgagaatagtaatttcgtttttgatggccatatcagggctgttccgtattaaatgtacgatatttacctaatttgccacacttataagtagtaacccacctccgcagccatttattggtgtggtctacagaggattaagtctttttagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcagtggtccaccgaatgcgatttccgtctgcatctgttgaagttgggcgacgacggcttctgagcctttaccggcctcacattcaaggcacaagaacacctgccttaacagttgctccaggagattgcattgttcatcgtaatgttgccactggtactcttccacggtccgtttctgttttttcaggtaaaggcagagggtctggatatccctgtcattcatgaccttcaatgcctgttgtctgactactgagaagggttgattatcatcaatgttctcatccacaaacagatgcagtaactctgccgctttcgtgacattgtccgcggctgactgccaggacaggaacactgcttgttgtgcaaaggtgttggcagcttcttgttgcttgcggatatggtaaatgaacccatcagttaaccgttccagtgccagttgtatccgctctgtcaggtgacatagcaaccatagatgctgctgtgcgcgtttgaatcgtttgagtttactaccgtaatagttgatgagctcaccgaagtgttgtcgatttttaagagacagattaagcccatcgataacgccattgatttgcgtgcgccatggcgctaactgatgataaagggcaagctcttttttaagttcaggtacggtcagactttttgcaccgcctctgagctggttcaggcttagtccgtcatcaatggctgttatgctgtccagaaagacgtgaagttcaggactggtgagttgattaagttggtgcgccaggtcttttctgacctgctgcatcgctctgcttatcagtctctggagtacggtgtacctagggatagcaatgctgtgactggttaggaattcaatagcagtatcaaagaggtaacgcggctccagccaggcattgcccacctgaacaaggtggtcgaaaagagaattgaagtgctgactttcgtcccatttgtgataaccagcaaggtctaatacttttgcgtagagtcgatctttttgtttttgtgagggagtgaatggtctgagccccttgccgccaagcagctctttactgatgaacattaaatccttagaaacctgcgagtaagcgatatctaggatgacgggctttgatttgaagtatcccaaaatcgcgacaaagtaacatctatgagctctgagacgaattgaccgaaaaactgccaattccgcatcgttcagagaaaagtacagacgttgttcttcgattgaaaaaatgggtggggaataaagatctgcctgttctgctctcgtgagaatagtaatttcgtttttgatggccatatcagggctgttccgtattaaatgtacgatatttacctaatttgccacacttataagtagtaacccacctccgcagccatttattggtgtggtctacagaggattaagtctttttagaggggaaaatccctagaaccccattgtgatacttggtaatcattccccccacgaaatttattgccattaactgaagtaatagcacgttttaactgatggtatgcttcacctctgttcaaggcttgctggacgtaatgacgcaacgttgaattatcaacatactccaaaacataaatagatttaattaaacggtcgtactcatgcaatgctgacaatcttcggctcttgccgttactcaactttctaatgattgtgctttgagtggtggttttacgactcaatgaacaaacaatatgctgaatattgtcccattcttcagcaattagcttatgattaatatctttctttaattgaatacggcctccgttctcttcagtcacttcaaatagctcaaaaaacacctttttcattttcgcgtatcgaggggcgaatgtgtaaccaaagaaatctaatatagcgaagttaacattattggtaccatgcgtatcggtcgataaggtattaggctgtatatctgaagagttgttatagagtaagtcaaaagcaaagtgaccttcatattcgttagcgccaatgacttgcgtactcaccggaacatgacgtggtcaaccaaaattgaccaacccagttaagctacttttttcaatttcttcatgtccgcctcatattgatttgaaatttccatactttatctaattcatgtttttctaaattagctaaaatgcaactcagaaatgtccagaagtgagttgtgtggtgtcgagtggagattgtacgattaagcccctaagtaattagtccgtcagtctccctcggtaatcaaattagtacatcttagcgatcaaattggtaaaaaattagacatgtagatgaatgcccaccttaaaaaatagacagcgggttgggctgggtgatttttctggtgttagacgccagcaacccatgcggcagaatggttgctcacttactcgtctatttttagcgggaattcttagccaactgtacgcgctgtatgcagatttaagcagtcgagtgatgcgcactttggaggagatggcaccacgagtagaggtttactctattgacgaagcgtttttggatttaaccggtattgagtctgccatatctcttgtcgagttcggacaacaagtgcgagagcgcataggccactggattgggatcaccgtctgtgtaggcattgcaccgactaaaacactcgccaaactggctaaccatgccgccaaaaaatatccagctactcagggggttgtagacctgaccaatccagatcggcaacgtcgattgctcgcattagtcccggttgatgatgtttggggcgttggtagacggctttctaagcgtttaaatgcgttgggtatcaccacagccttagatctcgccaatgcctctcctagagccatcagagaccagttttcagaggttttagaaagaaccgtcagagagctcaatggtgagtcgtgcattgaacttgaagagatcccgccaactaagaagcaaatcgtctgtagccgttcatttggcgtaaaagtgacgcactttgaatttttaagtgaagccgtatgcgaatacgcaacccgcgccactgagaaacttcgcaaagaacagcagcaagccaaagtgctgaccgtgttcatacgtaccagcccctttaaggacaacgagccgcagtacagcaactctgcatcgggtgaattgctaatccccagttgcgacacgcgggattttatcgagctggccaatcacttactcaagcggatatggaaggatggttttcgttatgccaaagcgggcgtcatgctgtctgacttttacgatcctggcatgtttcaaccaggactattcgatgacgtatcgacccgctctaatagccagcagctaatgtctgtattggacaccattaaccaaagcggtgccggaaaggttttctttgctggacaaggactcaagaaagattggtcgatgaagcgagagcatttgtctcccgcttatacaacacgctgggaccagttaccgcgagtgaagtagcgcagttgactcaatacgcattcactctgcgacgcagcatgttgagcttatcaacctggcgtcgaatatcactgaagaattcctctttctccatggccagcgctagctcccattctttggccaaaccttggcagtctaaaaatgcgtatctcagcttcgtctttgagatacgcagccccttgctaaagaccacgcgtttgcctcgttgaccgtgaaaactgttgatataccactctatgccaaagccatacttaaagtctctgatacggacaccaagcagaccccagtctttaaagggctcattctctcgaaccttgtaatgggtaacccaaaagtcatcaacttcagctcgtgccagcgcttttagcctgtccgtttcttgctgaagtaaatctgatacatctgctttccattgttcattgacgatttctaccaaaccaatttccccatccaattaacccctaaagccaaaaccactatccgtttggcttttggatcgaaacgccaaacgtaaaactgccgtcacaatcactgtttggcgtctcgatataaatcgactcgctcaatcccatacccgacaagggatacaggctgatttcacttaaaaacacctaaaaagacgtatcgccatgaagatacaaaccgtttggcaagttcaggccagaatgcaaacgacgtttggcgtctcaatttttttggctaggtcaccagccgccaaacagagcctattctcatacttttgcaaaaatgcaataggcagatagatgaaaggatttgtcacctttctgcccaccgccagtgcaccgaatcctgataatgacatttgagtaaaccgccagagcacttggaaatgcccaagcgtgaacagcgcggttgattgaaaaccgttagagcactttgagtgcacaggagataagtatgtttgtactaggcgtagatatcggttactcaaacctgaagctggcaattggccaatcaggtagtgaaccgaaaaccattattctacctgcgggtgccggtccagcggatcgtatgccggagcgtatcggtggaggcgatgatgaaacttgtttgtatgtctctgtcgataatgagcgctgggccgctggtgttcctgctggacgccttcaaggctgggaacgagagcttcacccggaatatcccaccacaaaaacctataaggcactttttcatgccgccttgttaatggctgaaacagaatccatcgatttggttgtcactggattaccggtttcccagtttcatgaaccacaacgtaagtctgaccttgtgcagcgtttaaaaggtgtccatcaagtgacgcctaagcgcagcatcaccgttcatgacgtcaaagtactaccacagcctgccggtgcctatatggatctggttcaaacgggtggtgatctgggcttgattgaagaaggtcgtgtcgtcgtcattgatcccggcttcttttctgttgattgggttgcccttgaggccggagaaattcgctacagctcatcaggaaccagtcttcaggcaatgtccgtgctactggaaaccatcgataagctgatttcggaagatcatggtgccaaagtcggaatggatcgacttgaaaaagccatgagaaccggcgacttacaggtcctgctatttggagaaaaagtcgatatttcaccttatctgaatgctgccatgaaaaaggtagcgcctgttgctcttacagccatgcgtcaatccatgcgtgacgaaagcattaatgcggacttggtattgatcgccggaggtggagccttggcttataaggaagcggccaaggagattttttcacgaagcaagatcatcgtgcctgagcagtctgttttggcgaacgtccgaggcttctggttttatggggcatgatcatgagagttgtcgtcaacattcccccagggagccacccagaactactcaaagaattggaaaagacgccaccacgggaacgcgctgagcgtctgcggatgctggcaacctttgggttaattcaaatgagccaacccaatctatccacgacatctgtaccggtggatggccttgcaccagatggtgaagttacttctatgagtacagcgccagaacccaaagcagaaacacgtaaacaatcattaaaatcaaaactagggctgggcttataacatggcgttatcagttagctggctcgatgccaggttaaataaagaagcaaaagaaaccgtagtaaaagccgaccgagatgggctaagtgctcgggtatcgcccaagggcaaaattgtttttcagtttcgttatcggttcgatggcaagcaacagcgggtagacataggtacttacccccttatgaagctggctgaagccaggaatgagctggataggttaagggcagtacttgatcaaggccgaaaccccaagctttacctacagcaggaacgggctaagtattctgctaatcaaagcttcgaatcgatttttcgagactggatagactctgccggtaagcaagggctaaaggagaaaacgtggcactaccaaaaacgcagcagtgaaatatatttgctgccccgacttggcaagtatccattaactgacatcactgaattgtccttgcgaaactgtcttcgtgaggtttcggaatcgtctccgtcaaacacagagcgcctagtgtctgtactgcataagttctatgactggctgattgatgaacaaattttggaaattaacgctgccgctgggatcacagcaaaaaaggttggcggtaaaaaaggaaaacgaactcgggtgctaaatgacaacgagatcaggatactttggcgctatttgcatgagtcaaaaatcactgagaagaatcgcatctacataaaactgcttctcttattgggagggcgcaagggcgaactcattcaagctgaaaagcatcactttgacttgcaatctgcaatgtggacagtgcccatagagatccgcaaacaaggtgagaaaattggagcgccgatcatgcggccattgattaagccagctattgagctgattgaactggcgatgcagatgagcaaatcaacttacttgtttcccgcgaacggacaagaagagcttgccacaaatggctttgataccactattcctaacaatgtgaaaatctgggctcgcagatcgcttggtattgagatggaacactggtctatgcatgatcttcgcagaacgatgcgaacgcgaatgtctgccatcacgacgcaagaagttgccgagttgatgattggccacagcaaaaaagggctggatgctatctacaaccaatatcagtacctggacgaaatgcgtcatgcttacgacgtttggtatcaacaactagaaaccatcatcgagccgacaggctttccattcaactggcgtttcggacaataaggggtagctgaattaaggaagagactgagctagtacaaatgaccgagtcaagtagtgcatttggctcggtttagattagttgtttttccagttacaaaaaaacaacttatcgaataattattataagtctcacgacgcctcagagagaggtatttgcaattcatccacaagggtttgcttagatttatactctagctcgcttctctttatttttagcttttgtaataaagcactatgagtcacctcgaaatcattaaaaattgtagaccaacttttaacgtatactcgaattctttcatccgccccggaaacaaggcccgcgccgcccttaccagcaaggtctttcaaccgccttgtaatttgagtatcattctgggagattttagttccaacaagaacaacatcaaatctcattctctcatcattaaaggcaggatgcttatcaagtacctcagcataacgttcagcttgagctaaatgtttcttattcaatgctacacttggtctttttatttcaatgatcgtacatttaataaattcttcttgtgtagaatgatcaattgtgaccattttgcgtgcaagaaacaaatctacttggccttttgccccctctatggtagcgccttcaataagatcactggtactgatatcgtccccatccaatatttcaatatctgaattccgaagatttctagctgtattagaaaagtcatcctcttcggcacctatagttgtgtactgagggccaaacaaccatgtattagcctcaataataccttgtaagtctggtgtttctagaacttctttagcgtgctctttaaaaaggtacttcattttctgtacgactagatctcgcttatgaatgtgtccaatcgtgctaattatataatcaagtttagatttacttatttgagatgcaaattcatccatttgctccttatttaagtctaaaacgccttccaatatatctatcaaactatcattttcacttgatgtagatagcctatcaagcaaaccgattataatttttgtttgcttagcctttagcccattaaaagctgctggatcagcaacgcagatactagttactaatttcttcgtatgtgcaattctaaaggaacgatcttcgtcagactcccaattgtaaacaggaaaatatcctttttcttcgaaagaatcgacaagctgaacagctctttctctaaggaacccctgataaatctcggctgttttgttgcgcagttcttttagcagcatagctaaaactttattcccatcactcttttcactaatgaagagatcagcatttggagatgaggtatcttgaaaattatcgaaccactcagattgtatatatccacttatgaaaaaattgtttttgtagttaaaaccagtcagatttctatacttctgatgttcttttgaatctctaaaataattgtatgacttttcaccagatggtttttttatccactgaatgatacttgaactaaatatatttccatcaacatctataagctcttgaaacaacctatgttggggaggcgtcactcggactctattaactgatattttaaggttagaaaaaactattagcttccaaccaaattcatttgaaagctcctccatgatattttcaatattagggattttttgagatttttcactcgtaatgcccgtaagaaatactgatgtcccacttccatttgaaagaatactactatgctgttctttatcgtcgatcaactcaactttgtacgttttaatacgagacgagtctatggtaatacgtgcattctcagattgtcttctcgtaagccaggttgctgttgcagcatatttatgaaatgaataccgccctctgccttgactgcctttttgggtaacctgttttttggatgagtcatcccaattatcaaaatttcggtctaggttatgaaagtcaattccttcaccattatcatggatctctattgactccaccccgccgagatcacaggtgttaataatgacatcaatatctgatgcaccagcatccaaaccgttccagatatattcactcaacatcttccaagcgggaattgagccgaaacgtttttttatcgacgcatttgtaatacctgttgtccgttcttgaggagtcgtcacttacctatccatccaatcaataaaaaatccatgctgctatcttagcctaagttggtgtacatattaactatattgttggcacaagccggcgtttcaaagcgttagtccaagctccaacagaaaaactaagctacgctatctattcctaattcttctcatactcctccaagtcttcaatgtgccacagcttgtttcgtgtatttcggttgatacgaggttgcggcaagctgccatcttttattcttcgccagagcgtcgtatagctaatgtggtaacgagccataacttcgtaagacgttagaaaaggggttacttggtgcgctactgctgtcatctgcattctcctgaaaatcaatgtaaagctatcatcgcctgattcatcacttgttgatggtcagaaagatgcatgatttgttcagaagatcaggcccatacaaatgaacttttaggacagcaagaaagcaaccggtaaccaactcaaccggcaaacaattagagataatcgcgaacgtcttaccatcatttctcgatttttggcataaaaaatataggcaagttttggctaaaacccagtaggaacaaggcctacagctaggtttgtgtcatggaatttggctaaaaacggtaaatatggcgatttgtactcaagtttgtacacattttccgaggttacgcttgaacatcattgaaaagcaaagaaacgagaaaaagacaaaaagcctttaaattcagtacgtagagatgtgattgtggtgtgcaatgaaaggtggttttaagcgttgaaaggctgggcggcatcagggtgcgagatgatcgcgaaagtacggcgctttgatacttcgccgaaatagggtgtagttgacatcaacaagttctctttgtgctcaatcagcccaacataagctagcgagcgtttcggttcaaatttgcgcggtattctcccctatcttggcgcagggagcaacttcactgtattcaatgagtgaattcatattttctcatggcagttttaattaatttatcaataaatttggactataactgtagagagtagaaaaaaatgaagtcgggcctatgaccaaatttcgcaagattcattctttggcctttaagcaagccaaaagcgtgtttttagtctctgtactgttgggactctgttttagtttttaccacaccttgtccgacctgcaccaagagcagagcaaggtgcaggagcactataactttaaattggtgcagagttatgaaaacgccagtcaagcggcttaccatcttaataatctactcgccgagcaagtcgccaccaccttgatgctcgaccccggcatattcaaagtggagattgtggatgactttggcgatgtgatgacccgtaaagaaaaagcaatcagtgaacagagtcaattagtcagtgtactcgccagctatcttactcctgcggtttccgtgtttagtgccgagctgcatcagcctaactccaacgtggtggtcggcaaactgagcttctatatcgatggctcgtcaatagccaaagtgttcatcgccaaaaccactcgcgtactgctcttcgacctattacgtaatacgctattgacgaccattttactgctgtttttctaccaaaagctctctcgcccaatcaccatgctgatcacttgggttaactcactcaatgacacacagcgctcacctctgcctcttcgtcttactcatgacgatgaactcagtgagctcgcgtcgacgtttcaatcgatgtggaaaggcaaagagctggcagaatcgaaactcaatcaattggcttattatgacagcctcacaggcctcgccaatcgcagtttgttgctgcaaaaattgagtgatgcgattgaaactgcgcaaaactcgcatagcacaggcgtactgttctatctcgacttggatcgctttaaaactattaatgactcactcggtcataccatcggtgaccagttgattaaagccgtggcgctgcgtatggaggcatggactaaaaacgactacctgtcagcacgaattggtggcgatgagttcgcagtgctgatcccttatctctcgcctgcgaaagctgaggaagtggccaagcagctactcactctgatttccaacccttatgcggtggacgatcaccagttctactgtaccgtgagtatcgggatttcggttttcccttccgtaggaagctgtaatattgatgtattacgtcaagcggataccgcactgtatcgcgccaaagccagtgggcgtaacaagttcatgttctatgagccggaaatgcaggcgcaggtggagtctttccttgaaattgaaaaaggcttgcatgaagcgctcaatcagcgccaactcgagcttttctaccaacctcaggtcgacgagcagcacaacattattggtgtcgaagcgctgatccgctggaaccatcctaaacgagggttgttgcctcccggtgtttttatgccgatcgcagaagaaacaggacaaattttaccgataggcaactggatcattgagcaagcgtgttatcaatatgcccagtggaaaaaacaaggcattttaccgccccattttcgccgtttggcgatcaatatcagcccactacagtttgctcaggagtcttttattgagcaggtgaaccacgctttacgccaagcagggatcacgggggagccgatagaattagagataactgaaagcttactgctggaaaacgttgagagcgccatagaaaaaatggccaagttgaaagagagccaaatcagtatttcgattgatgactttggaacaggctactcttcgctgcgttacctcaagcatcttgcggtcgatgtgctgaaaattgaccgctcgtttgtcaatcaactgcaccttgatgataacgatcaagcgatcgtcgacacaatcttagcgattgccagaaaactgaatttagaagtgattgccgaaggggtggaagacacctctgagttggccgcactcaaaaaactggggtgtaaccaattccaaggctacctgtttgataaaccgctgcgagccgaagagattgcacagcgttttgtcagcaacagttatcgcaaaattcaaaccttacccgttgcgacaaacagtttacaaaaataggtagctcatgatgatcgcatcttcacttttaccctttgccacggggtaatagttaacacggcgatcgatttcattaaaccccgctcgctgatacagcgcaaaagctcgctgattactttcgcgcacttctagccatgcgctttctgctttttgctgttcacacaacgcaataaagtgctgcaaaagctgctgaccataacctttgccttgctgcgccggatcaatcgcaatattcaataaggtcacttcgccaacaatattctgggcatagaaataccccacaacctgttgatccaccaacatgacttgatggcatgctccacggctagttaaatcacgcactaaggactccgcccaaggatgggaatgcgctgcacattcaatgcgccaaacagcatccagatgggtcggttgcattgcagtaaaaacagtcgtcatgatgcgattccttgatgagcgcaaatttgctgccacaacgcgcggcggtattgagtattgccatcaatgtcactcaaccgcggtgaatgcagctgtttttgagcctgatgagataagggatcgcagcccgcaaaccagatccactcgagtccagtataggcaagttgactgagctgaatcggtgcgatgtagcgaaccatcgacagctcaagctgaaagcttttgagaattctctccagcaacagaatttccgcgccttgtggcggttgattggccaccaacaagagtcggcaatcgtgatccagcgtttgtgtgcgcggctgaaatccggccaaacgctctggatggatcaattcccattgttgaatgtccatcgcggacaaatagtgtgaagaagaaagcatggtgttactcgcagcctatctgagcggcaatgctaacaaactggtgatagacgactcaaggactagagagaaaaaggagcagaaaggctccttttcagtatggattggatttataaagccgcaaactcttggctgtattcaatcactccacatcgaccatctaactcacgctcccatagcgccaccacttgaaatgctccctgcggtacatcccaagcacaacgcagcgaataacgcgcggcatcttcaaagccaaaacgtgagtagtaggccggatcgccaagcaccacacaagcaggatagccaagctccccaagcgagcttaacccttctttgactaactcggcaccaatgccttggcgacggtattcttcttttaccgcgagaggtgcaagaccttgccagttgagatcctcgccttctaacgtgacaggactgaacatcacatgcccaacaatctcaccttcatcatcgcaagccaccagtgacaaagtgcgctggccattttcacgcagcgccatcactaaatccgcctctgcctcagtagcaaagacgtttttcaacagttgatcgaccaccaaaatatcagcaggcgcttcagttcgaataagcattaataacctcgtgggatgaattcggcgtttgcatccctttatgcacaaaatcggccagttggtgaagcaaaatctgtaacgctttcggcaattgttgtagatccacgctatccatcaggtttttcacttccaaaccgagttcggtatccccttcgatggagagtcgacgctggaagaacagcgtatctggatcttccttacgtccggcgattaaaaccaaatcattcagatttccgctaaaactcacatcttcagcgacgggtttatctgcgacgactaacttgtcgttttggtaactgataaaccagcgcaattccatgtcttttacttcgactttcagccatttatcttcgaggaattcgaagtctccgtcctgtaaggcttcgcggaatactaaacccattgcatcaagcaaggcttttttttgaacgttttggggcaataagtggattggagatcgcaaaattgaagcagcgttctgaaccagttgagtgcgaatcttgtttaacacgagcgttatccgttaccttgttagtcaatctgcgcccatcatactggatgtcagcacctggattcctgttatgtatcaaaaaataacttcaggccaagatccttttctactgtggaaatcacagttatagttaatcatgttaccgaattggtaacgctataccccaacgacatacgctgttaaaggggatattataaacgtcgtcgcgcacggacagttggtagtattttaaatgcctgctcaaacctcatctcagctcaagcattggtttgcaaaaattacgtcacacagtccgttcttttttgcaatcctcaatgatcaacaccaatacgtgatggtcaacgagcgctattgtgatatcgccggtctctctagcgaagagatggtcgggatgagcgatagtcaggttctgggcgaacatttttatcgccatctcaaaccgttttacgaacgtgcgtttaacaacgagcatattgagtccgagctgaccctcagcgaaatcgacctcgaaaccagcttacacttttctctctcccccatcatgatcaacgatcgggtgcaataccttgtattccacgcgattgatacctcagaaaagcagattttagtgcgctctctggaagaatcggaaagcaaatacgcactcctcacgacactgctacctgatggtttaatgatggtggaaaatgactgcattatttctgccaacccttccgctgcacgtttactcggttttgacgacgcacaaaaactgctcggagaaaatctctccagactgtttattgatgaaaagaccaaaaccgttttttcatcgcagttggcttcgctactgacagaaaaacccttggtgtgcttgaccgggccaaggtgtgggtttgaacggaaaatccagttacacgcaggttgcacctctttactcggtaatcagtcgcagttgatcttattgcaagatgccgatgaagccccaaaacagttttctgcgaccactcaagtcgatgcgcatattgatagcctcactgggctgtataaccgacacgggtttaccaagcgcttagagcagtgcatccaaaatgagacgcctttggttatgctctatctggacattgataacttcaaaaacatcaatgactctctcggccatcacatcggtgacaaagtgattaaagaggtggcggcacgtttaaaacgcttactgccacagcaagccgtacttggccatttgggcggtgatgagtttggtttgatcttgccggagccagaacacaaccgctctgcagaaatgttggcagatcgcattatctctttgattaatcagccttttgacctgcaccatttcagtaagcgtttagcttgttcgattggcagcgtgcgttatcccggtgacggcaatgatgctcgcgtattactgcaaaatgccgataccgcgatgtatgaggctaaagagcgcggtcgcaatcgcctgatcaaattcaatgatcagatgaacaaagaagcgcggatgcgcctttggttggaaattgaactgcaaaaagcgctacaacaaaacggcctagaagtgtggtaccaaccgaaagtcaacgcgcgtgattttagcatcaatggcgcagaagccttggtacgctggaaacatcccgttgaaggctatatcagcccaggtgctttcattcccgttgcggaaaaagccggcttaatcgaacatttgggtcgcgtggttatgcgtgaagtcttcgcgaccgtcaagcgctggaagctacaaggcattttacccggacgtgtggcgatcaacatctcccccgagcagtttggcaatcctcaactgattgattatttagaaaaactactgcgaacaactgggctagatcccaacaacatcacatttgaactgaccgaaagtgcggtgatgagcgatagtgaacatacccagcaaatgctcaatgccatcaagaaactcggcttcaccttgtcaattgatgacttcggtacaggttactcgtcgctggcttatttagctcgcttcccgatcgatgagctcaaaatcgaccgcgcgtttatcagtaatatcgacactctacccaaacagctcacggtgattgaaaacatcattaatttggggcgctcactgaacctgaccgtagttgcagaaggagtagaaactcagcaacaagccactttactctccaacctaaattgccactccatccaaggcttccatttttatcgcccacaaccgaagcacgaagtggaagagttgtttgcgcaaaatcgccgccatcgcaaatccctctaaggggttaattttactctgattggtggaaacctgccttacatcaaatcggggagactcaatccttcctaaaatgcgttcactattccctgaattcagagccttacgctatggaacttctctgtccggccggaaatttgccggccctgaaaacagcgattgattgtggtgccgatgcggtttatatcggtttcaaagatgataccaacgctcgccactttgccggccttaattttagcggcaaaaagctcgaaaaagcggtggattacgtgcacgaccacaataaaaaaattcatattgcactcaacaccttcgcccatcctaatggtttcgagcgctggactaacgcggtagatcaagcggccgatctcggggttgatgccttgatcattgccgatattgccgtgctggagtatgcggcgcgccactacccacaccttgaactgcacctttccgtgcaagcatcagccaccaacgtgaaagccgttgaattttatcatcagaattttaacgtcaaacgtgtcgttctgccgcgcgtgctttccattcatcaggtgaagcagctttcgcgtaatattccacaaggtgtcgagctggaagtgttcgcttttggcagcttgtgcatcatgtcggaaggccgctgttatctctcctcttacatgacgggtgagtcgcctaatacggttggagcttgctctcccgccaaatatgtacgctggcaagagacagaatcagggcttgaatctcgcttgaacgaaattttgattgataagtatgcggcgggggaaaatgcaggttatccaaccctgtgtaaagggcgcttcatcacggatattgaaggtgaacgaaagtgctatcacgctcttgaagagccaaccagtttaaataccttgtcactgctgccagagctgtttgccgccaatgtggcttcagtaaaaattgaggggcgtcaacgaagccctgcgtatgtcgaacaagtcacccgcacttggcgtgccgcgattgatcgctacttagccaatcctgcgcaataccatgtcgaacccaaatggaatgcggcactggccaatgtctcagaaggtacccaaaccacacttggtgcctatcaccgtcaatggcaataagggcaacgatcatgaaatatgctttaggtccactactctatttctggccaaaacaggacgttgaaagtttctatactcaagccgccgccagcatggcggatgtcatttatcttggtgaaaccgtctgctcgaagcgccgtgaaatgaaaccacaacactggtttgagattgccaaatccctctctgctgctggcaaacaagtggtgctttctactatggcactgcttgaagcgccaagtgaaatcaatgtgatgaagaagtacatcgataacggtgacttcgcgattgaagccaatgatgtttccgctattcagatggcgcacgaaaaaggccttccttttatcgtcgggccggccgtcaatacctataacgcacacactctcaagctgtttttaaaacaaggcatgatccgttggtgtatgccagttgagctgtcacgagactggctaatcaacaccttacaacagtgtgatgagctcaatattcgcggacaatttgaagtagaagtgtttagccacggctatttaccgctggcttattcggcgcgctgctttaccgctcgcgccgaaaaccgcgctaaagacgaatgtgagacctgctgtattcgctacccgacgggcattcaagtcgcgagccaagaggggcaatcggtatttaatctcaatggtattcaaacccagtcgggttactgctacaacttggtcaacgatttaccaagtatggccggattggtcgatgtggtgcgtttaagcccactcggcgttgagacgttccaacatcttgagcaattcaaagccaatgaacaagggctgaagccgcagccgattaccagccatcagtgcaacggttactggcatcaattagctggtttggccgttaaaaatagctaaggtttaccaaagggttgctcatcagcaaccctttttatttgccttttccttttcatgcataggaaacttgggtaggtttccccattttgttcacatcgcgccagagcataatgccgaccacagtgctcagcacaatattggagatgggtaaggcgatccatacccctgtcagcccaaaaaactgcggcaaaataaacaagaagggtaacatgatcgacatattccccacggtaataaacatggctttgccaccgcgattggtggattggtaatacgccgcgctcaccactaagaaaccatcaagatacatcgcaaacaggtgcagcttaatgcccatttgcgctccggcgatcaattcgctgtcgctggagttaaatatcgcaatcgcctgctcagggaagaggtttagcaccagcacaaacgccatccctcccagtacggcaatccccatcgccaagcgtaataacttacggatgtgatcgtaattacgcgccccaaaatggtagctggccagcggctgcataccattcgcaataccttcaacggtcaggtagtagatcgtcactatgtaacccatcaccgcataagcaccgaccatgacggcgttgccgtactcgatcatcaaggtgttgtgcagcgcgaccatggtggaaccgtaggcgtacataaaaaagcttgagacgccaatcgcgaagatcttgggtaacgagtgccactccaaccttaagcaacgacgagttaaacgcatattggctcgggcagaaaagaaatacgccaagcctaataacgtgaccaccacctgcgcaagagtggtggcgatcgctgcaccggtcagctcccattgcagccaagcgataaacaggtaatcaagtgcgatattggtcagtgcaccaatcaccattaataacgtagccaaattggggctgtgatcgttacgtagcaaaaacggcatcgcaatcgagcctaaggtgaacaaacagccaacaattaacacttgtaggtactgcaggcctaattcaaacacccttccttcagcgccttgccaacgcaagaagtcatccgccataaaccacaaaatcacagccacgataggggcaagtagcagcaaactcatcaacccagtggccagaatacgcttagcactgtcaggatggccttccccctgtttgattgaagccagagctccagtgcccaccccaaccagcataccgatcccgaggatggtaccgatcacaggccaagccacgttaatgccagctaatccctcagcgcccacataatggccaatgaagatgccatccaccacttgatacagaccattaaccagcatcgcagccaccgtaggaatggtgtagcgaacaaactgtcggtaaatcgatcgattcatcatacaaacatatctatttagttagttagcctatctaataaaaacctgactagcgcagggctttacccaataacaagtccagcatcatcgcttcttcagaagataaattctgcgcgacttgttctgccaaaatctgataaaccttagcttcactcgccagatgtaactccgcttgttccgtcagctcaaacaattgagaacgcgcatcagattggcactgaacgcgtttcactaaacctcgccgttcaagcctcttcagcatgttagaggcagagggcttactcacttctaacgccagtgctaaatcggttaaacggatcgcttgaggggcgctttgaatcactttcaggtagtcatattcattaaaactgagctgagcaagaggatcttctttgccatatttacgccaaactttggcggcaaagcgttccattttttctaaattaacatcgagcatattcgataacacatagttagcaaggctaactattctgccagagtcctagcaacaaaaaaagccgcaagatgcggcttttttatcagagagaggtgaaactattgtgtcattgcttcggctttcgcgcgcgctaactgctcttcacgggcttgttgatagatgcgccctagctcaagaaaagcatagcgatgctccacatattcatacacattaaaggaaatcgcgagcttatacaaagagagagcatgggccagttctccttgcatttgataacgcttacctaggtagaaataagcctcagtgagacgctgtgctaatagctcattttctcgagagcccgcaataatggctttgaatgcgacctcttccgagagttgatccagcatcagtcctaccaacacccagccccactgttcatcgtgctgctgatagcgttcaagcaattctgtacgcgcttttgtcgggtcaatatcgctttctatgatgtacagccacagcgcccgaaaaggatcttgtgggtcttgctgatagtgcttagtgatctcttcgagtgccagttgtgggcgctcgccatagtaaagcgcgatggcgcgattgcgcacggcatactcgttactaggatccaattctaacgtcgaatcgaaggattcatacgcggcgtcaaactcgcccgcttcggtgtaatacacccctagcaagttaaacacatcgggctgcgcagggttaatcgagagcgattgagtaaaatcgagccgagccaaatcacgtaaaccgacactgtcgtaataattgccacgttcgaacagcattttagcgcgtatctcaggctcaagatccgtgcgctgtaataattggcttaagcgggcgatttgcacttcttgttgaatcgacgcttgcagcggcaccgccattggcgggtaaagccattgggttgcagattcattctgcgtggcacaccctgacagcagaaccaatcctatcaccgctatcgggaatcgaaaccatttcactcatcatactcctgtgggatttcgcataaaaaagggagcgaataacgctccctttatagcacgcttttattatgaaaagtaaaagccgtgttgtttttgctccagcaacggaaaattattccgcttgtggtgccacttctgctgctgcagcatcagaagtttcaaccgcttctttcatgcttagacgtacacggccttggcggtcgatttccagcactttaacttgaacttcttggccttcagtcaggtagtcagacactttctctacgcgcttgtcagcgatttgagagatgtgtactagaccatctttaccaggaagaatcgttacaaacgcaccaaagtctgccaaacgagctactttaccagtgtagatcacgcccacttcaacttcggcggtgatctcttgaatacggcggatcgcttctttcgcttgatcgccgtcagtcgcagcaatcttgatcgtgccgtcatcttcgatctcgatggtggtacccgtttcttccgtcaactgacgaattaccgcaccgcctttaccgatcacgtctttgatcttctcaacgctgatcttcatcgtgtggatacgtggcgcaaattcagagatatcgctacgcgctgcagagatcgcttgatccatcacagacagaatgtgtagacgagcacctttcgcttggttcagagcgatttgcatgatctctttggtgataccttcgatcttgatgtccatctgcagtgcagtaacacctgtcgcggtacccgcgactttaaagtccatgtcgccaaggtgatcttcatcacctaggatgtcagacagaaccacgaaatcattttcttctttcaccagacccattgcgatacccgcaacagaagccttgattggaacaccggcatccatcagagcaagcgatgaaccacacacagaagccattgaagatgaaccgttagattccgtgatttcagaaacgacacgtactgtgtacgggaactcttctggtgatggcataaccgcagcaataccacgcttcgccaaacggccgtgaccgatttcgcgacgcttaggagaacccacaaaacccgtttcacccacacagtatggagggaagttgtagtgcagtaggaagtgatctttcttctcgccagtcagctcatcgatgatttgcgcatcacgctgagtgcctagagttgcggtaaccagagcctgagtttcaccacgtgtgaacagagcagagccgtgagtacgtggcagaacgccagtacgaacgtccagagcacgaaccatgtctttttcacggccatcgatacgtgggttacccgcgatgatgctgcgacgaacaacggttttttccagatcgtggaaaatggtgtgaatttctttggtgtctaaagcttcgttttcagccagcagagccgccgtgacttctgcactgatttcatggatacgatcataacgcgccattttctcagtgatttggtacgcttccaccaaacgagtttctgccagagcagccactttcgctttcagctcagtgttctcggctggtgcaacccattcccatgctggtgttgcaacttccgctgcgaattcattgattgctttgatcacggcttgttgttgatcgtgaccaaacacaacggcagccagcatctcttcttcagtcagaatttgtgcttctgattccaccatcagtactgcgttgtcagtacccgcaaccaccagatccaaacgagactgtttcagctctttttcacttgggttcagaaccaattgaccatcaatgtgacctacgcgagccgcaccgattggaccattgaatgggagtccagaaatcgccagtgctgcagaagtaccgatcatcgagatgatgtcaggttgcacgtctgggtttactgaaaccacagtcgcgatcacttgcacttcgttagtgaaaccatcagggaacagcggacgaattggacggtcaatcagacgagcaatcagcgtttcgccttcagaaggacgaccttcgcgcttaaagaaaccgccagggattttacctgccgcgtaagtacgctcttggtagtttacagtcagagggaagaaatcttgacccactaccgcttctttcttaccgaccacagagacaaacaccgcagtgtcatccatggtagccattactgctgccgttgcttggcgagccattacacccgtttcgagagtaacggtgtggttaccgtactgaaacgtttttactactggtttttcgaacatgagtattccttattctcaggacaagcctgaaatcaaatcattaatactcagagcactactaatcgcgactagtaaaaatagactgacaacttgggagtacgttcgagaaacaatcggttttaatggcgatctgtttttaagagcgatctatttgtaagagcaatctgtttttaatagccgcgaccttttggtcgactacggtgactgtaatgccatgagcacaaacttgttcagccacgtagactgaacggcggatagtataaactacttagaggaaggatagctaatttagagtgcaaatttagcctgcaaaaaaggggcttacgcccctttttgtacaaactgtgctttgcagcgacgaattaacgacgcaggcctagacgtttgatcagatcttggtaacgagacagatctttacctttcaggtagtccagcagtttacgacggcttgaaaccatacgtagcagaccacgacggctgtggtgatcgcctttgtgtgcttggaagtgaccttgcaggtggttgatagaagcagtcagtagagcgatctgtacttctggtgaacctgtgtcattttcgcaacgtgcgtattcagcaacgattgctgctttagtttctgcattcagagacataattctctcctaaagagtttgaggtttaagtttgtgtcagccaatctctgattcagccgacacgagaagcgcggattatagggaatattcctaatccgcacaagcggaatgtctcgccatacagcgagcccttccacgaatttattcgccgtacaccaccaagcgtttcggcgcgaccttaccgttatcgtcaatctcgccaacgccaaggaatagcttctgctcgccgccagtaatgcgcaccataccgtcggatggtgcccccgaaacctgtactgcttgcccatgctgaataagtgtcatcagttctgggatcacgttgacttcgggtaaagcttccacggcagtatccatcggcagtaatagcggatcgagaacgtccgccaccgctttttcgtcacgatgggcttgttcaaccaaagcgttgagttgctctagcgtcaccattcgctcatacggatagttagcgacacccacacggcgcagcatggtcacatgcgctccacagcccagcatttcacccagatcatcgactatggtacgaatataagtgcctttcgagcagtgtacttccatctccacttcatcaccttcaaagcgatgcagctcaatctcatacacagtgatcttgcgcgcttcacgcggcacttcaataccctgacgggcgtattcgtagagtggacgaccttggtatttcaacgctgaaaacatggatggaacttgatccgtttcaccgcgaaacttggcgatacaggccagcagcgtatcgtaatccacgtgaacaggacgcgtttgtaccacttgaccatcagaatctgaggtgtcggtacgttcacccaatttggcgatcacacgataacgtttatcagaatcgagcagaaattgggaaaacttagtggcttcaccgaggcagattggcaacatgcccgtcgccagaggatcaagcgcgccagtatgtcccgctttttcagcgccatagaggcgtttaaccttttgcaaagcgtcgttggaagagatacctgtcggcttatccaacagaatcacaccgtggataacccgacctttacgtcgacgagccattacgcttcgtcctcatcacgacccgcttcatgcttgcggcgcttgtcactattgatcacttcggtaacgaggtttgacatacgcataccttcaaccaaggtgttgtcgtagtagaagcgaatttctggcgtcaaacgtaagcggatctgcttacctaacatcatgcggatctgcacttcgtgctcacgcaatgctgccagacaagattctggggtttgctcaccgatgcacagaaaggtcacgaacactttggcataagccaaatcgcgtgatacttctacatcagagatggtcaccatacctaggcgagaatcacgcacttcgcgttgcaggatcatcgccagttctttttgtaattgctgtgccacacgttgtgtacggctaaattctttcggcatatcgtttctcactgatagaaagaatggggggatggtcttggccagccccccatggtgtattcaacaacctatattgccttgattaatgcaacagtagttgattagtcgatggtacgttggatttcgatcgtttcgaatacttcgatctggtcaccgacgcgaacatcattgtagttcttaacgccgataccacactcgtaaccattcttcacttctgcaacgtcatctttaaagcgacgtagcgattccagttcgccttcatagataactacgttatcacgcagaacgcggattggagcattacgtttgatcacaccttcagtgaccatacagcctgcaatcgcacccagtttcggtgacttaaatacgtcacgaacttccgccagaccgatgatctcttgtttgaactcaggagacagcataccgctcatcgcctgtttcacttcatcgatcaattggtaaatgatggagtagtaacgcagatcgatgttttcagcttcaatcatacggcgagctgacgcatcagcacgtacgttaaagccaaccacgatagcgttagaagccgccgccagaaccgcatccgtttcagtaataccaccgacaccagagccgacgatattgactttcacttcgtctgttgaaagtttggtcaacgagtccgcaatcgcttccactgaaccttgtacgtcagctttcagtacaatgttcagctcagcgacatcacctgcagtcatgttagagaacatgttctccagtttagacttctgttgacgcgccagtttcacttcgcggaacttacctgcacggtagttagccacttcacgcgctttacgctcatcacgtactacggttgcttcatcaccggccgctggaacaccagacagacccaggatttcaactgggatcgatgggcccgcttcttcaacttcgttaccgacttcatcacgcattgcacgaacgcggccatattcttggccacacagaacaatgtcacccttacgcagagtgcccgattgaaccagaacagttgctaccggaccacggcctttatccagacgagattcgatgaccacgccagacgccataccttgtttcaccgctttcagctcaagaacttcagcttgcagcagaatagcttccagtagaccgtcaatgttagtaccttgtttcgcagagatgtgaacaaacatgttgtcaccgccccactcttcaggcatcacattgtactgtgacagttcagttttaacgttatctgggttagccgtgtctttatcgatcttgtttactgcaacaatcagaggaactcccgccgctttcgcgtgttggatagcctcgacggtttgtggcattacgccatcgtccgctgcaacaaccagtactacgatatccgttgcttgtgcaccacgagcacgcatagcggtaaacgccgcgtgtccaggagtatccaggaaggtgatcatgccgtttggcgtttcaacgtggtaagcaccgatgtgctgagtaataccacccgcttcaccagaagcaacgtgggtacgacggatatagtccagcgttgaggttttaccgtggtcaacgtgacccatgatggtcacgactggcgcacgggaaacttcttcgaacttgtcatcacgatccgacagaatcgcttcttccagctcattttccttacgcagaaccactttgtgacccatttcttccgctaccagttgagcagtttcttggtcaatcacttggttaatggtcgccatcgcgcccattttcatcatcactttgatgacttctgtcgctttcactgacattttttgtgccagttcagaaacaacgatagtttcaccaaccacaacatccgctttcgcgacgacagcggttttatcaaaaccgtgttgcatagacattggcttgttgatgcgacctttacgacccgctttaccaccacgaggacgagaatcgcgctcttggttatcgtcacgagaggacatctttctcttattcgcttttgtcgagcgacgacgagcaccttcttcgtggaggtcagcctcatcttccgcttcgcgtgcataacgcgaagtcgttacatggtaatctgtgttttcttgcatatcacctacagtctctttatcagcagaccaacgctcaccatttttttcagccaattcgcgtactttttcaagttgacggcgactttcctcttcggccttacgtcttgcttcttcttcctggcgacgttttagcgcctcggcttctttgcgcgctgcttcttgcttcaatttttcttcgtcagaacgtggttgtgtagccgcttgcgtttcacgcttcgctttctcttcagccatacgttttgcctctgcttcacgcttggcggcttcttctgcttcacgtttggctttttcttctgccgcacgttgtgcagcttcttcagcttcacgttttgcttgctcttctgcggcgcgcattgcggcttcttccgcttcacgagtcgcttcatcttcaacagaactgcgcttaacatacgtacgttttttgcgcacttcaacttgaacattcttacttttaccgccaccggcattcacgctcagtgtgctacgggttttacgctggagtgtcaaacgcgttggctcagagcctgtcgcatcgccgtgctctttacgtaaatgagccagcagcttctgcttctcatcctcagatacgtgatccgcaacagccttgttcattcctgcatcagcaagttgctctaataagcggtctactggtgttccaatttcttcactcagtgctttaacggtaatttgtgtcatgccgcttcctccccttgctgaaaattatgcgtcttcaccaaaccaacaaatgttacgagccgccataataagctcacccgcacgctgttcggtcagaccttcaataccttctaaatcatccacaccttggtcagccagatcttccagtgtcgcaacacctttcgctgccagtttgaatgccatgtcgcgttccagtcctgctaatgcaagcagatcttctgcaggctcaaggccttcgaacgactcttcttttgccaaagcaatcgtcgtcagcgcttctttcgcacgactacgtagctcatctgccagatcttcatccatgccatcaacatcaagcagctcattcattggtacgtaagcgatctcttctagcgtagagaagccttcttcaaccagcagctcagcaaaatcttgctcaatatcgagatacttcatgaagttctcgatggatgccattgactcttcttggtgtttcttctgtagatccgcaaccgtcatcacattcagttcccaaccggtcagttgagaagccaaacgtacgttttgaccgttacgaccgatcgcttgcgcaaggttatcagcctcaacagcgatatccattgagtgtgcatcttcatccataatgatcgatgccacatcggctggtgccatggcattaatgacgaattgcgctgggttatcatcccacaaaacgatatcaatacgctcgccacccagttcgccagaaaccgcttgtacacgtgcaccacgcatacccacacacgcaccaacagggtcgatacgcttatcattggtttttaccgcgatcttggcacgtgaaccaggatcacgcgcagccgctttcagctcaatcagctcttcaccaatttctggaacttctacacggaacagttctgccaacatttctggcttagaacgagtgatgaagagttggaaaccacgtgcttctggagccactttgtacagcaaaccacgaacacgatcgccaggacggaagttttcgcgtggcagttgatcttcacgtaggataaccgcttcagcgttgttacccagatcgaggatcacggtttcacggttcactttcttcactacaccagtcaccaattcaccttcgttatcgatgaattgttcaacaatctgtgcacgttctgcttcacgcactttttgtacgatcacttgtttcgcagtttgcgtggtaatacggtcaaaggttactgattcgatctgatcttcgatatagtcacccagttgaaccgagtcatcatcaaagctcgccgcttcaaatgagatctctttggttgggtgctcaacattctcaaccactaaccaacggcggaacgtttcaaacgcacctgttttgcgatcgatggctacgcgcacatcgatctcgatttcatacttctttttggttgaagtcgctaacgcagtttccagcgcttcaaaaatacgctcacgaggtaccgctttctcgttagaaaccgcctcaactaccgctaaaatttctttactcattgttctagcctcaaagacttaaaatttagggatcaggttagcttttgaaatgttgcttaaggcaaagtgttcttcttgcccatcaaccatcacggctacggtttcaccatcaattgattggatgacccctttccacttgcgacggttgccaacagccatcttcaaaacgatgctgacctcgtgaccaataaactgctcgtaatgtgctgctttaaagagtggtctttctagaccaggagaagacacttcgaggttgtaaacgaccgaaatagggtcttcaacatccaaaacagcactcacttggcgacttacttctgcgcagtcttccactgtgataccgttttcgtgatcaataaagatacgtagtgtggaatgttgccctgcacggacgaactctaatccaaccaactcgtaacctgcagcaaccaccggagcttcaagcatttcagtaagttgtctttctaaaccagtcatctaaaccactccagaaacaaaaaaagggcttagagcccaatttaaataccaagcaaatacctaaaacccttaaaaaggaaatttagataataaaaaaccccgattaagtcggggttttttattgctggaccctgataaattgagaatcgcttctcaactgcagtgaggttaacactgccaaacttgtctctctaatcgttaagagagattggttgcggggggcggatttgaaccaacgaccttcgggttatgagcccgacgagctaccaagctgctccaccccgcgtccgacttgcgagcattatacgctcacaagatgatttacaagtttgtaaatatggtgccgagagagggactcgaaccctcacacctaaggcgctagcacctcatgctagtgtgtctaccaatttcaccatctcggcatatcttttattgaggaatttcgtcactacttttagcaggcgcttcactcactgagtcaccagcttgctgaatcacttgaccttgtgaagggtcaacccattgtgattcagttttgtgagttgacatattgccaagcacaagactgataacaaaaaatactgttgcgaaaatcgcagtcattcgggttaggaagttacctgagccgctagcaccaaacactgtgtttgacgcgccagcaccgaatgaggctcccatgtctgcgcctttaccttgttgaatcaacactaggccaatgatagcaaccgctgccaacaggtaaatcacaagtagaactgtaaacattacttccacctatgttcatatttgttgagctagcgccgttcgtatcatcagactcgaacaaggccagcgacctttctctccgaaagcggacgcaatactaacgaatggttccgagactgacaagaggtattttctaaaaaaaatcactttacgatttgatcgctcaaaaaactcgcacaacagcgttttttcgagcatttctacaattcctagcgcgaaatcaatcagctaggaattgtagaaaccagcgcccaaattagcagttatcttttacagcttgagcaatttttaatgcagattgcttcactaaggtttcatcttccccttccaccatcacacggatcagaggttctgtacccgatttgcgcagtaatacacggcctttcgaacctagctcagcttcaacctcagataccgccgctttcaccgcatccgcttcaagtggattgttatctcctgcaaaacggacattctccaacacttgtgggtaaagcgtcatacctttcgctaattcatgcagggtcatttcactacccactactgaagccagcacttgtaggccagcgacaatcgcatcccccgtagtcactttatcgagtaagatgacgtgacctgaattttccgcaccaatcttccagcctttctctagaagtttttccataacatagcgatcaccgaccgcagcgcgtacaaatggaatgcccaactgtttaagtccattctccatgccaaggttcgtcatcaatgtcccaacaacgccacctttgagctcgccacggcgcagtgcatcacgggcaataatgtaagcgatttggtcaccatcgactttattacctaggtgatcaaccatgatgatgcggtcgccgtcaccatcgaaagcaaggccaagatgagcatgctcttcaacaacgcgtttttgcagtgcgcgaacgtcggttgcaccgacttggtcattgatattcaaaccattaggctcaacgcccatcgcaatgacttccgctcccaactcacggaaaacattgggcgcaatgtggtatgtggcaccattggcacaatccacaacaagcttcaaaccagatagactgagttttgaagggaaagtgcttttacaaaattcgatgtaacgccccgccgcatccaccatgcgtgaagctttaccaagctcagccgattcaacacattcaatgtctttatctaactcagcttcaatcgctaactcaatgtcatccggcagtttggttccttcataagagaagaacttaatgccgttatcgtagtaagggttgtgcgatgcagaaataacaatccccgcttctgcacgaaacgtttgggtaagataggccacagctggcgttggcattggtccggtgaaggtcgcttttaatcctgccgctgcaagcccagcttccagtgcagactccaacatatagccagaaatacgggtatctttaccaataatgacttttctcgtgccttgttttgccagtacacgtccagccgcccagccaagcttaagtacaaaatcaggagtaattgggtactggccaactttgccacgaaccccatcagtgccaaaataacgtctcttatcagacatttgtgtttcctttacattattgtttttacaaattgttatgcatcatctgcaccattttgagtgcatcaatggtctgctctacatcatgaacacggataatttgtgcgcctttttgcgcagccaatgtggcacacgcaacgcttcctgccacacattcagctggttgcttattcagtgttttaaaaatcattgatttacgtgacattccagctaaaactggcaatccaaaacgatgaaactgttctaaatgggcgagcaaatgataattgtgttgcaccgattttccaaaaccaaaaccgggatctaagataatattctcacgcttaatacccgcagcttcgcattgtgcaattcgctcagctaaaaactggcaaacctcttcaataatattgtagtagtgtgggttagcttgcatcgtccgcggctgaccttgcatatgcataatacaaaccgggacttgagcctgcgctgctacttcaagagctcccggctcttgcaaagcacgcacatcattaatcagatcggctcccgcagctaatgcttggcgcatcacttccgctttgctggtatcaatcgaaatccatacctcagcattctgttttcgaatcgctttgataagtgggatgacgcgctgtaattcctcttctaaagcaacatcaggagcgcctggtcgagttgactcaccgccaatatcaataatcgcgacgccaaggtcgatcatttgctgtgctcttgccaacgcgacatcaaggtcaacgtaacggccgccatcggaaaaggaatctggcgtagtatttaagatacccatcacaacgggtgaatgcagctcaagctgcttatcggcatgactgattttcagcattctaaaaatatattccctgcaaacacaaaaccccgaacaagtcggggtttaaagttaaaagtgatgttattcagcgtcttttttctcgcttgctgtcgcgacatccgatgaagcagtctctgctgtagattcttccgccttagcttcaggctcagcttttacttcaggtgcagacggagttttcgattgttcaccccaacctgctggttcacgaatcacaggcttacgcgccatcaagtcatcaatctgacctgcatcgatagtttcatacttcatcaatgcatctttcatcgcatgcatgatatccatattatccataatgatttggcgagctcgttcgtagttacgatcaatgatttgacgcacttcgtcatcaatcagcttcgcggtgtcatcagacatgtgtttcgtctgtgtcacactgcgcccaaggaacacttcaccttcatcttccgcatacaacatagggcctagcttttcagagaagccccattgggtcaccatcttacgagcaatttctgttgcacgctcgatatcgtttgatgcgcctgttgaaactttctctttgccgtaaatcaactcttcagcaagacgaccgccgtacaagctagagatcattgattccagatgctgtttagacatactcacgcgatcttgctcaggcaagtacatggtgacacccaatgcacgaccgcgaggaatgatcgacactttgtaaaccggatcatgctcaggtacaaggcgacctactaccgcatgaccagcctcatgataagcggtagactcttttatctcttcagacatcaccattgaacggcgctctgcacccatcatgattttgtcttttgcaagttcaaactcaaccatagagacgttgcgcttgttgccacgagcagcaaacagcgccgcttcgttaactaagttcgctaaatccgcaccagagaatccaggagtaccacgcgcaatcaatgatggctctacatcattcgccagaggcactttgcgcatatgcactttaagaatttgctcacgaccacgcacatctggcaggcctaccacgacttgacggtcaaaacgtcccggacgcagcaatgctgggtccaacacgtcaggacggttggttgccgcgatgacaataatgccttcattgccttcaaaaccatccatctcaaccagcatttggtttagtgtctgctcacgttcatcgtgaccaccaccaacacccgcgccacgctgacgacccactgcatcaatttcatcaatgaaaataatacatggagaggctttcttcgcttgttcgaacatgtcacgcacacgagatgcaccgacaccgacaaacatttcaacgaaatccgaaccagagatagtaaagaatggcactttagcttcaccagcaatcgctttggcaagcaaggttttacctgtaccaggaggaccaaccatgagtacacccgttgggatcttaccacccagcttttggaagcggctcggatcgcgcaggtaatcgaccagttctttcacatcttcttttgcttcatcacagcccgcaacgtcgctgaaagtggtttttatctggtcttcactcatcatacgcgctttgctcttaccaaatgacatggcacctttgccaccgccaccttgcatttgacgcatgaagaagatccaaaccccaatcaatagaatcattgggaaccaagagatgaaaatggtacccagcaagctttgctcttcaggaggcgtaccttgtactttcacgtcttgattgatcaagtcatcgaggagcttttgatcataaaccggcatgtaagttacataacggctgccgcctccacgacgcatgaaagtaatttcaccgttgttgaattgagcttcctgaatctggccttgaccaacttcctttacaaatgtggtgtagtcgactgctctgccgttattctcaccggggccgaagctctggaatacagacatcaaaacgacagcaatcacaagccacaggattaaattttttgccatgtcactcaaggtgtaagcctcgcgataactaattgtaattaaaaggtagggtactacagtttgtagctagcggctatagggtctacttaggcaccaaatagtgaaatagttaacctttgtaaccagtcgctacgataaaaacttctcgtgaacgtgatcgagaggagtccggtttacggattttaaccactttaaacaggtctcttactgctttgacataatcatcaaagccttctccttgaaacactttcaccacaaaactaccattgggagccagaacttgtcgacacatatccagtgccaattcgacaagatacatggcgcgaggctgatcgacggacaagttacccgccatattaggtgccatatcagacatcactacatcaaccatatctggctggattcgatcgagcaatgcattgagcaccgcttcctcacggaaatcaccttgcaagaaagacacccccgcaatcgactccataggtaaaaggtcacatgcaataacacgcccaccttcgccaactactttggccgcaaattgcgaccatccaccaggtgcagcgccaagatcgacaactgtcataccagcttttagtagtttatctttgttttggatctcttctattttgaagatagcacgtgaacgatagcctttcttctttgcttcgttaacatatttgtcgtcaaaatgctcttttaaccagcgagttgagctggccgagtgtttctgtttactcattttgttcctaactaagtcaccactatccaagaaagtctggtagaaaatatagtcttctagcatagatggcgttaaaatgacggttttcaaccctaatattaaataaatttggccgcgtaatgaacctaagcaacaaacaaaagcagcatctgaaaggcttggcacacaacttaaaacctgttgtgttgatgggagctaacggactcacagaagctgtgctggcggaaatcgaaattgcgctcgatcaccatgaactgattaaagtgaaagtcgtttctgaagatcgtgaaactaagcaattgatcgttgacgcaattgttcgcgaaactggtgccgagaaagtacaggtaattggtaaagtcctagtactttatcgccagtctcagcaacgcaaaatcgaattgccacgcaaataatcagccaatggatgaaaaaaggtcgcgactgcgaccttttttactttttcctaaaatgattggctaatttgcgaagctatagatattccacgcgatcaatttcaaagaccttattgccccctggagtcgcaatcgagacttcatcgccttcaaatttaccaatcaaaccacgagcaatcggcgaattgactgaaatacgacctgatttgatatccgcttcatcatcaccaacgatttggtaagtcttctcttcgtcgctgttgacatcaatcaccgtcaccgtggcaccaaaaatgactttgccactgttttccatcttagtgacatcaataacctgcgccactgatagcttgtattcgatatcacgaatttgcgcttcacagatcccctgctcttcacgtgcagcatggtattccgcattctctttcaaatcgccaagctcacgagcttcggcaatcgcttctgtaattttaggtctgagctttaatagtctatcgagttcttcacgcagtagcttttcaccacgcgctgtcattggaactttttccatcatttacctctgcgccaaagtgtttctttggacaataaaaaatttcccaacatcctaaatcgggtcgggttagggttgaaccatttggattactcaaaagtgtaaacaaagttaagagctaaatcatccaaattcaagatttgcgaggcgaatttagttgaatccccattttcgctttttatatgtgatctttagcacaattagattgcgtgcattttgctcaatctcgataaaaaaaaataaaaaatacaacaaattaaattaaaaaaaacacttaccaacaaacattaaaatcatttaaaaacaataacttgataaatttttaccaacaataaaacagtgttcataagttggatttatatcattttactaactgatagcggaactttgggagtaaaaaaatagccacgaaaatggctgagccatcaaatctttatgctttatggttgaacacaacaatgaccaatgaagcttgatgcatcacctatttcgattgacgtggcttacgtcgcacaaaaatcaaatttatggacaataaattaggacttaataagatgaacaagactctgattgctcttgctgtatcagctgctgcagtggctactggcgcttacgctgacggaatcaaccaaagcggtgacaaagcaggttcaaccgtttacagcgcgaaaggtacttctctagaagttggtggccgtgctgaagctcgcctatctctgaaagatggtaaggcacaagacaactctcgcgtacgtctaaacttcttgggtaaagcagaaatcaatgacagcctatacggtgttggtttctacgaaggcgagtttactactaatgatcaaggtaaaaacgcgtctaacaacagcctagacaaccgttatacctacgctggtatcggtggcacttacggtgaagtgacttacggtaaaaacgatggcgcattgggcgtaatcactgacttcaccgatatcatgtcttaccacggtaacacagccgcagaaaaaattgctgtagcagaccgtgttgacaacatgctggcttacaaaggccaatttggtgacctaggcgtaaaagcaagctaccgttttgctgaccgtaacgctgttgacgcaatgggtaatgttgtaactgaaacaaacgctgccaagtactctgacaacggtgaagatggttactctctgtctgctatctacactttcggtgacactggctttaacgtaggtgctggctacgcagatcaagacgatcaaaacgaatacatgctagccgcttcttaccgcatggaaaacctgtacttcgcaggactgttcactgacggtgagctagcgaaagacgttgactacactggctacgagctagctgctggttacaaactaggtcaagctgcgtttactgcgacatacaacaatgcagaaacagcgaaagaaacttcagcagataattttgctatcgacgcaacttactacttcaagccaaacttccgctcttacatctcttaccagttcaatctgctagattcagacaaagttggtaaagtagcatcagaagacgaactggctatcggtctacgttacgacttctaattgttgacttcaggtcacacgccaaacgcctgctcactagcaggcgtttttctatctcgttatactgcagcaacgtttcttggtggatgttattgctatgctttttcgcttcatacctgtttggttactctctattagcggttttctaatagcctctccgatttacgcacaaacaccattgactgccgcaacgactaaacttcctcaaggggcacgttatagcctattgattgaagatgtcgcattacagcagaacactctcgaactcaatactcatctgtactatccccccgctagcacccagaagattttgacggcactcgccgcaaaattagaactgggtgataagtttcgctttcacactgatttaatgcgttcagggcaagattggatcattcgcttttcaggcgaccccaccctgaccaccgcagatttaacgacattgctcaaagcgatgaaagcgcaaagtggcggtaggattgagggcgatttgtggctggataatagtgtatttagtggatatgagcgtgcggtaggctggccatgggatattttaggcgtctgctatagcgccccagccagtgccatcaacctcgatgctaactgtatccaggcgtctatttataccgaaccacaaggtaaaacgcgcgtttatgtaccagagcactaccctgtgcatgttcagtcgcaagccatcagcgtgacacagagcgaacaagagagtttactgtgtgacttagaactgacggcaacgcctgagaatcactatacgctggatggctgtttagccctacgagacaaacccttaccactaaaatttgcggtgcaagatactgggatctacacccagcgagtggtctatcgtctcctcagccagctaaacatcgagctcaaagggaagataaaagtcggtaaagcaaataccaaacaagcgcagaaaatcgcttctcatcactcccagccgctgcctgtgttactgaaaaccatgttgcaagagtccgacaacctgatcgccgataccttgaccaaagccttgggacaccgtttttactctcaacccggtagctttaccaacggaacacaagccattaaacagattttttactcgcgcacgggcatttcattagaagatactcagctcgccgatggctctggcctttcacgtaataaccggatgcgtccacaagtgatgctggaaactcttcgctacctttatcagcacgaagctgagcttggtttaattgctatgctgccttcagcgggagaatcgggcactttgcaatatcgacgcagtatgcgtgcgccgcaaatcagtggccaaattaaagcgaaaagtggttcactttatggcacttacaatatggcgggctttgtgatggacgaaaatcagcgccctaagactctgtttgttcaattcgtcaccgactatttccctccgagatccaatcctgaggtagcggttgagccgccgattatccagtttgaaactcagctctatcaagagcttattcagtttaatcgtttggcatctaagccaaactaggctacctgaaaaataaaaagcgccgtttggcgctttttatttatttttagctcaggtttgaaaaccattacttgatggtcactcgagcgaacttacgcttacccacttggtaaaccgatgtaccacaagcaggaatcagcttcgcatcttctaacttctcgccatcaagcttcaccgcaccttgtttaatcatgcgcagtgcatcagaagtagaagccacaagtcccgcctctttaagcagattggagatagcgattccagactcgaattcaaactctggcatttcctcaggcatcgcccctttttggaaacggttgatgaactcttgttctgctgcgtcagcgtcggcttgagaatggaaacgagcgatgatctcttttgctagcaaaatcttgatatcacgcgggttagcaccattagcaacctctgctttgaattgggccacttcttctaacggacggaaagagagcagctcgtagtagctccacatcaaatcatcagaaattgacatgattttaccgaacatttcgctcggcgcttcgctcacaccaatatagttatgcgctgatttggacattttcttctcgccatccaatcccaccagcagaggcatcatcaataccacttgtggtttttggccgttggctttttgtagctcacgccccatcagcaagttaaacttctggtcagtaccgcctagctcaacatccgtctccatcgcaacagagtcgtagccttgtagcaatgggtacataaactcgtgaatcgcaatcggctgaccattgttgtaacgctttttaaagtcatcacgttctaacatacgagcgacggtctggtttgaagccagacggatcatcccttccgctcccagttttgacaaccactctgagttaaattggatcttggttttggcaggatcgaggatcttgaacacttgctgcttgtacgtttccgcgttacgcaatacatcttcgcgcgtcaaaggtgggcgtgtggtgttttttcctgttggatcccccaccattccagtaaagtcaccaatcaaaaatgtcacgtcatgacctaaatcctggaaagtacgaagcttattgaggattaccgtgtggcctagatggatatccggagccgttggatccgcccccaacttaattcgtagcggacgattttctttgagtttggcaatgagctcttcttcggggatcagctcttcaacaccacgtttaatctcggctaaagcggcttcaatactcgccattcttgttcactcccacagatttggcaaaaatatgatagtgggacatattacttgaatagcgatgcattttgaaaccagttagactacccgacagcgattttgttaataattaaatgaatttgaactgaacatgctttctcttttcaatcgtcttccttggctgcatcgagtgttaatcaccgcgtttagcgccattattgtcttcgccattttttttctgcccaattctgaagatttacgtaaaccggatgctcagcgagaagtaggacgccactatcccgtcactctcgataaccaactggtctccacaccagaggaagaagtgatcgctccgccctctgttatgctgcgctgggaaacctaccaagttgccaacggtgagagtgccgccttactcttccagcgagcaggactctcatcacgcgtgctctacgaattgacctcaagcaatagcgatatcaacaatcaactgtcgaagttaatgcctaaagacgagctgaaatttggctttgacaaagataatcaattagttcaattaaaacgcaccattagcccttatgaaacctttgtggtaacccgttcagattctggttttacctctgagtttgataagaaagaagtcaccttccaactcaattatgccgaagccaaaatcacctctaatttctggaatgcgggtgtcaccgcagggttaagtgctaaccagatcattgagttagccaatatgtttggctgggatatcgacttcgcgctcgatattcgcgaaggcgatcaattcaaattgctctaccaagaaaaaatcgtcgaaggctctgtgattggtcgcggtaatattattgctgccacttttatcaaccaaggttcaacctttactgcgattttggatgacaatacaggtaactattacgatcagaatggccgtgcgatgaaaaaggccttcttgcgttcgccgctcgattttcgtcgcgtctcttctaactttaatcctcgccgactccatccagtgaccgggcaaattaaagctcaccgtggtactgactatgtggcaccagtaggaacaccgatttgggctgcgggtgatggtgtggttgagaaatccagctataaccaatttaatggtaactatgtctacattcgccatagcaatacctacattaccaagtacctacatttacagcgccgcctagttaaaaccggagagcgagtaaaacaaggccagactattggtacattggggggcacaggacgagttaccggccctcacttacactatgaattcttggttaatggcatccacaaaaacccacgcacggttgaattaccacaagcacagtcactgactggtaaagcaaaagagacctttattgcgaatgcgaagcaacgaatggaaaagcttgagcgttacagccagttactgtatgccaatcaataatcatctcgtggcggacaaaaagttaggccagcaattgctggcctaacttttatcaacattcactctgtcgctatgacatatttaactctgcgcatcttgaggagcttcgtcttcacttaccccttttctacgccgccctaacatgagcaagcaaggggtaagcactaaggtcagtaccgtagcaaaggctaatcctccggccaccgccgtcgccaactgtgaccaccactgggtactcggtgctccaaactcaattttctgattgatgatgtcgatattcatctcaagcaccatgggcagcaaacctaaaatcgtcgtcaccgtcgtcagcagcactgggcgcaaacgctgcactcccgtgcgcagtatcgcttcttctcggctcaaaccacgcttaagcaattgattataggtatcaatcaatacgatattgttgttcaccacaatccctgccagagcaatcaccccgatgccagacatgatgatgccaaacggtttttggaaaatcagcaatccagcaaaaacccctacggtagagaaaatcaccgcggtcaaaatcaggaaggcttgatagaaactattgaactgggtgatcaaaatgatcgccatcgccgcgagtgcaaccataaacgctttttcgaggaaaaccgcagaatgctcttgctcctcgttttgaccacggatacgaaactccacactactcggtaaattgagctcacgtagtgcctgttcaatggctgggagttctagcgctaggttgtacccttccttgagatcggccatcacgctaattacccgtcgaccatccacccgatgaatcgtatcctgcttttgctctggaataatttgcgcaaaattagtgagtggcactaaaccttgcgcggtttttacgcgtagttggtcaaaacgtccaatatcgcgatattcactcggataacgtaccaaaatatcgacttcttcatcgctgtcatcgggaagataatcgccaattttgaggccatttgtcacaaactgtacggtattgcccaccaaagtagcatcggccgcaaaacgtgatgcatcatcacgtcgaatatcaattttccaatcaatccccggcttgctgccattatcgcttaaattggtcagtgccggattggcctctgcccataacctcacttgctgagcggctttatcgagatcgtcagcaacgcgagctgaaatttcaatctccagatcatgctcaacagggggccctgcgtctggaaatttgtattcgatttcaacccctgggaaggtatcggtgacttgctccagttcctcaataatcgctttaacactgcgacgatattgccaatcaacgggggttatctgtacgacgccgatttcatcatcgccccccgtacgggtatagacactttcaaactcatcgtggcctaacatcacctgttcaatatcactcatgatacgatctttttcattcagcgacagatcgccataagagcgcactttgaccgagaaaaagggcggatcaacttcaggaaaaaactctgcacctaaccctgctttgccataagcaaacgcaatcgccgcagacatcagcagcgcaccgcacaaaattttgatcgggtggcgaatcgctatggcaagcgtgctgtaataggctttggtgatccccgtcgcttgtgaaaaatcaccattgtgcagcgccaccatccgcgcttgattggcttgggtcactttctgcggacgaccaaacaaacttcccaataccggaacaaagagcaacgccatcactaaagaggcagtgagcgtcgccattaaagtcagcggaaggtatttcatgaattcgccagtgacatctggccaaaacagcagtggggcaaaagcggccaacgtggtcgcggtagaggcggtgattggccaagccatacgtttcgccgcatcacgataggcttcacttcgatgcattccctcttgcatacgtcgatccgcaaattcagtcaccacgattgcgccatccaccagcatgccaacagccatgataagagcaaacagcacaacgatattgaccgtcagaccgaaaacggccagtaccaataacccagtcaaaaaagatccaggaatcgaaaccccaaccaatagcgaagtgcgtacgcccagaatcgcaatgataaccaccactacgagaatgatggcggacagaatattgttttgtagatcattgagcatgagtttgacatcttccgactcatcccaaatcgttttcaccaataaattattaggccaatcatcacgagcttgagcttcgcctaacaccgctttgactagctcaacggtttcaataatgttctcaccagaacgttttttgatatccaaaacaatggcgggtttaccatctaagcgagcgaagctctcaggatcacggaaagatttgcgtactgtagccacatcaccgaacgtaatcacttgcttaccttcgactttaatcggcagctctagtacatccttcagtgattcaaacacggaaggcactttgaccgaaaagcggccataaccggtatcgacaaatccggcggcgaccactcggttattgagtgcaatcagattgtagatgtcgctttgatccagtccatagctctccataagcagtggatcaacgatgatttccacaatctcttcacgatcccctgcgatatcaacagacaagatctgtcgaaagctttccaatttatcgcgtaattgacgggctatcagaactgtcgttcgctccggtactgtaccgtagagcacaacagataaaacaggctgttccgccgccagcgtcacttcattcaccgtcggctcatcactgtccgccggtaatttgggtttagccaaatcgaccgcatcacgcacatcggccatcgctttggctaaatcgacgcctacattgaattccagcacaacagaagcatgcccttctgacgcggtggccgtcatctctttcaccccttcaatcgagcgcatttcctgctcaagaggacgaacaatcaatctttccgcatcactgggagaaataccttggtggctcaccgaaacgtagatgataggaatggtgacatcggggctcgattctttgggaatggtcaggtaagtcgccacacccgcaaccaaaatgaacaccagtaaggtcaacatggtgcgcgtacgagacagcgccgcatcaatcagagtgaacatggtgcggctcctagtgggttgcgctgagttgagtggcgagaaccttatctccatcgcgaacaaatccttgtccacgggtaataatatccacttgctcgccaagtccggttaaccagacgccatcttgttctgctttcaccagttggattggcacaaacttgacgtgttcaccttgcaacgttttcacgccaaggttgccctcttcatcgagcgcgagcatggcgggggtgattttgatcgcggcttgagacattaggctcaactcaacttctgcgcttacccctgcaggaatggcttgttgtgggttatcgacctcaacttcaatggcaaaggtattggttgcaggcgatgagagccttgaaatatagcggactttaccttgtgtttgcgtgccatcgataaagcggatccgcgccgcttgttcaagctgtacatgttgaatgtgtcgctcactgacatcagcctctatcaccaatttgtgcagatcgataatggaggcaaccggatcgccaatcccaacaaaatcgcctttttcgataggtaaagtctccacgacaccatcaaagggggcgcgaacttgggtattatccagtaaacgttgcacagtactgagcgaggattgtgcatctgtgagagcagcagcagcattggtaaaagcaacttcgccttgtaagcctttatttttcagtgcactagccgcattaaactcttgttgtcgcactttgagctgcgctttcgctcgctctaactgggcatccagatcgcctttatcaatcaaggcgattatctggtttttggtgaccatttgccctttcgcaatcttcacctcggcgatccgcccagcaatttcagcaccaattttagcctgccgatccggcgcagtgcgtccgtacagctcgataactttatcggtttgagttgcgctaaacgtttgataaccgactttggctaaagggacttgtatttccatcgccgtttgcggctcttcggcgttggaatcgcctaagcctaaccagagtgctaacagaataatgaaggaaaaagaaatcagccaaggttgatgcagaaagtagtcgcgcgcttgacgtgaagaagttttgagcggaaacataactattccttattgttatcgctgcgtgacatcctaatacgcagcgtcggccaatcgagtttatcgactggccttattttcctgaaaaatctcaggattagacgctaaatgatgcgccgcaaccacacgtggtcgttgcattggggttgttaacgaagaatcttgagccttcgagaccttcggtataatcgaccactccgccgatcaaatattgcagactcataggatcaaccaccaaaatgacgccgctattctcaattttggtgtcaccttcgttgacggtttcatcgaaagtaaagccatattggaagccgctacaaccaccaccagtgatgtaaacacgcaacattaacgatggattttcttcttctgcgatcaacgctttaacacgttttgctgccgcatcagaaaaggataatggaacattaacttcgctcacgatgacctctctcagtcgtggaaaatacaacaacaccgcaaaatccgatgtgctgccgatctaataatgataatggcggcgattatctaatacctgagttggccgttcaagtattagccttaatccgaatcaacttggcggataaattcgctttcttgctcgctattttgcggatgcagatagggaaaatcgatcaaaatgtagcgaaaacatttcacccactggagcataggcgtacaatgcgccccaaaattggtccgattcatcataagaggaaactagcatgaccaaatcagccgagttgtatcaaaaggcgcaaaccacgattccgggtggagttaactctcctgttagagcctttaacggagtgggtggttcaccgattttcattgatcgtgccgatggcgcgctgatttttgatgccgatggtaaagcatacattgactacgtgggatcatggggaccaatgattctcggccacaaccatgcggtaattcgtgaagcggtgattcaagcagcacaacgcggtttaagtttcggtgcacccaccgagatggaaattaccatggcagagttggtctctgagctcgttccttcaatggaacaattgcggatggtgaactcgggcactgaagcgacgatgagtgcgattcgtcttgcgcgtggttatacaggccgtgacaaaatcatcaagtttgaaggctgttaccatggtcatgccgacagcttactcgttaaagcgggatctggggctttgactctaggccaaccaagttcacccggcgttcctgctgattttgccaagcacaccttaactgctcgttttaacgatctagactcagtgcgtgagctgtttgcggccaatcaaggtgaaatcgcctgcattatcgttgaacccgtagctggcaatatgaactgtatcccaccagtggaaggcttccacgaagggctgcgtgaaatttgtgaccaagaaggtgcattactgattttcgatgaagtgatgactggttttcgtgtcgcattgggcggcgctcaagcgcactacaacatcaaacccgatttgacgacacttggtaaagtgatcggtggcggtatgccagtcggcgcttttggtggtcgccgtgaagtgatgcaatacattgccccaacaggcccggtttaccaagctggtacactatcaggcaacccaatcgcgatggcagcgggctatgcctgtctgaatctactgcgtgaagaaggcaatgaaaagcgcttagccgccaaaaccaagcaactggctgatggctttaaatctctggccgatcaacatggtattccacttttagtacaccaagttggcggcatgttcggtttcttctttaccgaacaagagacagtgacttgctatgaagatgtcgcccgttgcgatgtagagcgtttcaaacgtttcttccatctgatgctgcaacacggcgtttatctcgccccctctgcctttgaagcaagctttacctcactggcgcacggttcaaaagagattgaagccacgttggaagccgcagatcgtagctttgcgattttggcagcggaagcgaaagcgtaacctactgtgggtcaccactttgcgaaggcagcctcggctgcctttttcattgagtgcagatctattgccaataatagagactcagtagcacgagagcacaaatcactacgccaaaccacggaatcggtctacgtttcgctttcttgtcacaacattcatttttatcacaacagcccatctcgacctccggattgctaagcagctgaattggcgtcattataacgcttcaaattcctttaggtggacaactcctgtgtcagaaaaaatcaaattagcatccagtcatcgcgtattagttgtggcgctgctcgcttctgcactcgcgtgttactggttggtcgagccttacatcaactcgataataatggccttcatcatttcgctcttaatgtttccaatccatgattggtttgaaaagaaactgccttcacacaacaatttagcggcctttttatcttgtgttgtgctaaccgttatcatcgttattcccctactgtttatttttggggccatcgttcaacaaggctctaagttctcacaaaacctctacgcatgggttacacaaggcggaattcaggctctctttaaccatccttgggtggtcaaagggctcagcttagccaatcactatctgccttttgaagagatcagcccccaacaaatcgcacaacgcattggtcagtttgcaaccacattcggcagtaatttagtcagtattagcgcaaaaattctcggggatgccaccagcttcgtgatgcattttttcctgatgctgtttgtgctgttcttcctactgcgcgatcacgacaaaatcatcagtgcgattcgccatattctgcccctctctcgcagccaagaagatcgcctgctcagcgagatagaaaatgtctccaaatcagcggtgatgggctcttttttaaccgccatcgcgcaaggtgtggcaggcggaattggcatgtggctggcgggtttcccgggactgttttggggaaccatgatgggctttgcgtcctttatccccgtcgtcggtactgcgttaatttggatccctgcgacactctatctatttttaaccggtgatacgacttgggcgattttcctcgccatttggagtgttgcggttgtgggctcgattgataacttactccgccccttcttaatgcaaggcagtgcagggatgaataccttgatgattttcttctccctgctcggcggtattcagttgtttggtttaattggcttaatttatggcccgctgatttttgccatcaccatggtgctgtttaatatctacgaagaagagtttcgcagctttttagatcagcaagaccgaagctaagtccaagttagggtttcattcaaggggcagagtgtgcgaaaatctgcccccttttcttgagtagagcgtgtcatgcaaccttatactgccccgagtgaaatcgcccttcgtcaactcgactattttgctgataagcatgtgttggtcgcgggcgaagttgaagatcgttttcctatcgaacttcgtcaatattgcgcttccgtttcggtgtttaccacgcactacggctactactctcagctcaaagcttaccctgagattactcgctactttggtgagcaattaacagcagatctcaatgctgatctgattttgctttactggcctaaagccaagcaagaagcggaatacttactcgcgatgctgctggcaaagctcggtacaggcactgaaattgtggtggtcggtgaaaaccgctctggggtgaagagcattgaaaaaatgttcgccgcttatggcccaatccacaaatacgactctgcacgccgctgctcattttattggggacactgtgttcatactccagccgcttttgatattgagcaatggtttaaatcttacgcggtagactatcaaggtcatgagctgacgatccgcagcttaccgggagtttttagccatggcgaatttgatctgggaagtcgcttactgctcgataccttaccccccctgagtggtaaggtaatcgatattggcagtggtgccggtgttttgggctgtgtgatggcaaaactcaaccctcatattgagttagagatgacagacatcagcgctctggcgattcgctctagccaagaaaccctagtggctaaccaactgcacggccacgtttatccatccgatatgttttccgacaccgggcatcactacaactatattgtgaccaatccaccattccattcgggattggagaccagctatagcgccacagagcgtcttcttgccgaatctgtagatcatcttgcttcgggaggctccatctgggtggtggcaaacagctttttgaaatatccgccaattcttgagcaagcgtttggtcactgcgatatcgccgctaaaaccaataaatttgccatctatcacgcaaaaaaataactcgttacattttgccgcttttaacgtaaatcagcctcaaaagcggcattctcctcacgttttttgcgtctatgcccacgctttagcttggacttacttgtcaaagtaaaaaaactcgttaatttcgttactttaggtttttcttgtctatcacccactcatgcttggcgatcgccgcagagtttcaccgaaagtaacaccttaattatgtttaggttctatcgaaaacaaaaattcaaacgcctgcaaaataccttgatggctgcgtttttggccctcagcattattcctttgaccattactgcgttgtttttcctacattcacacagtaaagatctggagcagcagagcacttcttacctcgtttctgttcgggataataaacagcaacaggtcatcgactacatgatggccaaagagtcggaagtgatgggttttgttcgctccgagctggcttatgccagtggcgggcgtttttatggtctggtgaatgctttccagcgtttagacgtcagtattgaagcggctcgtgaacatgctcagcagcgctatatcaccggatcgggtgaccaaataaaaacctcggtgctcccccaatcaagcagctacgtgggcagtgaacgctatcgactgctgcataaacgctaccactgggcttacttagaactgctgaaacggtcggactttgatgacattttattggtcgatattgatggcaacgtcgtttattcgatttataaatacgacaattttggcaccaacttattaacgggcaaataccaagacaccaatctaggccataccttcaagcgtttagaacaaacggtcaatgaacagcgcaaaaccaacgaagatttcacccctgtcgtgatttctgatttcgtacaagaggatggtaaacaatacgcttggcttggcgcaccgattattcagcaaggctacttgcatagttacgcgatgttccgcttaccaagcaatgcgatcaccaaactcatcgcagaaggcagtagcaatccttcgatgcaaaccattctagtgggacaagatcaccgctcaagaaccttaacttccgccgaaattgcggttgaaaaaagtaaagctgtggtcgatttagccttatcgggcaaacgcgccgtaggcacttacaccaataccgatggtgaacagatcatcgcggcctacgcaccgatcaatttgaaaaatatccattgggctctggtggttgaactgccagagaaagaagcgtttgctcgcgttcgtcagttagagaaactgtttgtttttgcgatgttgacggctatcgtcttagtggtcatcgcctcgcattacctttccaatttcattacctcaccgcttttgaagctgacatgggcagccgaacgtgtttcggcaggcgatcttgatgaagccatgatcaataccgaacgcaaagatgaaattggccgcttggcggtcagttttgagcgtatgcagcgttccattcgcgaaaaaatatcgctgatcaaatcgcaaaataaagagttagagagcaacttactgatcattcgtaagcaaaacgatgagttacagctagcgaataagctaaaagatgagttcctcgcgaccacatcacatgaattacgcaccccattgcatggcatgattggtattgccgaagccctgatctcgggggcaaatggcccgatttcagcagcgcacaagtatcaactcgacatcattatcagcagtgggcagcgcttggcgactctggttgatgatctactcgattaccacaaaatgcgctatggcgcgctggatattcaaaggtgtgccgtcgatttatcgagcgctacgcgcttagtcttggagctttctcaccatttacttggcaagaaaacgctgcgcattattaatcaagtctcagaacaaccggtctgggtttctgcggatcctcaacgcttagagcaagtcctgtataacttgatcggcaatgccattaagtacacttccgaaggcaaaattgttatctccgcaacctatattgacgataaagtgcgcgtgcaggtggtggatacaggtcaagggattccggcagaacaactggagcacatctttgagccattgattcaagcgggccatgatgcgagtcgctatcgccaaggcgcaggactcgggctttccatcagtcgtcagttaatcgaattgatgcacggcactctctacgtaagtagtcagccgatggttggcactacctttagcttcacgctgcctctggcgagcgaagaagagattgctcaagcgcgcttgaccgaactcccccacttccaagcaccggaagtgttggattctgaactgcccgagcaaagcaacttacccgaaaatgaacatggcccacttctgttggtcgccgatgatgaaccagtcaacctgcgtgtgctggacagctttttacgtcttgaaggttatcgcgtacataccgcgcaagatggccatcaagtacttgaagcaattaaacgtgaaaaacctgaattggtgttactcgacatcatgatgccaggcatgagcggttatcaagtgtgtgaaaaacttcgacaaacttacgaccacgctgaactgcctattattatgctgacggctctcaaccagtctgatgaccgggtacgagggtttgaagctggagccaatgactacttatccaaaccattcaacaaacaagagctggccgcgcgcattgtcgctcacctcacggcgagcaaagccgaactgcgccgcattgagaatgcccaactgcaaaaagagttgaaacatcgcgctatggtagaagcgagcctattggaaacccaaggccgattattggaacagttagaatctgcgccagaagcgattttgtgcgttaaagagggcaataaagtacgttttgctaacgaagcggcagcacgtttatttagacgtacccctgagcagctcaaacgctccaacgccgaagaactgattgctcctaaattcttgaatattgagcaagagcattactgcggcaatattgatgtttacgtagatgatgtgcgccagcacctctctgccgatgtccttcgcttgccgcaaggttctggcttacaagcgatgtacatttttaatgtcggcggcagcgtcaatgccgcgcggattcataacctcgaaaccgcggtagaagccctgtctagctatgccttcgaaggcgataaagacaagctgcaaaaactcaaggaactgggtggtgagtttactcgtcttgcagataaagcctcgggcgagtatcaatcgaaacaagatttgatgcgtgccgtgttagtcgaagccatgaccagtgccttgaactattgggaacgagtctcagggcaaagcaagttcacgtttgccgaacaaagtggcttgtggcgcgtttatcttgaccgcagcaccctacaaactcgtaccctagacaaatacttacgaattgagacactgcctaaaacaccgcgttggcgaaccgtactgaactcgctcgactacattcttgagcattgcaaagaagcaggccctgaacgcactcacatcgaaatgcagcgcgataaattgcaaaaactcctgaccagtgaataaagcaatccgcaagcgagccataaaaaccaccgcagggtggtttttttatgtccataacaaaacgctttcccaactcggttaatcagggtcttgaagtgacatacccaagcaacttgaattgccgctaggcaacaactgaatttatctccatgagcacagataaaccattctagatgcactatacccaaacaacttggagttgcaggtaggtggcaagtcagtgaatcccatgagcctaggcaaactatgtgataggggtgaagcaacaaaaccaataccacgcagcttccaatcgcagaggaattcgtcccttcatattgagcactagagtgacacactcagacttgattcaagagataaaaaaagcatattactcccctcttcttgtattcaaaaagtcgggataaaacggtaagaaagggcagcaaattcctgattcagtcagcctttgtttgagattgcgaagggagtcacaacaattcgccagatttaatttaatcgattaaattaacgtaaaatcaggctagtgagcgagatctcgcaaatataactcaggcaaagagccattatcaaacaaggccaaataagtaagtaaacactaacaaacctagctaaaccgtacccgttttgcgagttgaatcacttcgcgttttttgtacaaaaatcacacatcagaaggtattttgacgttaatgacgtagggcatctaggttttgacgtttttaacgggaattgcaattgataaatttcttggctaggtgttttcttactcctgccaaaggcctacaggccactcatgactccccaccctccgacggggtaaaagtgatgaggtaggtcttggagagtgtttatcaattgatgacattccatccattagtgaaatgaaagcaactagtaaggaacagctatgcttgccaatattaaaaagacagcactagccgccgcagtaatcgcagcagcaaccagtgtttcagctccagcgtttgcacgtagtgagctcaccatcgtgccagatttctaccctacaatggtacgtaacttcaacccgtacttagcgactaacctgcgtacaaccaccgactttatctatgaacctctggttgtattcaatgaaatgaaaggtaatacgcctgttttccgtctggcagaaagctacaaaatggctgacgacctgatgagcgtgactttcgatatccgcaaaggcgttaagtggtctgacggtgaagcattcacagctgacgacgtggtttactctttcggcctgctgaaagcgaaaccagaacttgatcaacgtggtatcaacaagtgggttaccagcgttgagaaagttgacgaatacaaagtgcgtttccgtttgtctgaagcaaactcaaacgtaccttatgaaatttctctgatccctatcgttgctgagcacgtgtggaaagacgtgaaagatccaaccaccttcactaacgaaaatccagtaggtactggtcctttcaccgtgatcgacactttcactccacaactgtacatccagtgtcgtaacccgaactactgggatgccgctaacctagaagttgactgtctgcgtgttccacaaatcgcaaacaacgaccaactactgggcaaaatcgttaactctgagctcgactggacttcttcattcgttccagatatcgaccgtacttacgccgcagcgaaccctaaccaccactactggtatccagcagcgggtactcaggcgttcatggtgaacttcaaaaacccagatcctgcgaaaaaagaagcactggataacgtagatttccgtcgtgcgttctctatggctctggatcgtcaaaccatcattgatatcgccttctacggcagcggtactgtgaacgacttcgcatctggccttggctacgcattcgaagcatggtctgatgaagcgacccacaaaaagtacaaaggcttcaacacttatgacgttgaaggctctaagaagctactggcaaaagcgggcttcaaagatgtgaacggtgacggtttcgttgaaactccatcaggcaaatcttttgaactgctgatccaatctccaaacggctggactgactttaacaacacagttcaactggcggttgagcagctacaagaagtgggtatcaaagcgaaagcacgtactcctgaattcgcggtttataaccaagcgatgctagaaggtacttacgacgttgcgtataccaactacttccacggcgctgacccattcacttactggaacagcggctacaactcagctctacaatctggcgacggtatgccacgctttgcgatgcactacttcaccgataagaagcttgatggtttgctagacagcttctacaaaacagcggacaagaacgagcagttagcgatcgctcacggtattcagaagatcattgctgaaaaccaagtgactatccctgtaatgtctggtgcatggatgtatcagtacaacaccactcgtttcactggctggtggagcgaagaaaatccgaagggccgtccaagcgtttgggctggtatcccagagcgtctactacacgtactggatctgaaaccagttaagtaatacacgttcatttcttgcggcgcacgctgtgcgccgcctatctaaatcccctcatgttgttaagcagacatatggcgctcgtcgtcaggggatttctcgctctcaaattcgctaggggcgagacctgaaaccagagacaggacaaaactgggtgagtaaggtgtaagttatgggttactttttaagacgattgtcgttctattttgccgcgttgctggtcgcagcaacattaaactttattattccgcgtgccatgcctggtgatccggtcaccatgatgtttgctcacgcaaccgcacaagttactccagaacgtatcgaagccatgaaacagttacttggctttgttgaaggtccttggtatgtgcagtatctgacgtacatcaaaagcatcctgacttgggagctgggcacttcaatcaaattctaccctttaagtgtgaatgagctgcttggtggtgcatttggttggtcactgttccttgcgggaacggcggttatcatctctttctcaatcggctctgtgctggggatttttgccgcatggaaacggggcagccgttacgacacttttattactccgggaatgctggtgattcaggctgtaccacaagtggttattgccatgctcgccatgttcactttcgctatcggtttaagttggttcccaactggctacgcatacacagcaggtaccactccagattggacgagttgggcattcatcaaagacgtcggttatcacgccgttcttcctctgttctgtgcttcgatcgtgcagatcggtggcttcttggtcaacatgcgtaacaacatgattaacctgctcgctgaagattacatcaccatggcaaaaggcaaaggcctgagcgaaaaccgcgtggtatttaactacgcagcacgtaacgctctactgccaagtgtgaccgctctttctatgtcgctcggtatggcgattggtggtcagttgattatcgaaatcatcttcaactacccaggtttaggcactgtactgttcaacgcgattaccgcacgtgactaccaagttctgcaaggtcagctgctgatcatgacgctgttcatgctgttctttaacctgctggcggacatgttatacgttgttcttgaccctcgcttacgcaagggaggtaaataatcatgaaagcactttggaaactcttacgcggcaaccgtatggcgatgattggtgtcaccatcttaggcctgttttttctgctcgcggtcgccgcaccacttcttacctctcatgagccagacaagcgcacgggtaatccgcacgaataccccgcttttgtcgtaaaagcggctaaagcgaatcctgatggctggattgccgaaaacctagcgacagatcgccgcactctagcgatgtcgaaaaaagctgaccacatactaggcaccacacgtatgggtcgtgatgtgtggtcacaagtggcttatggtgctcgcgtatccttagctgtgggcttcggcgctggtatcacggtctgtttcttagccaccgtcatcggtgtctctgcgggttattttggcgggaaaatcgacgatttcctcaccgccgcaatgaacatcatgctggtcattccgcaatacccactgctgttcgtattagctgcctttattggggaagcgggacctctcaccatagcgctgattattggctgtacctcctgggcttggggtgcgcgggtggttcgctcgcaaaccatggcactgcgtgagaaagagtttgtgaaagccgcagaagtactaggcgaatcttcatggcgcatcatctttattgagattctgccaaacctgatttcgattgtcggcgcaagttttatcggttcggtgatgtacgcgatcatgatggaagcgacgatctccttcctaggcttgggcgatccaaacactatcagctggggcatcatgctctacaacgtacaaacttcatcttcgatgctgatcggcgcttggtgggaactgctggcaccttgtttatctttgactctgctggtcacaggccttgcgctgttgaactttgcggttgacgaaattgctaacccacagttgcgttcacataaaggcatgaagcgttggaaaaaccttgccaagcaagaccaaaaagcgcgtgagccaaacgtaccaccacaaaatgcactttggagcggagataaataatcatgactacgccattaatctcaatccgcaacttatgcgtggactacattaccgatgctggtgacgtccgtgcctgtaacaatgtgagctttgatttagcccccggcgaggtgtttggccttgcgggtgaatccggctgtggtaaatccaccgttgccttctcgctgatgcgcctgcataagccgcccgcgttcatcactggtggcgaggtgatcttcaacggtgaagacatcctgaaatacagtgatgagcgcatgcaagcgttccgttggaaagaaatgtcgatggtatttcaaagtgcgatgaacgcgctgaacccagttctgaccatggaagagcaattttgcgatgtgatcacgcgccataccaatatgacgcgtgaacaagccaaacgtcgtgctgaagggctgttagaaattgtggatattcacccaagccgtcttaacgattatccgcaccagttctcgggtggtatgcgtcaacgcttggtgattgcaattgcgctcgcgctcaatccaaaaatgatcattatggatgaacctacgaccgcgctagatgttgtcgttcagcgtgaaattctgcagaagatctacgcactcaaagaagagtttggtttctctattctgttcattactcatgacttgtcactgatggtcgagttctcagaccgtatcggcatcatgtactccggtgaattgattgaagtggctccttcaaaacaaattctggaaaccccttaccacccttataccaaagggttgggaagttcttttccaccattaactggaccaaaaacaaaactcacagggatccctggaaacccactcaacctgttggacattcctcaaggttgccgtttccaagctcgctgtgaccgagttcatgaagcttgtactaaggtaccgaccgtactgcgccaaatcgagcatggccgcttttctaactgccatctctatacgcaatcgaacgccactataaaacgctaaggcgtacgacaaagcagtagcaaagaatttctggagacaattatgagcaaaccacatggcgaattactggttgagggaaaaaatctggttaaagattttgccatcaacagtaacgcactcaaacaacccatgatgcgtgccatcaacgacgtatcattcaaaatgtacaaaagtcgcggtttatctgtggtgggtgagtctggctcaggcaaatccaccaccgccaagatgatcgccaaaatgtacgcgccgacctctggggttatcgagtacaaaggccgtgatattcaggacatcgtttctcgtgacgacctgatgcattaccgcgaaggcgtacagatggtatggcaagatccgtttggctcactcaacccgacccataccattttccaccacattgctcgcccgctgctgatccacaaaaaggttacgccgggcaacaaaaaagagttggaagagcgtgtttacgaactgcttgaacaagtcggcctcatcccaccaaaagctacggccgcgaaatatccgcaccaactttctggtggtcagcgtcagcgcgttaacttagcacgtaacattgctgttggtgctgaggttgttctggctgatgaacccacttcaatgctcgatgtgtcaatccgtgcaggcgtactcaacctgatggaagagatgaagtttgagcgtcaaatgtctctgctatacatcacgcacgacatcgcgaccgctcgctacatcgctgaagatttagccgttatgtacgtaggacacatggtggaatggggtgataccgatgagatcattcacgatccacagcacccttacaccaagctgttagtctctgcggtacctgatccgaaaaagtcgatccacgaaaaattggaaggcaacaaaggcgagatcccactgtggactccgaattctgtcggctgcccatttgcaggacgctgtttgtacgcttccgcgaaatgtcgcgaagccttgccagaagtcactcagttgtctgacaaccactttgttcgttgttatctgtttgaaaaataaaaccagcagctccctctcgtagggagcttgctcaatccatactgcggagaaaatgaatgctgttactgaccaaccacattggctatgaaacccaaggccctaaacaggcggtgttgctgtgtggacaaacacaactcatggacgattgtgtgcttttggtttgcgctcgtagtcaccaaaccgttgccaagctcgctattgagtggcacggcaaggtcgacaactggcatcagggacaatttcatcgtatcgatttttccgatttcacgacgccaggcgactattatctgcgcctggaacacacgcattctgccacttttactattgcgcgaggcgtattaatgcaacgcacattttctgatgtgctgcactactttaaatcgcaacgctgctctgggcagtttgatcaacaagacaagcaagtaccgctgctgagcacatcaaccactgccgatgtgcacggtggctggtacgacgcttcaggtgacgttagcaagtatctcagtcacctttcttacgctaactatttgaacccacaacaaacacctttggtggtctggaacatgctcaaagggttagcggttttacaacatcactcgggttttgcatcgttttctcgcactcgcctcaaggatgaagcgttgtttggtgctgattttctacgccgtatgcaaaactccgagggatttttttatatgaccgtctttgacaaatggagcaaagacaccaaacaacgggagatttgtgcctacgcgacccaacaaggccataaatccgatgattatcaagcgggttttcgccaaggtgggggcatggcgattgcggcacttgccgcagccgcgcgtttggatacgcacggcgagttcacacaagctgactatttacaagcggcagaaaatggctactggcacctcaaagagcataacctcgcctacctcaatgatggggttgaaaacatcattgatgagtactgcgcactcttggcgtgttgcgaactttaccgcacgacagagaatgaccaatatctggctcaagctcgtgagtgggcacagcgtttagccaagcgccaatgcagcgatgaacaaattgcgcactactggtctgccaccagcaacggtgagcgcccatacttccacgccagtgatgctggtctgcctgtcattgcactttgcgagtatctgaatattgaaacggatacggctaactacgctcaactccaaagagtggtcgagcaagcctgtcaattcgagttagcgataactcaacaagtctccaacccgtttgggtacccgcgtcagtatgtcaaaggggtggaaagcgccaaacgcaccagtttctttatcgcccaagacaacgaaagtggttactggtggcaaggtgaaaatgcccgtctcgcctcgttggcgagcatggcctatcttgctcagcctcatttgagtaccgctatcgctaaaccgcttgaacagtggtcacaaaatgccctgaactggattgtcgggctcaatccttacaacatgtgcatgctcgatggacatgggcacaataatcccgattacttacctcatttaggctttttcaatgccaaaggcggtgtgtgtaacggcataaccgcgggctttgatgacccaagagatatcgcgtttaacccagcagggcaaaaagatgacatgctgcaaaactggcgttggggagaacaatggatcccgcatggcgcttggtatctgcttgccatcatcagccaatttgctcactttaccgctcacggggaggagaaccaatgaactactacgtaggcattgatggcggcggtacatcctgccgtgctcgcattcgtaatcagcaaggtgaatgggttggcgaagccaaaagtggcagcgccaacatcatgctcggtgttgaggtggcgttgcgttccgtagtcgatgcgatcacccaagcggcagagcaaggcgggttatcaccagacgacttccctagtatgcatgtaggtcttgctttggctggtgcggagcaaaaagaggcgtggcacgcttttatgcagcaagcgcaccctttcgcttccatcacgcttaacaccgatgcttatggcgcttgtcttggcgcgcaccttggtgaagagggcgcgatcatgatcgccggaaccggatcgtgtggcattttgctaaaaggtggcaaacagtacgtggttggcggtcgtgagttcccaatctccgatcaaggcagcggcgccgtcatgggcttacgcctgattcaacaagtgctgctcgcacaagatggcatccgtccccataccccgctgtgtgatgtggtgatgaaccactttaaccatgatattgattccattgttgcttggtctaaaaccgctctacctcgcgactatgggcaattttcacctcagattttcagccatgcctattgcggcgatcctctcgcgattgaattactcaaacagaccgccgcagacattgaaatgttcctgatcgccttacaccacaaaggcgcagaacgcatctgtttaatgggcagcattgctgagcgtatccaagattggctctccccaccggtacagcagtggattgtcaaaccgcaatcggatgctatcgaaggtgcattaatgtttgccggtaagcctgagcacaacctgtataaggatggtttatgagttatcgaattgaatttgcggtgctctcggaacaaaaaccggattgccgttttggtttaaccctgcacaatttgagcgatcaagatctgcatgattggtcgctgtattttgtgattgatcgttacatccaacccatgagtgtgaccaacggtcaactgacccaagtcggcagcttatgttcgattgttccaacggaaaaagtgttgcaagctaatggccacttttattgtgagttcatcatcaaaaccgcgccttaccatttctacaccgatggggtaaagcacgcgtttgtccaacttaatgataaacagcctgttgaacgtattaacgtcgcggttaaccctatcgttctcgcgtcaccatttcgcgagcgtagccagatccctgaagtgactgcggctgagctctgtctcatccccaaacctaactcactgcaacgtttccaaggtgagtttgtggtcaaccactccagccagatctcgctgcaatcggactcggccgcgcgtgctgcacgctggttagagcaagaattgcatgcactgcatgagttcaaactgaatacggttggccatagcgatatcgtctaccgcagtaatcccacgctcgatgagggccattaccaactcaatatcgaagcgcaagggatcaagattgaagcaggcagccacagtggctttatgcatgccagcgcgactttgctgcaactggcgcaagcgcatcaaggctcattgcgctttcctctggtcaacattgtcgatgcaccgcgctttaagtatcgcggtatgatgctcgattgcgcccgccattttcactcgcttgagcaggtcaaacgagtgatcaatcaactggcacactacaaatttaacgtgttccactggcatctgactgatgatgaaggttggcgtattgagattaaacgcctgccgcaactgacagacattggtgcatggcgtggcatggatgaagtgctggaacctcagtacagcttactcacggagcgtcatggcggtttctatacccaagatgagatccgtgcagtgattgagtacgccagcgatcgtggcattactgtcatccctgaaattgacgtaccagggcacagccgcgccgcgattaaagcgctgccggcatggctggtcgatgaggaagattgctcgcaatatcgcagtattcagtactacaacgacaacgtgctctcccctgcactgccgggcacttatcaattcctcgacatcgtattggaagaagtggctgcgctgtttccaagccaatttattcatatcggtgccgatgaagtcccacacggtgtgtgggtagatagcccgaaatgccaagccttaatgcaagagcaaggctataccgacccgaaagagctgcaaggccacttactgcgctacgccgagaaaaaactcaagagcttgggtaagcgtatggtcggctgggaagaagctcatcacggcgacaaagtgagtaaagatacggtgatttactcttggctatcggaaaaagccgccttggattgcgccaaacaaggctttgacgtgattttgcagccgggacaatttacctatctcgatatcgttcaagactacgctcctgaagaaccgggcgtggattgggcgggtgttactccgctagagcgtgcttacggttatgaaccgttagccgacgttccggccaatgacccactgcgtaaacgcattttaggtattcaatgcgccttgtggtgtgaattgatcaataactcagaacgcatggaatacatgctctatccacgtctcacggcattagcagaaggcggttggacagagaaatcccagcgtgactggttggattatctagcgcgtttgaaaggccatttaccactgctggataagcagaaaataccttatcgcgcgccttggaagtaattctgccttgaaagtaattcttccggaaatcgtaacgacggcgtgacggaactcacgctggttttcactagcaaaatttttagctgccatagggcagctggtttaaaaggaaagcacaatgaaatacggctatttcgataatgataatcgtgaatacgtcatcactcgccctgacgtacccgcaccttggactaactatctcggtactgaaaaattctgtacggtgatttcacacaacgcagggggttactccttctatcactcacctgagtacaaccgcgtgaccaagtttcgtccaaactttacccaagatcgtcccgggcactatgtttacctgcgcgatgatgcgacaggcgatttctggtctatctcttggcaacccgttgcgaaaagccttgaacaagcgaaatacgaagttcgccacggcttgtcctactcaaaattcaagtgtgaatacaacggcattcacgccaccaaaactctgtttgttcctaaaggcgaagatgccgaagtttgggatgtagtgatcgaaaatacctccaacgaagtgcgcaccatcagtgcgttcaactatgttgagttctctttcagccacatcaagtcagacaaccaaaaccatcagatgtcgctctactctgcgggaacagcgttcaaagatggcgtgattgagtatgacctgtactacaacaccgatgatttcctcggtttctactacctgactgcaactttcgatgccgacagctacgatggccaacgtgaccaattccttggcatgtaccgcgatgaagccaacccaatcgccgtggcgcaaggtaagtgctctaacagtgcgcaaacctgttacaaccactgtggtgcactgcataagcaattcgtgctgcaaccgggcgagaaagtgcgctttgcggtgatcttaggtgtaggtaaaggcaacggcgcaaaactgcgtgaaaaataccaagacctgagcaaagtggattcggcctttgcaggtatcaaagcacactgggatgagcgttgtgcgaaattccaagtgaaatcacccaaccaaggtctcgataccatgatcaacgcttggactctgtaccaagcggaaacgtgtgtggtgtggtcccgtttcgcctctttcattgaagtcggcggccgtacaggtcttggctaccgtgatactgcgcaagatgcgatctccgtaccacacactaacccagcgatgactcgtaagcgcctcgttgacctactgcgtggtcaagtgaaagccggttacggtctgcacctgtttgatcctgactggttcgatccagaaaaagcggatgttaaaccgtctaaatcaccgacagtggtaccaaccccatcggatgaagataagatccacggcattaaagatacctgttctgacgatcacctgtggattgtgccaaccatcctcaactatgtgaaagagaccggtgacttcgcctttatcgacgaagtgatcccttacgcggatggcggcaacgccactgtgtacgagcacatgatggcagcgctagatttctctgcagaatatgtgggtcaaaccggtatctgtaagggtctgcgtgccgactggaacgactgtttgaacctcggtggtggtgagtcctctatggtctctttcctacacttctgggcgttggaatctttccttgaactgtcacgctatcgcaatgatgaagcggcaaccgacaagtaccaagcgatggccgatggtgtacgcgaagcgtgtgaaactcacttgtgggatgaacaaggcgaatggtacatccgtggcctgaccaaaaatggcgacaagatcggaaccttcgaacaagtggaaggcaaagtgcatttagagtctaactcgcttgcagtgttgtctggcacggttagccatgaacgcggcatcaaagcaatggatgcggtctacaaatacctgttctccaaatacggtctacacctgaacgctccatcatttgccacgccaaatgatgacatcggtttcgtgactcgcgtttaccaaggcgtgaaagagaacggcgcgatcttctcgcatccaaacccatgggcatgggtagccgaagcgaaactgggccgtggtgatcgtgcgatggagctgtatgacgcactcaacccatacaaccaaaacgacatcatcgaaacccgtattgctgaaccttactcttacgtacagttcatcatggggcgtgaccaccaagatcacggccgcgctaaccacccatggttaaccggtacttctggctgggcataccatgcgaccaccaactatatcttgggtatcaaagcgggcttcgatgcactggagatcgatccttgtatcccaacgtcatggccgggttttgaagtgactcgcgaatggcgtgatgcgacttatcagatcaaagtggaaaacccgcaaggcgtttcaaaaggcgtgaaatccatcaccctgaatggtcaagcgattgaaggtgccgttcctgtgcaagccgcaggcagcgttaaccaagtcgtggttgttctaggttaatccattttcgggcactcgctgagtgcccgtttgctaatacctaagcgttttatatgcccagaccacttgtcgttgcaaccaagactcttgcagcgtcagtagaaaagggatagggggagaaaatgattaaatttggtactggcggctggcgtgcgtttattggtgaagaattcactaaagataatgtgcgcttggtggctcaagcgttagccaacatcatccatcatgaacaagccgcaaacgaaggcttcgtaattggttacgaccgccgttttctgtcagacaaagcgggacgctggtttgccgaagtgttagccgcgaatggcgttgtggtgagctttatcgacaagtttgtgccaacaccggtggtaatgtttaaagccaaagcgatggattgtgcttactcagcctgtattaccgcctcgcacaacccggccgactacaacggcatcaaagtgtttattcgtggtggccgtgatgcagatgaagtgatcactcagaagatcgagcagcaaattgccacactgactttacaagacgtgaaatcgatcgactttgatcaagccgtcaacgacaaactgatcgacatcatcaacccgatgaacgagttcgtcgacagcatcatcaacttcatcgatattgaagcgatcaaaaaagccaatctgcgagtgttgatcgacccgatgttcggggtggcgaaaaacgcgctgcaaacggtactgatcaatggccgctgcgacgtggacgtgatcaacgatggcaaaaaccctgatttcggtggtttgatgccttcgcctagcgctgccaccttgtatcgcttgaagcatctggtgaaacacgaaggttatgacatcggtatcggcaccgatggcgatgcggaccgccttggcatcatcgatgaaaaaggcaactttattcacccgaacgaagtgctgatcctgctttactactacctgctggagtacaaaggctggaaaggttctgtggtgcgtaacatcgcaaccacacatctgttggataagatcgccgccgatcatggtgagcggtgctttgaagtgcctgtgggctttaaacacatctcttcacaaatggaagcggacgactctctgattggcggggagagctctggcggcctcacgattcgtggtcacatcaaggggaaagatggcgtgttcgcttctagcctattggtggaaatgatcagcgtgacgggcaagaaactctctgagctgttaaccgagatctatgatcgttacggctatgcctacactgcggaaggcgattgcaaatttaagcccgctcagcgtgatgagatctacaacaaggtctacattgagaaaaaactgcctgagtttgaattcgacatcgataaagtcagctatgaagatggggcgaaagtctacttcaagaacggtggctgggtaattgcccgattctccggtactgaacctttattacgtattttcgccgaaatggccgacaaagatactgcggagcgtgttcttcaacagatgaaagctttcttggcgttgtaatcatcgccttgtcaaatcatcccctgaggttaagtcccctcagcggagaagaacacttgcccgacgctcgacgtcgggcttttttatgcaggtaacatagtttggcaatccaagacgcttggtgagagttaatttgccatactaattgcggcaatcgcatgaggcgttttattattccatacacataacttttcgactttagcttcagtaagatatgcaatcctcagggtatccttcatcctttcaatcgcttttttttgtgaatctatatgttgactacctggtacttctacttgaaaagttgcaccattcttaaaagtaatgatagccatctctctttttccagctagagattctgtatacgaaaatatcttatcatttagcgtatgtatttgtgtgttgtggtattctgcacacaaatcagtaatattttgaggtgttccatttgcatatgctgaagatagtaaaactgtaaaaaaaacaccaaattttaatttaatcatggacgtcctcctattcagccgtacccgatttagcaatcgtacctaagttttcgatcacttcatcacgggtcataccgatcccgttatccgaaatggtcaacgtatttttgtctttatcaaaagagagttttacgcctaattcagcgtcgccctgatagagatcaggatgagaaagcgcttgaaaacgcaacttatcaacggcatcggaggcgttagaaatcaactcacgcaggaaaatttctttgttggagtacaaagagtgaatcatcaggtgcagcagttgtttaacttccgattgaaaaccacgcgtttctttattagtggttgcagtctcgctcataatcgctccgtttacttctgtttcaaacaattgatccattgagactcaatggaattaccttgatgtacaagtgagatatggacaaaaaatgtaaattcaaggtcaaaactactcataaaaacactgttttttgatcgagattggattattctaagtctgcatttttatcaaagaagataaaaaaaccagtaaagtctgagtgttgggacagggagatactgggacattagatgttcggattaggacacaactcaaaagagatggcgaaagcgagcacgccttgggtatcaatattgaccgagactgcctgccctaactccagcggttgcgaagaggtcgcgataagctgagtgccatgcgcatcaatcagataacggcaatgatcgcccataaactgctgctccgtgaccgtcacactgctctcctcttccgcgcgaatttgcacctgttgtggacgcagcagtaacttacactccgcctctaccgcgatcggttggcgcgcaatcgcttcgaccaccccaagcgccgtttggtactgagtttcactgatccgcttggcgcttaaataactgcccccgcccagaaaatcggctacaaactgactcgatggttggtagtaaagctctgcggcggtgccgtattgttcaatcacaccacgattcatcaccgccattttatcagcgaaggcaaacgcttcttcgcgcgaatgagtgacgaaaatcgccgtgactccctgctgtttaaagatcttacgaatctcaatgatcagctcatggcgcacttgagtatcgatattggaaaacggctcatcaagcagtaacagatcgggcttatacgctaaggcacgagcaatggcgacacgctgctgctgaccacccgacagttggtgcggataacgctctgcgaaagcgtcaagatgaaccagagccagcatctcggcaattttggcctccttttgcttcgcgggcatcgcatctaacccaaaaccaacgttttgcgccacggtaagatggggaaacaatgcgtaatcttggaaaatcattccgatattgcgctgctcagggggcaaccagcgtttaccgtcatccaaggtgacacagttaaggctaagctgaccagaagccaaaggcagcaagccggcaatcgctttcagcaaggtggttttaccacaaccacttgcgccaagcagacagacaatttcgcccggattgacttgcaaagagagagatttcaatacggtttgtgcatcgtattggcaagtgagattttcaatcagcagtgcgcagctcattagtgcttttgctccaaagaacggttaaccataacaagaggaataagcccgaccaacaccagtaaaatggcgggtagcgccgccaactctaagcgctcatctgaagcgtagttatagacgtaagtagcgagagtttcaaagttaaatgggcgcagcaaaatcgccgcgttcaattccttcatcgattcgataaacaccaacaagcctgcgattaatgcgccgcggcggatcagtggcaaatgtacacgcttgagcatttgattggcatgacaacccatggtgcgcgccgccatatccaacgaaggtgatactttactgaggctactttcgatgctgccaatcgctaccgccgagaaacgcaccaccagcgcgaacacaatcgcaaataaactgccggagaaaacaagccctgggcgtccccactccatcattttagcgatatcgttgatcagatgatccagtgcgagcacaggtactaaaataccaatagccagaacggttcccggcaccgcatagcccatcgaagagaggcgcatcaaggcaacacttgtacgattattttgtaaacgggcataaaagttagccactaaagccactaagaccgctacgacagcagcactgatcgagacagtgaaactgttgatcgcgtactctttaaattgggtggtccagctctgggcaaaataggtccacgcgtaactgataagttgtagcagaggcagaataaacgccaccgccactaagccccagcaccagattaaagcggcccataagcgccagccttttaaggtataacgatactcttcatggctattaaattgggtttgatacagtttttgtcggcgacgactataacgctcactactgagcagcagcagcaccatcaccagcataatggccgagatttttgcagccgcattgagattggaataaccgagccaagtatcgtaaaccgctgtggttaaggtattcaccgcaaacaggcttaccgtgccgaaatcaccaatcgtttccatggccaccaaagacaaacccaccgcaatcgcaggtcgtgctaacggcagagaaatacgtcgaaaactttgccacggtgaacatttcagtaagcgcgcagactgaagcaaagtgacattttgctccataaacgccgcacggcacaaaagatacacataaggataaagtaccagcgccagcaccacactcgcaccgcctaggctacggatatcgggaaaccagtagctgcccgcttgccaaccggtccaatcgcgcaaggcaatttggatgggacctgcgtaatcaaaccaatgggtaaataaatacccaatgatataagcaggcatcgccaaagggaggacaagcgcccattgcagccaacgctcaccgggcagtttgcacatggcaatcagccaagctgacggtaccccaaacagtaaagccaagagcaataccgagcaggttaataccaaggtattgaaaatataggtgggcatcacagtcgccagaagatgagcaaaaacctcatcactgttgccgaatgcggtatagaagatcgctaagatcggtaaaaccagcagagtggttaacactaggctgctggctttccaggcaaaatatttttctttcatcgcctatcagtataaggcttgaacagcaagcagatactgcatccctcaaataaaataggggtacgttatacccctgattttacttacaggtcaaatttgacttcatcgatcaatttgatcgctgcagcattgttatctgcaattttttccagtggcagactgtcggctttaaactcgccccaagactccaccaatgcagaacgttgtacacccggtttgactgggtattcgtagttcacttctgcatacattttctgagccgtttcaccagtcaaaaactccatcagtttctgcgcgttttcacggttaggtgagtatttagccatcgccataccactcacgttaacgtgtgttccttgcacattttgacctgggaagttgatgtacaccgcttcagcccaagatttctgctcttgatcattcagcatggcgcctaggtagtagctgttacccaatgagacatcacacagaccttctttgatcgcgcgaacttggtcacgatcgttgccttgcggtttgcgtgctaggttcgctttaacgccttctagccaagcttttgcttcagcttcaccgtggttagcaatgatggaagcaactaatgcgatgttgtaaggatgcttaccactacgagtacagattttgcctttgaactcaggctttgccagatccatatagtcaaaatcatcaccgagcttacctaggcggtcacgtgaagaatagacactgcgagtacgctgagtcagggcaaaccactcatcgccactgtcacgatactgagccggaatgttctcttcaatcactttgctatccagcggctgagtcaaacctttttcggtcagctcaaacagacgactgaattcagaggttaagatcacatctgctgggctgtattcgccttcttgagcaagcttttcagcgataccttctttcgcgaactttacgttaactttaatgccagtttctttcgtaaattcagcaaacatcggctcaatcagaaacggttggcgataagagtaaacattgacttcttgagcggcaaaagcagaaggggcaagcacactgagcgttatcgctgacaggctgagcagttttttcattgagtattccttttgactagtaatgataacctttatcaatcgcaatgtattataggaatgttcaataagaaaacaattggcaaaaaaacaaaacccgcctttacggcaggttttgttcggttcaatttgtaaaatgatatttcacttaacagtaacaaactctgggtaagcaccgacaccacaatcgtgcatgtccatcccttccatctcttcttcttcagagacgcggatccccatcgtcgctttaagcacgccccaaaccaccagacttgcaccaaacacccatgcgaagatcaccgcagcaccgagtaattgtgcgccaaaggttgcatcagcgttgctcagtggtaccaccatcagaccaaagaaaccacacacgccatggacggaaatcgcacccactggatcatcaattttcagcttatcgagaccaataatgctaaacaccaccagagagccagatactgcgccaatcgctaccgaataaagcggtgaaggagagagaggatcggccgtaatcgctactaagcccgctaatgcaccgttcagtaccatggtgagatccgctttaccccaagtggttttacacactaaaagcgcagcgatagcccctgccgccgcagccgcattggtattgaggaaaattttgcccacagacgtcgcattttcaaaatccgacaccatcaactgtgagccgccgttaaagccaaaccagccgaaccacagaataaacgtaccgagtgtggccaatggcatgttggaaccgggaattggataaatttcgccgtttttgccgtatttgcctttacgagccccgagcagaagaacgcctgctaatgccgctgaagctcccgctaaatgcacaatgccggaacctgcgaaatcactaaatcctgccgctgaaaggaagccaccgccccaagtccagtaaccttcaacgggatagatgaacgcggtcaatactgcggagaaaatcaaaaatgcccagagtttcatccgttccgcgacggcaccagagacgacagacatcgcggtcgccacaaacaccacttggaagaagaagtccgattcgagcgagtggtcagcaccatcggcctgtgagccaatcagcgcaccaaacgaaggcaaccagccaccttccgtgttatcgacatacatgatgttgtagccgacgatcaaataggtggtacaagcaatcgcatacagaacaaagtttttcgtcaaaatttcggtggtgttcttggagcgaaccaaacccgcttccaacatagcgaaacctgccgccatccacatgacgagcgctcctgagatcaggaagaaaaatgtatcgagtgcgtaacgcagctcagtaactgtgattgatagttccataatcaaatctcatccttgaatttaaagggcttctgaatccatttcgccagtacggatacgtaccgcttggcttaggtcatacacaaaaattttgccatcaccgatttttccggtgtgtgccgccttaatgatcgcttcaactacgcgatcgacattgtcgctttgagtcgcaatttcaattttgactttagggagaaaatcgacctgatactcagcacctcggtacagttcagtgtgtcctttttgacgtccaaagcctttcacttcagacaccgtcatcccctcaatcccaacatccgccagcgcttcgcgaacatcatccaatttgaatggtttaatgattgcgttgatcagtttcatctcttcctctctgaagcagtcgtccatttactcttcattatccaaggggcgtgccaactttttaacttaatgatttttatggatatataggcatttgctgagtaaaaaaacaaaaggctgcaccgattcggtgcagccttttcccaacaataacgcacaacgtatgagcaggatggattagaacctaccctgattttgaataaagctttgccactgcgtcagtaaggccacaaagtcttctcgcccacaggcggcaatactttcgctgtcatagagagcaaaatcggtttccaattcatgctcactctcataagccagcgcattctcttgtactgtgatttcatcgccttgcaccagtaatgagatttcacgtcccgtccataaaaactcttgggctggtgattgttctgccttatcgatcagcgttaatacgtgtttaagtttggctaggtcttggccaatctcttcttgtagccatcgtccgacgatttggtgctccatattgcatcgcaccgcatactcaccgagcagggtatttttaataaattcaaattccatggtgaacactccaccgatccacaatggcgcgagtatatcgcaaaccccttcacgatacttagacaagtgatgacccgcgaagtaaaccgaccgaaaaatacccacaataaagccgcgacaagcgcggctttaaaagaggattcaatcactctgcttatgcaggttcttggaaaatgaccgaatctgctttactggtgtactgacccatacggtggaagttgaggtaacggtaggtatccgcggccgccgcatcaatctgcttcgcgtaatccatgtactccgctacgcttgggattcgacccaaaatcgctcccactgccgctaattcagcagaagagaggtaaacgttagcccctgtgcccaaacggttcgggaagttacgcgttgaagtcgacatcacggttgctttgtccgctacgcgtgcttggttacccatacacaacgaacatcccggcgtttcgatacgcacgccagcacgaccgaaaataccgtagtaaccctcttcaatcagctggtcacgatccatcttggttggcggtgcgacccacaaacgggtattcaattggccattgaatttttcaagcaatttacccgccgcgcggaagtgcccgatgttggtcatacaagagccgatgaacacttcattgatggtttcacccgcacactcagaaagcagacgagcatcgtctggatcgtttggcgcacataggattggctctttgatctcagcaagatcaatctcaatcacatgcgcgtactgggcatctttgtccgcttccatcagtgttgggttagctaaccaagcttccatcgcttgaatacggcgctcaatagtacggcgatcgccataaccttcagcaatcatccacttcaacatcacgatattcgagttgaggtactcttcaatcgatgcttgtgacagtttcaccgtacaacccgccgcagaacgttctgcggatgcatcagaaagctcaaacgcctgctcaaccgtcaggtgttcaaccccttcgatctctaggatacgaccggagaattcgttgatcttacctgctttttctactgtgagcagaccttgcttgatgccgtaataagggatggcatgcaccagatcacgcaacgtgatccccggttgcatcttacccttaaagcgcaccagaaccgattcaggcatatccagtggcattaccccagtcgcggcagcaaacgccaccagaccagaacctgctgggaaagaaatacccaatgggaaacgagtatgcgagtcaccaccagtaccgactgtatctggcagtagcatgcggtttaaccatgagtggataacaccatcgcccggacgcagtgaaacaccgccacggttcatgatgaaatcaggtaatgtgtggtgagtctgcacatcgacaggctttggataagccgaggtatgacagaaagactgcatcactaaatcggcagagaaaccaagacaggccaaatctttcaattcatcacgcgtcattgggccagtggtatcttgcgaaccgacagtcgtcatcttaggttcacagtaagtgcctgggcgaatgccttgtacaccacacgctttacccaccattttctgagccagcgtataacctttaccgctatctgcaaccgccacagggcgacgaaactcttttgacgcttccagacctaatgcgtgacgcgctttatccgtcaggccacgtccaacgatcagcggaatacgaccacccgcacgcacttcatcgtacaggacatcggttttcagtttgaaagtcgcaagcacttcgcccgtcgcgtgattacacactttgccttcaaatgggtaaacgtcgatcacatcgcccatattgagcttagagacatccacttcgatcggcagcgcgccagcatcttccatggtgttaaagaagattggagcgattttaccgccaagcacatatccgcccgtgcgcttattaggcacattaggaatatcgtctcccataaaccacaacactgagttggttgccgatttacgtgatgaaccggtaccgaccacatcccccacgtaaaccagttggtgacctttggctttaagtgcttcgatctgtttgatcgggccaactttacccggtacatccggctcaatgccatcgcgcgcgtttttcagcatggctaatgcgtgtacaggaatatcaggacgtgaccatgcatcaggcgctggagagagatcgtccgtgttggtctcccccgtcactttaaatacggttaaggtcactttttcaggcagtgccggcttagataggaaccactctgcatcagcccaagattgcagcacttgtttcgcaaatgggttgcccgctttggctttttcttccacatcgtagaagttatcaaacatcaagagggtatgagacagcgctttcgcggcaatcggagccagcgcgctatcgtccagtaattcaatcagcggttcgatgttgtagccgccttgcatggtaccgagtagctcagccgctttttcacgactcaccaacggagatgcgacctcgcctctcgcaacggccgtcaagaaacctgctttcacgtaagccgcttcatcgacacccggaggaatgcgattttcaagtaggtcaagaatgaaagcttcttcaccttgtgggggatttttcagaagttcgacaagtcctgcgacttgctctgcgtctaggggtttaggtacaactccttcagcggcacgctctgcgacgtgtttacggtaggcttcaagcacgactttttcctctcattgcggttcacccagttgattataaaaatacgagcgaacatccttggaaacttggctctccctagcccttgttttcactcaaattgactgagaaacagcgccatagaggccaaactgtgggcgtcagaatagcaagtttaacgataaattaaaatctcatcattttgaccaacatagcaacttgagactaaagttttagctttctcactgagtgaaaagcgcgcaaaccccacccatctcaagctctcgctatttaaatgtggtaccaataatgaaatagatcgagtcataattctgctcggtgcgaccatagccaaacataatcggcccaatcggcgaattgaccccagcgaagatcgaacctgcgccatacaaaggcgcatcttgcaaacgcaaatcgggatcagaccagacgccaccgtattcaatcgatgcccctaagtagacgggggacgtgaacataccaaagtcattatcaaaccagcggtaacggtaaacgaggtttccatacagcttgttttgaccaatcaagctattgcgggggatgcccgacaagttgagaaaaccaccgatgcttttcggatcaatcggggtagatgagtgtttacttttcaccacccccatatccaagtttgcgactaaagtatggcgtgaaaaggtgtgcgcagcgatcaatcgcccagacagctccgatacggtatcggaagagagggcatctccagaaaggggattgctaccgtcaaaactgtctttagagatcagatattccaagtcaaaatagatgccttgctgaggtaagctaaagtcatccaaggtgtcgtgtcgataatcaaaaaacaccccgcgacgctggaaggaaaaatccccaaaaaccggtaatgaagaagcttcgccattgcctttgctgtagcgtgcaccgagtttcatttctcgccataactcgatttgatagccgagcgccagttcggcaacccattcggaataagtgacgggtaagtaattctccgtagccgcgagagaggtgtcatcaaagcctgccaaaggcgcatttcgccgctcgttactgaaatgcagcagtgccgtcgtaaatgttttttgtcccgataacagtggcgaataaagctcagcttcgatcagcttgtcggtccccatatccatattcagagccagctcagcaccgtgtgagttgatgtctgtaaaattggtggaaacgccaagggcatactgactttccgtatcaaaatcatcttctaaaaagaagcggaaattgacgtaattgggcccccaagacttttcacgcacatcgaccaccagttgttgttggtcatcgcgttgttcgtattgataacgcaccaattcgaagcgatctagggcatagagatcttctatgctggcttcaatctcttcggtgctgagcttttgcgcgggttctaaattgagtcggttcagtaatagcagatcgctgtagtgggtgttgttttgcagaacaatttcgtccacctgaacattatcaccatagcgcaaggttttacgccgctcttctttctcatccacatacacttgatattgcgctgaactcagagcaatgttcttgaaaaaagcctgattatccatcgcttcttggtagcccatcgcaaacgccgccggcattttgtcgaactccatggtctccattttgcccacgggtggacgcagcagcagatcgcgcgaggtcaaatgatcgctctgtctttccgtgctgcggcgaaccaaatagttcgaaagctggtctgcaaccgtaaagagattggtgaagtcctcttggcttttgtagtcggtgctgatgtcgaccgcgatgataatatcggcccccatcgcacgcgcgacctcaacgggcatgttattggtgacaccaccatccaccagccataacccatcaatttcataaggtggcaacgcgccgggtactgacatgctggccatcatggcatccaccaaaaagcctttatcaagcacgacttcttgaaggtgaataatgtcggtcgctaccgcgcgatacgggatcaccaattgatcaaaagaatcgaaggcgggaagattgcctgtggtttcacgcaacatgcgcagcatgttttgtccttgcactacgccttttggcgcgcgcacttccccccagtgtaggccaagatctgtggtgatttggtagcgatcttcatactctttgtcacgaactcggcgctggctacgatcgacacgatctcgatagcctcggttccaatccacgctataaatcagcgcttcaatctcctctgcgctcattcctgttgcgtataacccacccacataagcacccatactggtacctgtgatgatatcgacggggacgtgcatctcttccaaggctcgcaaaacccccatgtgcgcggcgcctttggcaccgccccccgccagaactaacgcgattttaggtcgtttggcgacttgagcttgagcttcttgtgccaaggccaatggggcaaacactatccctacgactacgctgaatgataccgcccatttcatcacgtgagttatcctcgaaatccttaagaatcagaccaatatatacccaaactatggggagttacaggcagacggcaagtgagcacatccaaagcgcatagacagtcgctatgattggagtgaagaaacctcgccaacacggctgccgcagcaagtagcaagaaaagagaaaactatgcccacacaagcaaggcagacgttgtcgtcaatgcaacgacaacgccgcgcccaagagggtgttaccactcaaacagctttttgatccactcggtcggacggttttcacactgctgttttaactgctgttgattgtcccaaataggcagtttaaacgcattatcacagtcgagtttcaatccaccttgcgtctgcttggcaaagccgaaggtcgttatgccttctggccaaggtaactgtaatttctctggaatgcgatatttcaaatactgcgcataaacacgtaatgccccactcgcgccagtgagcttcgttggctggttatcatcgcggccaagccaaatggtggtcacttcacggccatcgacccccacaaaccaactgtcacggttatcgttagtggtcccggttttccccgccagtgctgcactgctgaactgcgcattcaagtaacgtccagtcccctcttgcaccccttgtttcatcgcgtaagtcgtcagccaagcggcttgctgatccaccgcttgtgacactctcggcagagattcatacagcacattgccttccaaatcgagcacagaacgtagcgctgacagcggggcttttttgccggaattggtcaacgtttgatacatctgcgccacttgatatggcgtgagtgagaatgaaccgagcaacatcgaagggacagggcgaatttcgtcgcgattcacgccgagcttacccaaggttgctgagacttgatcaatcccaagcttcatccccaaagccacggtcggcacattaagcgattgagcgagcgccaaataaaggggcacctctccacgatattgacgatcgtagtttcgcggagtccacgcgctgccttcactgccttttaaggtgagtggtttatcttccagtgtagtggctaggttgtactgatcgggatgcgctaacgccgtgagatacaccgctggtttcaccagtgaaccaatttgtcgactggcattgagcacgcggttaaaaccatcgtaaccggttcgcttaccgccgaccatggcacgaatttcgccactatgacgatccacagcgatcgcagcggcttcgagatctttgcctgcggttttcgctaattgcgggatctgatcgtggatcgcttgctcgagtttggactgcgaaaccggatcgagcgaggtaaacacccgcaatcctgaatccgctttaaatttgtcgcccagtttttctttcagctcaatagaaacttgctggaaatacgctggctgacggctagcgatttgcgcggttttctgcacatccaacggacgagttaccgcttgctggtactctggcgccgtcagaatatcgtgctccatcatcagtttcagcaccagatcgcgccgctcgcgagcgcgctcggcataacgcatcgggttgtaataagaaggccctttaaccatgccaaccaacaatgccaattgatcaatccgtagctcttgcagcggctgaccaaaatagagccgtgaagccagaccaaaaccgtggatcgcatctgcgccactttgccctaaataaacttcgttaagataggcttcaagaatacgatctttgctgtaacgataatcgatgatcagcgccatataggcttcgcgcagcttacgccacaaggtgcgatcgctagaaaggaagatgtttttagccagctgctgggtcaaggtactgcccccttgcaccgtgcgccccgctttaaggttgaccaccatagcgcgaccaatcgcaagtggtgatacgccatcgtgctgataaaaatcacgatcttcggtgactaagagtgcatcaaccaacacttcggggaattgatcgcgacgtaaaaagagtcgctgctccggcgaatctttttccagcatgcccatcagttttggctctaaacgcaggtagcctagctcgcgtttttgctctaatgattcgattttgttcaaaccactgccatcaaaggtaagcatcactcggcgatccggctctggaccatccgcgaattcaaacggacggcggatcagctcaattcgactggaagaagacgcgtattcaccggggaaacggggctgtgccactttgcggtaattgaggacatccagctcattgcgcagttcttgcaaactgaggccgttgccgggctcaagcgttaaaatacgggcatagaccacggtcggcagatcaaacagctgaccttcaaagcgctgtttgatcatcgaatcgagatagataccaataaaaaccagcactgcggccagcgtcagcgctaatttccagccgatactccaaatccttcccagccagatttgcagcttggaggaagaggcacttttaccactgcgcgctttacggccacgcgatctgttactactttttctcgtcatgcgttcaattgtcgtttggttttactggttgccacatgattggcaggatcatccggccacacgtgtttcgggtagcggcctttcatctctttttgcacttctttgtacgcgcccgcccaaaaactggcgagatcgcgggtaacttgcaacggtcgctgcgcgggggaaagcagttccatcaccacggcgcgcgtccctttggcaacgcgtggcgaactttgctcgccaaacacttcctgcatgcgcaccgagagcgtaggctccatccctaactgataacggatttttttatgattccccgttggcagcagatgatgggttggcagccactcgtcaagctgctgactgagctcccagccaagatagtgcttcagcgcttgcaacacggagacactctgcaaacctttcactgaggtcaccccagccaaataaggctctaaccacagttcgaggcgcgccagtagcgtttcatcgtccaaggctggccacgcttcttctggcagccattcggcagcgcagcgtgcacgggcaagccactcgctcgcgtcttcgctccactgtaacactgttaagcctttgcgccgtacatagctcagcaaagcttgtgtcattttttgtttatcgggttctggcagcttttcacgacgaagcaccaattgatcgattcgccactgcgcttccgcgctcaagcggccggctttttcatcccaatccacttgttcaacccgagaaatcagcgctggtaatacgcgttcaagcgcgtggatatccagctcaagggcactgaatatttgactggcttgagtttggccgcgcatcaaatccaaggcgaccagataatcggcggcggacaaacgatcttccaccgccagccaagcgccatggccattggcgagtaaaaattgccctgtttgttggccgcgctgctgggcgatccgatctggaaaggccaaacacgccactaaaggcagccatgctgaatcaaccgaggaaagtgaaaatgccgtatcgagtttgtgcgccaaagattgggcgcgttggatcagcagtttttgtttgggatgacgaccttgctgccagcggtgcaagctatgttgtacatcaatcacttgccgttccggctcttcaagtaacaccgtcaacgctaaagcgctttgcaaggccgactcacctaagcgatcggcgctcagcagcatcgcagcaatccgcggctcaacgcccagcaaatgtgcctctttaccggccgcagtgatttgcgtgcgtgcatccaaaagcccaagacgctgcaacaattgctgcgcctgcgcaaacgcactgctcggtggcaaattcaaccaagccaaatcgctcggctgcgcgccccattgcgcgagttctaatgccagtggcgctaagtcagtatgtagcatttcgggctccggcacccaaggctgctgcttaagctgcgcttcgctgtataagcgcacgcaaatccccggctctaaacgtccggcacgccctgcgcgctgctcggcagaggattgagcaatccgcacttgttcaaggcgagtaatgccggttttgagatcaaaacgcgcactgcgctcaagcccactatcaagcactatgcgaatgccttcgatggtcagcgaagtttcagcaatattggtcgccaagaccactttgcgccgccccgccgccgtgggagcaattgcgcgctgctgcgcggcgaactccatctgtccatacaaagggcagatttcaacctcgctagccaaatcgcttaactgttcggttaactggttgatgctggcggcaccgggcaaaaaggccagcaatgagcccgtttcgtgctgcagaagatgacgaatttgtcgctgcatcgccgtcaccaaaggctcatcagagcgcagaggttgatagcgaatctctatcgggaaaccgcgcccttgtgattcgacataactcgcttgcggcagtaagttttgcaaagcttgctgatcgagtgtggccgacatcaccacgatttttaaatcttcccgcagcgcagactgcacttcgagcgccaacgccaaggcagtatcagcgtgaatgctgcgctcatgaaactcatcgaaaatcagcacatctacgccatccagttccggatcgttttgtagcatgcgcgtcataatgccttccgtcacaatctccaactgagtggcacggctgactcggttttcaccgcgcacccgataccctacacgctgcccaacctcttcccccagttgctgcgccaaatagcgggcaatgttacgcgcagccaaacgccgtggctccagcataatgattttgccgtggaaccctcccgcttgcagtaactgcaacggaaagtaggtggacttaccggcaccgggcgcggctttgaggatgagttgtggagagttggtgataccggacaacagcttcggcatcacctcaataatgggcagtggtgacaagggcgcttcctacaaggttaaatggccgcgccattgtacataaaacggagtccgtgcccaaagtgcattcctatcaagaggcgcagcagacaaaaaacttactgtggtgctctctcttccggttgagcaaccaaaggtgcctcaagcgtgggttcagaaatcgctggcacagcactctcgctctcttgtggctcaagctctaccgcacttgaaagcggctcagttgcaacctctgtgggtatgttttccatgctcggcagcacaggctcatcgctaagatggggagagataacactgggctccaccacggcttcagcaggaacaacttcggttgctgccgtgagcttagacttcatccaagcattcaaagctaatgcctgatcatccgttaaaatgccgttatggccagcaatcacaccatcggccacagcaagtacccacacagcctgacggttggcatcttcgcaactttgtacggttttgcgggcgtgcaatctggcgcgaattttccagccagccccttgcaatacctgcatgcaaccgggtttcgcatcgtgctcaagcagccactgagggattttgaccactttattacaatcacgccccgagcacgggtccacatcatgagtgattgcccaagagttacccacggcgcgctcgccatctttgatccagttaaaggcctcacgtaccgcaaaatcggttttggactgcaacaccagcatggatggaccaaaaccttctggactcaaccacttatccagcggctgatactctttggcagaggcagcggggtttaaaagcaccgttaaatgggtttcaccgcgacctgccgccagattatccaacatcgcctgtttgcgggcgtgcagcgcaaccacaccacccaagctgtgcccaactaaaatatagcgccctagcgttccttgacgatgcaattcatccagcgaactcagcagctttctcaccccatgctcgccaactcttcgcgccacctgcttgctggttaatatggtcggaaaatccaatgcttcaactcgactttcaggatcgtctgaaccatccaaccacaagggatcgtactgatccccccgccaaccgatatacagcccgatgaggccaggattggtcttcgccatctggcgatgaaaacgttgaaaagcgacaaaattatcgtcagtgggagccgcattatggtgccaaccgtgaataaaaatcagcagttctgctccagggtttttggctaacctcgccttcaacatgtcgtattgcccaggcaggtgcatttcaccctcatcattaaattcaatgacatggaaatcagaccgactcaactcaggcgtgacttgatgatagggcatatcgggaatacgggtagaccaaattgacaacgcgagaacagccagcaatacaaccttaaacatggctatatttttcaaaaacttacgcaaggaatcttaccaaaaaacagatacccagactcgggcgggcggccattatatgttcaacttcaatgcttcaccagaggctgaatgagggactttctcacctgccgctaacctctcgatggcatcaacctttaacagcttgaaacaccatggctaccgcttccaataggaaggggattgcgattgtgacaaaagccactagggtatgtttaaatgccttcgccattggctatgaataagaagagaaacatgcacttttccccacctctacaaaaaggaaccttactcaaacgttacaaacgctttttggccgatgtcacgctggaagatggttcggtgatcaccatgcattgtgcgaacacaggcgccatgactggctgcgccgagccgggcagtacggtgtggttttctacatcggataatcccaaacgcaaatacgcccacagttgggaactgacgcagacccaagcaggtcactggatttgcgtgaataccgcgcgagccaacgcattggtggtcgaagcgattttggcaggagagatcccacaactgcggggttatgacgcactcagtacggaggtgaagtacggtcatgaaaatagccgtatcgatatcttgctaaagtcagattctcaaccacactgctttatagaagtaaaaagcgtcactcttttggatgagattcaaggcgataaagggcaaggttactttcctgatgcggtgacaacccgtggtcagaagcatctgcgtgagctggcggaagtcgctaaagatggaagcaggtcgatacttttatttgccgttttgcattcagggattgaaaaagtcgctcccgctctccatatagacgcgaactattcacagttactaaaagcggcacaagaagccggagtggaagtgttgtgctacaaagcgtcactttcaaaacacgagatccgaatggtatctgaggtcaaatttgcccatcaagtgacaaaaaattgatggtgtcttcacattgacgataactttaccttcgattgtttgcctcccccacttctttttgctatagatacccgccttaaatttaactgctctcgcagttgactagggttagtaggagatctgtatgacagagtctaaaaagaaaacgctaggcatcctagccattgctggtgttgagccatatcaggagaagccgggtgaagagtatatgtcacctgggcaaatcacacattttacaaagattttggaagcgtggcgcaaccaactgagagaagaagtggaccgtactgttcaccacatgcaggatgaagcagccaacttcccagaccctgttgaccgagcttctcaagaagaagagttcagcttagaactgcgtaaccgtgaccgcgagcgccgtttgatcaagaaaatcgaaaagaccctcgacaagatcaaagaggaggatttcggttactgtgaatcgtgcggtgtggaaatcggtattcgccgtttagaagcgcgcccaacagccgatctctgtatcgattgcaaaacactggctgaaatcaaagaaaagcaaatgcttggctaagatggaacagtaaggaaaagggagcacaagctcccttttcttgtttctttgcatttgaaaggtaaatcgccctatgaactatattggtcgcttcgccccctctccttctggtccattacattttggttctttgattgcggcgttgggaagctatttccaagccaaagcacaacaaggaacttggctggtccgtattgaagatctcgatccgccccgggaaatgccgggagcagccgcgcacattttgcgtacattagaagcctaccgcctgcactgggatggcactgtggtttaccaaagccagcgtcacgccttataccaagatcaaatcgatgcttggctaagcacaggtcaagcttactactgccagtgcacccgaaaagccatcaaagccatgggcggcttttataacggccactgcaaaatccatccgccagcgcggcagcaagactgctcgattcggctacgaatggataatcaggtgcaacaattcattgatttgaaacacggcaccatcaccatacccaaggcattagcagaagaagatttcattattaaacgccgagatggtctgtttgcttacaatcttgctgtggtgctggatgatattgatcaaggcgtgactcaggtggtacgcggcgccgatttgatagaaccgacagggcggcaaatcagcttgtatcacactttaaaacaaaagccggtcagctacttacatttgcctttggcgatggatgggaacgggaataaactctcgaaacagaatcacgctccggccattgacccaaccgcgcctcggcagaccatttcccatgcgatgcagtttttaggctttacgctgcccacggatttttccgatgccagcgcagagcaaatgctggcttggggctgccaacattggcaggtgagccagctaccggaagcgatcgagatcacaccaagattctcaaatggtcctgcttaagctattattagcgccaaattccgtccgtttgagcgtcaaattaagcagcgtagcgcttacagcggcaacagcaatcattgtcagaagcacatgaataataacgattttgaaccgagcaacactcgcacatatccagacttagctttgaccatcattccgcgtcaggaacaccctatctcgcgtcagcagatcagcgaaaatgcgctgaaagtgctctatcgtctgcatggtgcggggtttgaggcctttctggtcggcggcggtgtgcgtgatttacttctgggtggcaagccgaaagactttgatgtggccaccaacgcaacccccgagcagttacgccaactgtttcgcaactgccgtctgattggtcgccgtttccgtctcgcgcacattatgtttggacgcgacatcgtcgaagtcgccactttccgtggccatcatcaagagtcgagtcagagccaaaatatcgctgcacaatccgaagcgggtatgctgctacgtgataacgtgtacggcacgattgatgaagatgccgagcgccgcgatttcaccatcaatgccatgtattacaacattgcagactacagcatccacgactatgccggcggcatggaagatctggaagatcgtttggtgcgcctgattggcgatccggaaacgcgttatcgtgaagatccggtacgcatgctgcgcgcggtacgttttgcggtcaaactcgattttgatatcgaagaagataccgcggcgccgattgagcaacttgcgccattgctgcgtgacatccctgcggctcgtctctacgaagaatcgctcaaaatgctgcaagcgggtcatggtttagaaacctaccacttaatgcgtcaatacaatctgttccagcaacttttcccaactatagccgagcattttactgccgatcacagctcaaaaactgagcagatgttggatttggtgctggatgcgaccgacattcgggttgaagaagatctgcgcatcaatccggcctttatgtttgccgccatgctgtggtatccgatgattgatctcgcggatcgcttaatggaatcgctcgatctcaatgagtttgatgccattaccgaagccagcaaccgcatcttagatgaagtggtcaagcgtatcgctattccgcgccgccacaccactacagttcgtgatatttggcagttgcaacagcgcttaccccgtcgcagtggtaaaagggccttccgtctacttgaactgaacaagttccgtgcaggctttgatttcctcgaaatgcgtggcgaaattgaaggcggtgaaaccaaacaattagcggaatggtgggccaccttccaaagcgcgggacgcaatatgcgccaagccatggtgggtgatatcggtaatgcaacgggcagcagcaaatctggcgctcgccgccgtaaaccatcccgcaacaaatccaagagtaaatccagcgaatgatgcttgcctacattgcgattggcagtaatttgggcgaccctgtcgcccaagcacagctggccatacaacagcttactctcttaccgaagtcgcgccttatcgcggcttcatcgctctatagcagcactccgatggggccgcaaaatcagcctgattacatcaacgctgtcgccgccatcgaaaccgaattaacgccactggaattgctcgattgcacacaacgcattgagctagaacaggggcgtgtccgtaaaagcgaacgatggggaccgagaaccctcgatctcgatattgtgctttacggcaatgaggtgatagagaccgagcgcctcaccattcctcactatggaatgaaagtacgtgaattcgtgctttacccgctcgcggaaatcgcaccaaatttaaccctcccagacgggactgaaatccaagcgttattgcaacaagtaccgctcaatgggctcagcatttggcactcgccaacgtcgagtaaggactaaacatgaaaaaaattaccataaacgacctgatgaaatggaagcaggaaggtcgcaaatttgctacatcaaccgcttatgatgcgagttttgctcagttatttgagagccaagaaatgcccgtcttattggtcggtgattcacttggcatggtgttacaaggagaaaccgacaccttacccgtgacggtggatgacattgcgtatcacacccgctgtgtgcgtaaaggcagccccaattgtctgctgatggctgacatgcctttcatgagctacgccacaccagaacaagcgtgtgaaaacgcggccaaactggttcgcgccggtgcaaacatggtgaaaattgaaggtggcgattggttagtcgacaccgtaaaaatgttgactgaacgtgcagtgcctgtgtgtgctcacctcggtttaacgccgcagtcggtcaatatttttggtggctacaaagtacaaggccgcgagcaagataaagcggatcgcatggtacgtgatgcgttggctctgcaagaagcgggcgcacaaattgtcctgctagagtgcgttccagccgaactcgccaaccgaattactcaaattttggatgttcccgtaataggtattggcgcgggtaatggtactgacggccaaattttggtgatgcacgatatgtttggaatttcggcgaactacatgccaaaattctcgaaaaatttcttggctgagactggcgatattcgccaagccgttgccaaatatatcgaagatgttgccagtggcgcgtttcccgatctcgcccacaccattgcctaaggagtcatacatgcaagtttttgctgacatcgccgttcttcgcgagcagatcaaacagatcaagcgcgaaggtcgccgcgtcgcttttgtaccgaccatgggtaatttacacgaaggccatttaaccctggttcgtaaagctcgtgagctcgctgacgtcgtcgtggtgagtattttcgtcaatccgatgcagtttgatcgcgcagaagatttgaaaaattacccacgtacgcttgaagaagacctaagcaaactcaacggcgaaggggttgatctggttttaacgccgacacccgaaaccatgtacccacaagggttggataagcagacctttgttgaagtgccagggctctcttacatgctcgaaggcgcatcgcgtccgggacatttccgtggcgtcgcgaccattgtcactaaactgtttaatattgtgcagccagatgtcgcttgctttggcgaaaaagatttccagcaattggcggtgatccgtcaaatggtagaagacttgtgcatggatattgagattgtaggcgtagcgaccgtacgtgagttagatggccttgccatgagttcacgtaataatttgctgacgctggatgagcgccaacgtgcgcccgttttggcgcgcactatgcgctggatcagtagcgccattcgtggtggtcgcgatgattatccatcaatcattgaagatgcagtggatcagttgcgtgcggccgatttagagccagatgaaatcttcatccgtgatgcacgcactctgctacctatcagcagtgagagtaagcaagccgtgatcctgatgtccgctttcctcggtaaagtgcgtttgattgataaccaagttctcgatctgcaaaccgacaccaaagccagtagcgaagaagaataatcctcttgtctctggatcaaaaaaggtcaacctcggttgaccttttctatatcgattgtctgattagctgcgcagccctttgcctttggtcactaaataatgcgccacacagtacagcgccaccacaaatgccattaacactgcaaacgaagtcatgatatccacatccgacacgccaaggaaaccgtagcggaacgcattgaccatgtagacaatcggattgatcttcgagacactttgccaaaactccggcagcaagctaatcgaataaaataccccaccaaggtaagtcagcggcgtcagcacgaaggtcggaacaattgagatatcatcaaacgttttggcaaacaccgcgttaatcaatccaccgagtgaaaacaccaccgaggttaaaaataccgtcgcaataatgatgccccaatgatcgacctgcaaatcgacaaacaatagtgaaaccgctgtcaccatagcccccaccaacaatccacgcgcgacgccgcccatcacgtaacctgcgataatcacatagtttggcacaggagcgactaacagctcttcaatgttcttttgaaacttagagctaaagaaagaggatgccacattggaataagagttggtgatcaccgacatcataatgagaccgggtacgatgtactccatgtagctgaaaccgttcatctggccgattcgagagccaatcaaattaccgaagatgatgaagtacagcgtcatagtgatggcgggtggaaccaaagtttgcacccaaatacgggtaaaccggttaatttctttgccgagcagactacaaaatgccgtccaataaatttgatacatgctgattaacctcgcttaccactgttgactatgctgacaaacagctcttccaaacggttcactttgttgcgcatcgacagcactttcaccccttgttcggtaagttgggtaaacacatggttgatcccttggcttttttctaattcaatctccagcgagccttccaccatctgctgtttaaccactccttgcagcggtgcaatgggtgcgttgccatccacatcgagaacaaacgtctcaacgtgcaacttaccaagcagagatttcatggtggtgttttcaatcagctcgccgcgttgaatgatgccaatatggcgacagagcatttccgcttcttcgagatagtgagtggtgagaatgatcgtcacaccttgcgcgttgatttgcttgagaaactcccacatggaacggcgcagttcgatatcaacgccagcggttggctcatcaagaatcagcagttgcggctcatgcattaatgcacgcgcaatcatcaaacggcgcttcatgccgccagagaggtttcttgctcgttcgctgcgtttttcccacaaatcgagctgagtcaggtactttttcgcgcgctctttggctaacgctttcggtacgccatagtaaccggcttgctgcaaaacaatctgctcgaccgtttcaaacgggttgaagttaaattcttgcggtactaaaccaagcttctgtttggcaagttccagttgagaatcgagatcgtaaccaaatactgtgactttgccggaggttttattgaccagcgatgagatgatgccaatggtggtcgacttccccgcaccattgggtcccagcagagcgtaaaaatcgccttttttgacttgtagactaatgcctttgagggcttcaaagccaccggcataggtttttctaagttgttctatttccagtgcgtacatggtaggaaccttgttatcaataacaacaaggatgttgcgcttgtatggcgctttttcaaccctttataccaaaactacttggaattgcagctaggcggcaagtaagtgacaaatttgtctggaacaaatttgcacagccatcggctggcctttggtgagagccaaggatggctctcataatccccatgagcatagataaactgtgtgattggggtgagcaaacgtagccaataccgctgcaacttcaagtaggaaggggatattggctaagggcaatgattaatacagaaatagctaatattataggcttgccctgcattcaaagatcagagacaaaaatgccgcatgactgcggcatttcggccatcaccatcaacgccgagttacgtattcacctgtttgactgccgcattaagcgcttcataacggaaggtaaacatattctgatccggaaccagatctatgaccttaaacttttctaattcggcacgcgttttttcattaggacagagtaaatagacttcacaatgcgcttcctgcgcatcacgaatcgcgttttctaacgccaagccaacggtgacatcaatcatagggacatcggttagatcgagaatcatcgcttgatattgatcgacactgctgtgctggcgcgtaatggctttcgagacactgaaaatcatcggccctgataggtagaaaaacagcaccttaccattggctttatccagcagcttacgttcactctccgtcagtggcacatcatcgtcatccgcgtcactgatcgccttgacttggcgtgcctgctcacggcttaaacgttcaataaccagaatgttggagatgaacacaccaaggccaaccgccacaatcagatcgacaaaaacggtcagcaacataacgccatacatgatggccataccttgcagactgattttgtgcgcacgttgaataaatgcccagtcgaggatattcaccccaacatacaccgcgataccggccaataccgccatggggattggctcagtcaacccaccagcgactaacaccaccagcgccaacattaaagcgcgagtcacaccagacaatggcgaacgagcgcccacttgaatgttggtgactgtgcccatggtggctcccgcaccgggtaaagcaccaaataatcccgcgaccatattggcaattccctgcccttgcagctcgcgatccgaatcatgctctttacgcgtgagagaatcgccaatgactgccgttaacagcgtatcaatacaacccagcgtaccgagtacaagggcatcaatcaccatggtcacgacaatatcgccagtgaaagtagggacgacgatactcggtaaacctgcagggatttcaccaatccggcgaatatcatcagtatcaaagaaaatcaccgaaaacagagtcacgacgaccaaggcgaccaactgcgcaggaacttgcttgcggtatttttgtggtaaaaaaaacaaaattccgagggtgagtaagcccaaaaacagctcgctgaattttaaattggcgagcaaatcgggcaacgcagataaagtcccaagcacaccgccaccaggagaagggtgcccgagcagtggtgagagttgcaggataatcaggatcaccccgataccggacataaagcctgaaaccacgctgtatggcatcagcgtaatgtatttaccgagcttgagagtaccgagcaaaatctgaaatgcaccggccatcatgacaacggtaaaggcaatcgccgcgcccgattcagggtaacgtgccaccatggcggttaaaatcgccgtcatgatcaccgtcatcggccctgttggctctgaaatcagagtggaggagcctccaaataaggcggcaaaaaagccgactaaaatggcaccccacagacccgcctctgctcctgcaccggaagcgaccccaaacgctaacgctaatggcagtgaaatgatggcggtggttaccccaccaaacaggtcacaacgtaaattaagatccgcaaatctagcctgaaacacgcactattccttaaggtgtcatcgaatgaccctagtttaaaaccaatgttgtaaaaacacgtcagatgagttaagcagaaagtaaattagatgagcttgaatttgtaacattgtgtatattgttggcaattatttaagggaagtaagatgccagaaattaaacaactttttgagaacaactcaaaatggtctgaatcgatcaaagcagaaactccggaatattttgccaaactcgctaaagggcaaaacccggattttttgtggataggatgtgcagacagccgagtgccagccgaacggctcactggcctttactcgggggaattatttgtccaccgtaacgttgccaatcaagttatccataccgatctcaactgtctttctgtcgttcagtatgcggtcgatgtgctgcaagtcaaacacatcattgtgtgcggccactatgggtgtggtggggttactgcggcgatcgataatccacaacttggcttaatcaataactggttgctgcatattcgcgattactaccttaaacatcgtgaatatctcgatcagatgcctgccgaagatcgctccgataaactggcagaaatcaatgtcgccgagcaagtctacaacttggctaactcaaccgtgttacagaatgcttgggagcgtggacaagcagtagaagtacacggttttgtctacggtatcgaggatggccgactggaatatctcggtgtacgctgcgcgtcacgcagtgcagtggaagataattaccacaaagcgttagagaagatactcaatccgaatcatcgcctactgtgtcgttaattctctccaaagagcaacgcccacgagtgcgtgggcgttgtcggcaatcttttattgtcaatcgtgagcttaggttattccgccaaaggcaccactttgccaatataaggtaggtgacgatatttctgcgcgtagtcgataccgacaccgaccacaaattcgtcaggaatttcaaaaccgacccaattcacttcaacgtccacttcacgacgggttggcttatccaatagtgtgcaaatacggatcgatttaggctcacgcagcgccagaatctctttcactttgtttaaggtattccctgtatcgataatatcttccaccagcaatacatctttacctttgatgtcatcatcgagatctttcagaatgcgcacatcacgtgagctttgcatactgttgccatagctagaggcggtcataaaatcgacttgatgagtcagatgaatttgacgagcaagatccgccataaaaacaaaagaaccacgcagcaatccaaccaaaactaaatcactactcccttgataatgctcagtgatctgttgacctaattcgcgaatgcgctgggcgacctcttgctcagaaatcatgacttcaactgtgtgtttcataccattctcgttgtgttgggcgatgtcagtatcgctgactttggtggcgcgtatagtaccacttcactcaaatcctgttaatcgtttccctactcatcctcgctttgttatgtacccactcaataaaacaagctgaaacgacaaataattaacatagttgcacatttttcacccaacagagattgaccttgaatatatgcaccattacactcatagggctttaagtagcaaataacaaaataatcattagagcaaaatgctcaatcaacaactcaattggcaaggatatacccctatggacgcatcaatcgaaaaacgccctcgaactcggctatcgcctcaaaaacgcaaactacaactgatggaaatcgcgttggaagtgtttgctaaacgcggcattggtcgtggtggtcacgcagatattgccgagattgcgcaagtctccgttgcaacagtgttcaactacttcccaactcgtgaagacttggttgacgatgtgctgaattttgtggttcgtcagtactccaacttcttgaccgatcacatcgatcttgatttggatgtgaaaaccaacctacaaactctgtgcaaagagatggtgaaattggcgatgaccgattgtcactggctcaaagtctggtttgagtggagtgcttcaacccgtgacgaagtttggccactgtttgtttccaccaaccgaactaaccaactgctgatcagaaacatgtttatgaaagcgatggagcgtggcgaattgtgtgagaaacacgatgtcgataacatggccagcctgttccacggcatcttctactccatcttcttacaagtgaaccgtttaggtgaacaagaagcagtgtataagttggccgatagctacctcaatatgctgtgtatctataagaactagtttcttgggcagcacaaagggcgcatccgcgcccttttttgttttcagatgggtatcacttccagcggtaataaatatacctaaacgacttggtgttgcaggccggcggcaaatgagtgaatccccacgagcatagatacactctgtgattggggtgagcaaattctgccaacaccgctacagcttcaagtaggaaatggatagaagagaaaattattcgcctaaattctccaagccccatttatacaatgcattctttttcaactggtgaatttcagccactaaggcagcagcttttttcaatggcagctctttagtcaaaatcgttaaggtgcgtagagcctcatctggcagttgctgctcacccgcatcccgatatccatgcaccaacagcaccatttcgcctttcttacggttatcatcttcagcaatccacgtaatcaactcagccaaaggcataccttgaattgtttcgaaggttttggtgagttcacgggcaagtaccacttcacgctcgccaccaagtacatctaacatatcttgcagtgactcgcagatccggtgtggcgattcataaaaaatacaggtacggctcactttcgcgatctctaatagtttatccttacgtgctttgctttttgccggcaaaaaaccttcaaagctaaaactatcagatggcaggcctgatgcactcagcgctgtgatcaccgcacatggccctggaagtggcacaactttaacgcctgcttgacgacattgagtgactaaatgataacctggatcactgatcagaggcgtgccagcatcggacactaaggcaatcgatagaccagagagcagtttatccactaagacttgggctttctgctgctcattatgatcgtgcaaagcaaacgttttggtcgagatgttgaagtgagctaataattttccggtatgacgcgtatcttcaacggcaatcatatcgacactggctaatacatccagagcgcgttgtgtgatgtcacccagattaccaatcggggttgggacaatataaagaattggagcaccatttggcacggttttattatctgtcatttgtttaccatcacatcaacgattaatatagagacaattttacacggactaacgaaagaactcatggctatgaaccaccatcagcgacgcagtgtaccacgcttactcactccgattgcattatcaatcgttttatcggcctgttcgactcaaccttcgtcaccggatgtggtcgatattaccgctcaaccactcttaacggcgcagacgtatttgatgcgagccgatgccagccaaggtaatcagcaaaatgattggctgatcatggctctcaaagccgccatagaggaaaacaatcccgatcaagcccaacttctgatcatgcgcttggcgaaacagcccttgactccaactcagcaggcgcagtggcaactgctgcgcgctcagttattagctaataccgaacaatatcaagaagctctagagcaactgagtttccaagccaattggtcgttacctcaagttcaatggcagcaatatcaccagcttcgtgcggacatattcacggctctggatcgctcttttgactccactcgtgagttagtggcgctgtacggcctttcatccaacaaggacaaagaagcattagcggatcaaatctgggcaaacctcaatcactactccgccagcaaaattatcaagctttctactgagcccgatgaagcgcagttggatggctggctacagcttgcgatctatatgaaaacgctgggtagcgatctaccacaactgaaaaataccttagaaaaatggctggctgaaaatccgcagcacccagcggcaatttatacccctaaagccattaccgatattttggctttagaaatcgtcaagccgactaacaccgctttactgttacccttgactggtaaatttgctaagcaggcccaatttattcgtgatggatttgtgtttgccatgatgaacgatgccgatcgccaaacaaacgcgacgttgacaatcatcgataccaatgccgaaacgctcgaatctgttgatgcgattctgaccagcaaacaaattgattttgttgtgggtccactgatcaaaggtaatatcgaaaaactgcagcaattccaacaaagccgtggtcaaatgatcccaacgttggcgctgaacatcccggatcaaattgatacgacggcgggcgcttgctatctcgctctatcacctgaacaagaagtcgcacaagcggcgaaacatctgttcactcaaggctaccgttacccactgatcctcgcgccccaaaacgcttatggtgaacgtgtggttgaagcctttaatgaagagtggcgtcgttacagcaaaaacaaagtggcagtgaatctttttggcgacaagcgtcaattacaacgcaatatcaactccatttttggcttacaggatagccaacaaaacatcgcgcagatggaatctctgcttggtatgggcttagagagccaacctcgtagccgccgtgatatcgatgctgtgtatattgtcgcaaacagctcagaactcaccttgatcaagccatttattgaagtggctatcaaccctgatacccgtccaccaaaactgttctcgaactcgaacagcaacacaggtggtcgccaatacgaagatttgtcaggcgtgacttacagtgatattccactgctgatacagccagcgccaagtatcaaagagcagctaacccaaatctggcccgaaagctcaaatgcagagcgccgcttgcaagctctggggatggatgcctaccgtttgatggtggaacttccacagatgaaaatcgtcgaaggctatacgattgatggacaaacgggtgtgctaagtattgatgaacaatgtgtggttcagcgtgaaatcagctgggcagagcatggtgttcgttaattctaggcaccaaggaaatcattatgaacaaatggcggcggactatcttcgccgccaaggccttactctagtcacacaaaatgtgaactaccgttttggcgaattagacttaatcatgcgtgatggaaacacattagtgtttgtcgaagtacgctatcgaaacaacactcaacatggtcacgccgcggaaaccgtcacaagaaccaagcgtgctcgcttgatcaaagccgcaaattgttggatgctcgccaacaagatgaatagtcacagtgcggattttcgttttgatgtgattgccattcatcaacaagggcaacatattgattggttaaaaaacgctattactgaaggataaacaatgctcgatagcattaaagacagttttaccgaaagcattcaaattcaaatcgccgcagcggaggcgttacccgatgccattatgcatgccgcacaagccatggtggcgagtttacttaacggtcataaaattctctgctgcggtaacggtggctcgtcggtcaatgcacaacaatttgtttcttgccttctaaatcgctttgagaccgaacgcccaagcttaccgggaatggctctgactgcagataacacgacgctcaccgccgtcgctaacgactaccactatcaagaaatcttctcaaaacaggttcgagcttttggccaacccggtgatatcttgcttgcaatatcaaccagcggtaacagtaaaaatatcatcaaagcaatggaagcggccgtaactcgcgacatgacgatcattgctctcacaggcaaagatggcggtgaaatggccggactgcttggtgaaaatgacgtggaaattcggatcccatcacaccgtaccgctcgcattcatgaagttcatatggtaacgctacactgcctatgtgatttgattgatcaagtgttattcccagcccatgaagagtaaatatgaaaagcattagacttcttatcgtttccggtttgctcgccactctaacagggtgtgccggactgtttatcgcgggtgccgcaaccacagccaatattgtgaccgatccgcgcagcacgcaagagatctggcaagataacaatgttgaacttgaagttgcaggccttgccaataaagaaccttaccgcaaagatgcgcgcatttctgccgttgcttaccgtggaaccgtcgttttattgggacagtcacgcaatgaagcgatcttagagcaatttattgctcaggctcgtcaactcaaaggtgtcaaagagctgcataaccaagtgcaaattaaagcgccactctccgttggtgaaatcagcaacgatagttggataaccaccaaggtaaaatcggcgcttttaacgaaatctgagctcaacggcattaaaattaaagtggtgacagaggatcgcgtcgtttatctgtttggatacgtttctcctgaacacgcagagatggccattggtgtcgcaagaaatatcataggtgtgaaacaggttgtgaaggcgtttgattacgctcagtaacgattttgagagtgggatatgaaaaaggcagcgatgaccactgcctttttgatttcatgagatttatttacttcacgacacgtaaactcggtttgcctctagggcgtggagtctcttcagtgtgctcaaccgcaacatcgctttccagctcaatcaaggagtcatctgaatcaatctcttcaggaaaatccatcatatctagataagcaggctccggctcaaacatagtgcctgcgccattttcacgggcataaatggcctgcacagcataaataggcacgataaccaaatgaggacgaccaccgaaacgggcattaaaggtcacttcatcattgcccaactctaggtttcccactgctcgtggagcaacattcagaataatttgaccatcttgaacgtattcaagtggtaccttcacgcccggtaaagtggcatcaacgacgaggtgcggcgttaattcattttccagtaaccaatcataaaatgcacgtagcaaatatggtcggcgtggtgtcatgtgaccaatatccattccggcatccattagcgagccagacgcatctcgcgttcagcttcagtcagtgaagccaagaatgaatcacgttcaaatacacggttcatatacactttcagctcttttgagccagggccaattaaatcaatgcccagcacaggcaaacgccataacagtggagcaagatagcaatcgatcagactgaactcttcactcatgaagtattcaaactcagcaaacacaggccctaaagttaacagatcattgcgtagcttattacgtgcattttcagcaacttcaggagaaccattcactactttttctgccaatgaataccagtttctttcgatacgataaatcatcagacggctgttaccacgtgcaactgggtaaacaggcataagtggcggatgagggaaacgctcatctaagtattccatgatgatctttgagtcatacagagcaagctcgcgatcaaccagtgttggaactgttttataaggatttagctcaatcagttccgctggaaggttgttctcatcaaccaactcaacttcaaaactgacgcctttttcagctagcacaatgcgaacctgatggctatacatgtcagatgcacttgaaaatagagtcatcacagaacgtttgttggcagctacagccatggagccctccagtacagatgcgggtacaaaaaatcaatggaggctagagcctccactgatgagttaacaatcgggaattagcgcagcataatagcacaattagtgcacatcacgccaatactctttcttgagtgcgacaacgacaatggtgaagatcactaagaaacccattgtccaccagcctaagttttggcgctcaagcttcatcggctcaccggaatattccaagaaattcaccaagtcacgtactgcttggttatattccccttcactcaattcaccgtttccacgtgacttcacgccaaccacatgttgaacctcattgccatcgacgactttggtttcaaaaataggctcaggagtaccttgaagctcttcaagaacatggggcatacctacgcttggaaacacaatgttattcacgccaaaaggacgtgaaggatccgtgtaaaatgagcgcaaataggtatacaaccaatcggttccacgcacacgagcaaccagtgtcaaatctggtggtggcgcaccaaaccatttcgctgccgatttatcgggaatcgcattttccatcaattgaccaattttggtctcaggatcaaaaatcaggttttccttcattaaatcagctgggatgccaagatcattggcaacccgttcataacgttgatattgagtagaatggcaaccaaagcagtaattcataaacagcttggcaccattttgtagcgaagcctgatccgtcaaatcgttattcgctttatctaaatgcacatttgctccagccgccatcgccagtgaaggcagcatagcaaacaaaactacaatccattttttcatttgtatgtcacccttgttggtaatggcttagtggcttcgtttttgctgtagaagaacagcaacacaaagaacatgaagtaacacaagctaaatatctgagccaacagtgtgtaggttggagttgcaggtagcgcgcctaaaatccctaaggcaataaagctaacagtgaactgggcaatattgaataaatggaatttgctacgataacggtaagaacgaaccttacaacgatccagccaaggtaacaggaacaatacaacaatcgatgcccccatcgcgataacccctagcagcttatctggaaccgcacgcaagatggcgtaaaacggcgtaaagtaccaaacaggcgcaatatgttctggtgttttcagtgggttagctgcttcaaagttgggcggctcaaggaagtatcctcccatctctggattgaagaacaacacatagcagaacaagaataagaatcccgcaacaccaattaaatctttcaccgtgccataaggatggaatgggatcgaatcgataatgtcgtacttcttagtgtagtactcatggaatttaaactgtgattcgtagccttcacccattgaaccttttggcaatttagtctcaataccatcagggttatttgagccaacttcgtgcagagccagaatatgcagcacgatcaaaagcagtaatacgattggcaacgcaatcacatgcaaagcaaagaaacggtttagtgtggcaccagaaatgacatagtcaccacggatccacagcgtgagatcatcaccaataaccggaattgcaccaaacagcgaaatgattacctgtgcgccccagtaagacatctgtccccaaggtaacaagtagcccataaaggcttctgccatcaacacaaggaaaatcagcataccgaagatccacaatagctcacgaggcttttggtatgatccataaatcaagccacggaacatgtgcagataaactaccacgaaaaatgcagaagccccggttgaatgcatataacgcaataaccagccgtactccacatcacgcatgatgtattcaatcgaagcaaaagcgccctctcccgatggcacatagttcatggttaaccaaataccggtcaggagttggttgaccaaaaccaacatcgcaagcgaaccaaacagataccaaaagttaaagttctttggcattgggtattctgaaaggtgtttcttgtacgcattcatggcaggtaggcgtttttctacccaatcaagtagagcttgcattatgcctcccctgtctcatcaagaccaatcacgatccgcgtatcactgagatacatgtgcggcgggataacaagatttagtggtgccggaacagcttggaatactcgccctgccatatcaaattttgaaccatgacatggacagaagaatccagacttaaccccttggacttgctcagaaaaagaatctggaagataagttggtgagcaacccaaatgagtacaaataccgactgcgataaagtactcaggcttaatcgaacgataaggattctgagcataattaggctgttgtagctcgtcagaattcggatcacgaagttggttttcgtgacttttcaaaccttcaacgacagcttgtgaacgacgaaccacccaaacaggcttaccacgccattcaacacgaaccatctgcccttcttcgagtttactgatttcaacctcgacaggggcaccggccgcttttgctttcgcgctcgggttccacgattttataaaaggtacggcaaccgcaacggctcctaaaccacccacaacggccgttgtagcggtcagaaatcgtctgcggccttgatttagaggcgcattactcatccagacattctcccatttgctccttatggatcctgcttattccgtttaaagagcaaggctaacaaacacgagtttattttgtatttatttgatagcaaatgataaataaaaccctactttttgacaagataaagctacctttctgtaacatttgtcaattcaaatcgctcgcggcatcacaaaaggaacaacttatttatcgagtattgagaagaggggaattaggaatctgccaagcagaccttgagatgtaaaaaacccggccataaagccgggtttttgaaccacatccagtaacactggagcgtatttttccaaaaggaaaaattaacgcttagagaactgtggacgacgacgtgctttacgtagacccactttcttacgttcaacgcgacgagcgtcacgagtaacgtagccagcagcacgtagaacaggacgtagagactcatcgtattccatcagagcgcgagtgataccgtgacggatagcacctgcttgaccagaaataccaccacctttaacagtgatgtacagatccagtttctctaccatgtcaaccagttcaagaggttgcttaacaaccatgcaagaagttggacgaccgaagtactcttcaaggctacgcttgttgattacgatgttgccgctgcctggtttaataaaaacacgagcagctgagcttttgcgacggccagtgccgtagtattgattctctgccatttccgaaatccccgattagatgtccagtacttttggttgttgagcagcatggttgtgctcagcgccagcgtaaactttcagcttacggtacatagcacggcctagaggaccttttggcaacatacctttaaccgctaactcaagtaccatttctggcttacgctcaatcagcttctcgaagctgaatgacttcaggccacctgggaactcagagtgacggtggtacatcttgttcttagccttgttacctgtaacagtaactttctccgcattaacaacgatgatgtaatcaccagtgtcaacgtgtggagtgtattcagctttgtgtttgccacgtaggcgagatgcaatttcacttgctagacggccaagagttttaccttcagcgtctacaacgtaccagtcgcgttttacagtttctggtttagcaacgaaagttttcatgctaataataacccgttaatttaaatttacacttcaaggagctttcgctcccactgtctaagagcccagtcatcaccccttcgagtgggtggcactctcggccacaaaggacctgcagtaacggtgggtcgcaggattatagagaagggcgcagaaaaaatcacctttttttgcatgaaaagagaaaaaaaatccacgccttactggggaagccattttgtgctcagcccaagtgctccttcgctaagtaatcatgactttgcatttcaattaagcgtgattggcagcgtttaaattcaaattctaacaaaccatcggtatacagatcggtaaggggcacttcagcagaaataattaactttacatgtcgctcataaaactcatccaccagcgcaataaagcgcctcgcggcatcatcgctacttttgttcatctgtttgacatccgccagcagcacggtgtgataaattttcgacagctcaatatagtcattttggctacgtgccgtttggcataactgagcaaaggtcgcatacaatactccgtctcctgccgcttcaaccgtaatcattcggtgattcacgtcgatctgcgtctctggagtctgctctgagctgatcaactgctggaagtaacgctgtaggttatcggtcgctttactgtctaaagggtaatgataaatttccgcttgctgtaaggttctcaaacgataatcgacaccactatctacatttaggatctgacaatgcgtttccaccaacgcaattgcaggtaggaatcgggctcgctgtaacccattgcggtacaaatccttgggggcaatattcgaagtggctaccaatacgataccgcgtctaaataaggcctcgaacagagttccaaggatcatcgcatcggtaatatccgagacgaaaaactcatcaaaacagataatgtttgcctcagcacaaaagcgatcagccacaatttcaagcggatcactgacgtctgataaagtgcgtaattcatcgtgcacccgatacataaagcgatgaaaatgaaccctaagcttcttttctgtcggcaaggcttcaaaaaaagtatccataagataggttttaccgcgtccgacacctccccacatatagagaccttgtggcggttgcgtcactgttggcttcttaccgatgagcttttgccatacagaaggtcgtaccactggctgattgaggtaatttagccattggtgatacaaattatctaaggcatcgacggcacgtgcctgtgcttcatcactataaaaatcagtgcgttgtaaatctttttcgtatcgctgcttcggagtcatcttggtctactacagttacaaggagagccataaacgcaaaatagctgacgtgcattttgctttatccaacttgggtctcatagtaacatgtccctcgtacatgtgtaaccgatgggtaaaaaacatgttaaataacaacaataaggagctgttatgccttggatctatgccattgctggattgctagtggggattgctgtcgggatgctgattgctcgtttgactacccctcaatataagacgcagaagaacctgcaaaaagaactcgagagcgcaaaattcaccttagagcagcagcgccaagaactgtctgatcactttgcgcagacagcagaaatgctcgataccctaggaaaagattacactaagctgtatcaacacatggcgaaaaccgctaccgatttgatccccaatttacctgagcaagataacccattcagtaaattggctcagcaaaaagaagagagcaaacagccagaagagctcgaacaaccacctaaagattacgcattgggtgccacaggacttttgcgcggtgaagaaaaagcaatcattcgctcagcggatttgcttaacgccaaagccagctaatcgattcccgctactttacggtgaactttgtaaaggtttttgagtcataactcgcagactgtcagttgaagtttcttgaaatggacatattttctacttcaaccggacgttaatttgttgaggagcttatgatgaaaaaacctttacttgttttaactgctctgtctcttagtttgagcgcgattctctcgcctttgcctgcaactgcagcgcttcctctctcagtcaatggagagcagattcctagcctagcccccatgcttgaaaaagtcacacccgccgtggtgagcattgctgtggaagggactcaagtttcaagacagcgtctgccggatcagtttcgttttttcttcggaccggattttccgaccgaacaactccaagagcgacctttccgtggcttaggttctggggtcatcattaacgctgataaagggtatgtcgtcactaactaccatgtcattaatggtgctgaaaaaattcgcgtcaaactgtatgacggtcgcgagtttgatgcagaacttgtcggtggtgatgagatgtctgatgtcgccttgctcaagctaaacaaagcgaaaaacctcactgagatccgtatcgcggactccgataaactgcgagtcggtgattttgcagtggccatcggtaacccatttggcttagggcaaactgtgacctctggcattgtctcagccttagggcgtagtggtttgaatatcgaaaactttgaaaacttcatccagaccgatgccgccatcaacagcggcaactcaggaggagctctggttaaccttaatggtgaactcatcggtatcaacaccgcgatccttggtccaaacggtggcaacgtcggtataggttttgccatcccatcgaatatgatgaaaaatctgaccgatcaaattcttgagtttggtgaagtgaaacgcggcatgctgggtgtacaaggcggtgaaatcacttccgaactggctgatgcgctcggctatgaatcctcaaaaggtgcttttgtcagccaagtggttcctgacagtgctgcggacaaagcgggcatcaaagcgggtgacatcattacgtcgctgaatggtaaaaaaatcgataccttctctgagctacgcgcgaaagtcgcgaccctaggcgcaggaaaaaccattacccttggagtgctgcgtgatggtaagaatcaaaatattgatgtaacgcttggggagcagcaaaatgccaagaccaaagcagaatcactgcatcaaggtttgagcggcgcggagttaagcaacaccactgacagcgatcctattcagggcgttaaggttactgaggttcaaaaaggctctgccgctgaatcttaccagctacaaaaagacgacattatcattggcgttaaccgtaagcgggtgaaaaatatcgccgagttgcgtgcgattatggaaaaatcaccgaatattttggcattaaatatccaacgtggagagagaacgctttacttggttgttcgttaattatcactcagcgttaccgctcattgagcggtaacgctttctttccctcaaaaatccccaaacttgcacaaaaacttattcataagctacagatgcaactttggcgaaatgcctttccagtgttatacttgcccactcgcagtgaggaatttagtcaatattgagttggggaaactatgctgaaattttgggttcgctcaatcagccttgggttgttggctgcgattgccattattatggtgacaccctcactacgcgccaaattaatgcccgttgtcgaacaaccacgcaacatcggcgctctacaaatctcatttaatgaagcggtacgcaaagccgcccctgccgtcgtcaatatttataaccgtaaatacagcgaaaatgatcgccgtaaactctcgattcaaggtttaggatccggtgtcattgtcagcgaaaaaggctacatcatcaccaactaccacgtcgtcgcgcaggccgatcaaattgtcgttgctctacaagatgggcgagccgcagcagcacaattggtgggaaaagatcgccgtaccgatattgccgtattacgcgtagaaggcacgggtttaccagtgattccactcaatccagattaccatcctaaagtgggggacgtggtgttggcgattggtaacccttacaacttagggcaaaccacgactttcggaattatctcggctaccggacgttcatccatcagcgctgatggtcgccaagcctttattcaaactgatgccgcaatcaatgacggcaactcaggtggtgcattggtcaatacccaaggtgaactggtcggcatcaataccgcctcttttcaacaagccaccgatctcgaaacttacgggatttcgtttgcgattccctactctttggccagtaaaattatgaccaaaatcattgctgatggccgcgtgatccgcggttatattggcgtcgacggtcaagatattaactcgatgacatcacgtttgctggggaatgagcatgtcggtgggatcattattttaggggttgacccgaatggacccgcagcccgagcaggctttctggagcaagatattttgctgaaaatcgacggtaaaaaaattaatggtcgccagaatgtcacagataccgtcaccgatcttcgccccggcactgtggtggatttcaccctactgcgtaagggtgaagagattgtactcccagttacgattggtgaagacactcgtgattagacgagtgtgattctgaaaggttccactcatcgacgatgagacctcgacgttaaaaaatggagcacaaaaaagcggagcccttgggctccgctttttactacgagaacgagagttctagcattacttcttagccagcttctctttgatacgagcagctttaccagataggtcacgcaggtagtacagtttggcacgacgtactgcaccgcgacgtttaacttcaatgctatcaactactggagagtgagtttggaacgtacgctcaacaccttcgccgttagagattttacgaacggtgaatgctgagtgcagaccacggttacggattgcgattacgatgccttcaaaagcctgtagacgctcacggtcaccttcttttaccttaacttgaaccacaacagtgtcgcctggtgcaaattgaggcaggtcttgtttcatttgctcttgttctagagccttgatgatgttactcattgtctaaattcctagaataaactgatactaaatttaataggttactgatgacgagtctctttaatgtactcggtcagtaattgttcctgttcgtcagtcagagctaggttttccaggagctccggtcttctaagccaggtacggccaagcgactgcttgagtcgccaacgacgaatgtcctcatgattgccggatttcagtaccgctggcacttcttttccgtccaatacctcgggacgcgtgtagtgagggcaatccagcaaaccattggcaaaagagtcttcttctgctgacgcgaaatcccctaatactcccggaatgaaccgcgagacagaatcaatcaacgtcatggctgggagttccccacccgtcattacaaaatcaccaattgaccattcttcgtcaacttcagattcaataatgcgttcatctaccccttcatagcgaccgcaaatcagaatcagattctggttttgcgccagctcttccacaccttgttggtcgagttttcgaccttgcggagagaggtaaatgactttcgtcttacccggtgacgcttgtttcgcagcatggatggcatcgcgcaaaggttgcaccatcatcaacatgccgggaccgccaccgtagggtttatcatcgacagtgcgacgtttgtcatgagcgaaatcacgaggattccacgcttcaactgacaacaacccttttttaaccgcctgacctgttactccaaaatcggtaacgctgcggaacatttcaggaaataggctaacgatgccaacccacatgtttcctcgcttattcgattttaagagttaaaacgcaggatcccagtcaacttcgatccgttgagcttggcgatcaacaactttgatcacttgctcttcaagaaacggaattaaccgttccttttggccgaaagcatctttcagattcgctttcaccacgagaacatcgttggagcctgtttccatcatatcggttaccacgccaaggtcgtagccgttagtggtcactacttgcattccaaacaattcacgccagtagaactcatcttctgacaattctggtagtgatgcggggtcaatggcaatttcaaagttagtcagcagatgtgcatcttcgcggacatcaagcccttgaagttttaccacccaacctttgttgtggcgtttccagccttctactttgtattccacccactcgcccttttggtcaatataccaagggctgtaatcaaaaatactttctggattgtctgtgtaggaaaaaactttaagccagccacgaatgccgtaagaagaacctaattttcccacaaccaatttttcgttttgcttgctcatcgtctctttacctttcatcgacataaactagttactacttaacagtaataattaagccgctttttgagcggttttaactagctgtgctacgcgatcagacagagatgcgccttgtgaaacccagtggttcacgcgatctaggtctagacgcaggccttcttcttgaccagtagcagtagggttaaagaaacctactttctcgatgaaacggccagttgctgagttgcggctgtcagctacaacgatttgatagaatggacgctttttcgcgccgtgacgtgccaaacgaatggttaccatgtcgtcctctttgcttttcaaaaataaaattaaccccgaaaaccactttgcaaaaaattcacaaaatcagtttagggtctcgtgccaaaataaagcctcgggattttactcttattccgaggctttgcaaggggtttagctactttttcgccagcttaaagcgctacaaattaccgtgattcagttaacaaattggaaagttcactgaacactcaagcggttgcgtgcgagtgaattaacgaccgaagaaaccgccgccgaaaccaccacggccaccgccgcccatcaggccttgcatgttacgcatcatgcctttcatgccaccttgttgcattttcttcatcatcttctgcatctgggtaaattgcttgagcaggcggtttacgtcttgcacttgggtaccggaacccgcagcaatccgctttttgcgtgagcctttgatgaggtctgggttttgacgctctttcatggtcattgagttgatgatggcttccatctgtttgaaaacgcgatcatccactttgtctttcatatccgcaggcagttgagacattccgggcagtttatcgagcatccccatcatgccgcccatgtttttcatctgacctaactgctcacgaaagtcttctaaatcaaagcctttcttctctttgaattttttcgcgagtttttcggctttctcttggtcaacattgcgctgcagatcttcgatcagcgacagtacatcgcccataccaagaatgcgtgaagcaatacgatccggatggaaaggctctaaggcatcggttttctcgccgacaccgataaatttaatcggtttaccggtaatatggcgtaccgacaacgccgcaccgccacgggcatcaccatcgaccttggttagaatcaccccggtcagtggcaatgcatcaccaaacgctttcgcggtatcggcggcatcttgacccgtcatggcatcgaccacgaacagggtttcaaccggattgatcgctttatgcagcgcttggatctccgccatcatctgctcatcaatcgccaaacgacctgcggtatcgacaatcagtacgtcgtagaatttcttcttagcgtgatcaattgcagcgttagcgatatcaatcggtttttgatccggtgtggacgggaagaaatcaacgcctaaatcattggctaatgtttcgagctgcttgatcgccgctgggcgatacacgtcggcggaaaccaccaacactttcttcttatcacgctcttttaggagcttagagagtttgcctacggatgtggttttacccgcaccttgcaaaccagccatcaaaataaccgctggaggctgagcggcaagattcaacgcttcgttggattcgcccatcacagcttcaagttgctggcggacgattttgatgaactcttgacccggagtcagagatttggaaacctcgacccccaccgcgccttctttaacgcgattgacgaaatcacgaacgacaggcagcgcaacgtccgcctctaacagcgccatgcgcacttcgcgcagggtatctttaatgttgtcttcagtaagacgacctttgccgctgatatttttcagcgttttggacaatcgatcggttaaattctcaaacatcttttttctcttcgctaagcggcgataaattagcgtgagtataccttagacaaacggacaggcatacccgttacccaatgctcacattcacgaatatcattttgagccatattttgtgctctaacctctcaaaaacgaaggtgatacaaagtagcccattagcacagagcaaggtataattcgcccacttaacccttatctatgtggcaggtatggacaacttaatcgcgattgccgcggcgatgttatatctcttgtcgattgcgaccatcgtacccgggctggtcaatcaaaccgggatccgagcaaaaaccgtgtttatcagtgcagcgattgcactgctgtttcatggctggttactgagtgatttgatcctacacagcagtgggcaaaacctgagtatccttaatgtggcttctttgattagcttcatcatctctttagcgatgagcttagccatgttcaaaactcgcctctggtttttgctgcctgttgcctacagtttttctgccattaacctttctgcagccacattcttaccgggaacttttattacccatttggaaagtgatcccaaactgctgctgcacatctctttagcgctattctcttactcaacgttgagcatcggagccttgtatgcactgcagcttgcttggctcgaccataagctgaaaagtaaaaaagtcttctctatcaatcctaatttaccgcctctgctgctggttgagcgtcagttatttaagatcattttgattggtaacttgctgctcacaggtaccttgttgactggttttatctttgtgcaagatatgtttgcccaaggcaaagcccataaaggcatcctctcgtttgtcgcatggattgtgtattctattttgctttggggtcattaccgtaaaggctggcgcggtaaaaaagtgacttggtttgcggtcgcaggcgctacgttactcaccttggcttacttcggtagccgttttgtacgtgaaatcattctgcgctgaacaagattcatcgagctgtcatttgacactcgcaatacattcagcctttaattagaactctgtcataaggaaaattcgcgttttggacgacatatcaacgggtatcttatttgcgctactcgcgtgtctcatcattatttccgcctatttctccggttctgaaaccggcatgatggctctcaaccgttaccgtttaaagcatttggccaacagcggccataaaggtgctaaacgtgttgaaaagctactggatcgtccagatcgtttgattggcttaatcctgattggtaacaacctcgtcaatatcctcgcctctgcgattgccaccattatcggtatgcgcctgtatggcgatttaggtgtcgcaattgccacgggggccttaactttagtgattctggtgtttgccgaagtcacgcctaaaactctagccgcgctttacccagagcgagtctcttacgccagcagcgtgttactgacgattttgatgaagctgctttcacctttggtgctgttcgttaacttgatgaccaatggcttgatccgcattctcggcatctcaccgaaacatggcaaaggcgatcatttaagctcagaagagttacgtactgtggttaatgaagcgggaggactcatccctcgccgccaccaagatatgctgctgtcgatcctcgatttagaacacgtcaccgtcaacgacatcatgatcccgcgtaatgagataacggggatcaatatcaatgatgattggaagtcgattgtgcgtcagttagtccattcaccacatgggcgagtcgtactgtaccgtgacaagattgacgaagtggtcgggattttgcgtttacgtgaagcctcacgctttatgcttgagaagaacgactttaacaaagagatgctgctgcgcgctgcggatgagatttactttatccctgaaggtacaccgcttaacgttcagctgctcaaattccaacgtaataaagaacgcattggtttaatcgtggatgaatacggtgaaatcattggtttaaccacgctcgaagatattttggaagagattgtcggtgaatttaccacatccatgtctccaagcttggccgatgaaattactccacaaggtgatggcagtttcttgattgaaggcagcgccaatattcgtgacattaacaagagcctgaaatggaagcttcctaccgatggaccacgaaccttaaacggtttgattttggagcaccttgaagagatcccagcgagccatctgagtgtgaaagtggcacagcacaaaatggaaatcctcgagctggaagagaatcggattaagttggtcaaagtttacccaagaaaaaccaaagtcagcttggtttaagttaagcactcaaacaaaagcccgaactcaacttcgggcttttgtatttttaacgtttacagaaccgacttagtgaaccttcagctcattgagcatagattcgggcagcgccaactcatcgttacggttaaccgagatgcctgccgcaatcacgtttttcgcaatcgctttggcttcttcgagcgagtgcatcgccgcagtgccgcactggtactcattcagctcaggaatttgctcttggctttcaactttcaacacatcttgcattgcggctagccatgcttgtgccacttgctgttctgtcggcgcaccaatcaagctcatgtagaaacctgtacggcaacccattggtgaaatatcgatgatctccacttggctgccgttaaggtgattgcgcataaagcccgcgtagagatgctctagagtatggataccgcgctcagacaagatatctttgtttggcatagtaaaacgcaaatcaaatacggtaatcgtatccccttttggggtttgcatggttttggcaacacgcaccgccggtgcattcatacgagtatgatcgacggtaaaactgtctaataatggcatttcctttctccctttctggctcgcttactgcgcaccactaaaactaaattaactcaccgcctgtaggtaggcaaaatattgcgttaggtaagcatcaaaattgagcgtctctttcgcttcaatgtcggcttgggcttgagttgagcggcgcacttcctgctccatctcatcttgtgagtagaactggtattggtgctgtaaattgaccgctcggtactcgttacctaacgcgcagcctgttttacctaagccgccgtgctgtttaatttctgctaggatttgtgccgagagcgtcagctcaggattttcgatccaagtctctagtttggcacacaccgcttggtaggcatcgccgccgagagccgcatccatagtttcagcaatcacacgcagatcggcaaacacacgcttcgcccacgcttgcaaggtcaacacttcaccatggcagccaatttgcagttctaagccaggcttgcgaccttccagtaccactttacgccagttgtcgcgccaacaagccagttcacagccatccataggatcagaatctgacagcgctgtccatgctaagaataggtcgaggaaacgaacctgatcttcattaattccaatcgggctaaatgggttcacatcgagcgagcgcacttcaatatattccacccctgcacgcgctagggcttgcgaaggccgctcgccactttgtgtcacacgtttcggacgaatcggcgcatacagctcattttcaatttgcagtacgttgctattgagctggcgatattctccctctactttcacacccagtttggcaaactcggctgagggggtgcggatcgcttcattcaacccttgcagatactgctctatgctattgaaaccaatttgcagcacactttgcgcgctgttggtgtagcccaaatcgcttagacgcagcgaggtggcataaggcagatacaaggttttaccaatggactcgaacggcagatcggttttgcgaccttgtaaaaaagatgagcagagtgcgggggaagcgccaaacagatacgggatcagccaaccaaaacggtagtaattacgaatgacaccaaaataggccgcagatttactcgcttgacgagcagactcttcttgctcaccaaacaaggcatcccagaaactttctgggaatgaaaaattgaaatgtactccggaaataatctgcatcaggctgccataacgacgcttgagcccttcacggtacaaggttttcatttttccagtgttcgacgaaccgtattgtgccagcactatcccctcttcactgccaacgtagcaaggcatggagagaggccaaagtttttcatcgcccagcttggtctgcgcgaaatggtgaatatccgacatctgcgccagcagagtatcgacttcatgcgagacaggggtgatgaactccagcaaggactccgcaaaatctgtggtgatccaacggtgagttaatgccgctcccagtgctttcgggtgtggcgtttgcgtgagagcaccttccggcgtgtaacgcagcgattcgcgctccaatccacggctaaacttttgaaatacttctggtttgtttgcaactgtttgtagtcgctcggcaaatttactcaaaatacgcttcgcttatgtaggtggttccagtcgcacgccgcctgttaagcgtagtgcttaagcagcatagcgagtttggggcgcaatccgccccactattaaatgtgtactctaacggatgatttcaagctcttctagcggaatgcctaacttttccaactgcggcttgagtcgcttggcatcgcccaccacaataatttggtaatcctcaggattgaaccatttggccgccagctcattgagtgttgagcgatcaacgcttttcactatctcattacgttgctgcagataatcacgatctaaactgtacgtcagaatactggagacaagttgagctttctgcgcgggtgtttcatacatcagcgcatcttgttgaccgacagcgagacgtaaaaatttcatctcttcctcgctcatccccgcttggctgaaatgatgcatctctttgatcatttcttgaatcgcttcaacggtcacatccgcacgtactggagcgttaaatacaatggctccaatctcacggttactggcaaaatagcttcctgcgccgtaggtatatcctttgtcttcacgcagattttggtttatccggctattgaagttacctgctaagttaaaattcgccaattgagttaagtacagctcacctgtggcatcaaaaggaagccctttacgcaccatacggatgatactttgcggcgctcccggcttatccactaaatagattttctgcttagttaacgttggcactacttgtgggttaatcagcggggccgcttcgcctttccaatcggcaataaactgtaactgctgacgaatttctcgcgcactgatatcccccactaccgcaatttgtgcaccatgcggggtgtaatgttgacggtagaattgcttcacgtccttcaaggtcaaggcagagatagaagcttgcgtaccatcaccggagcgggcaaacaaactctccccccataatacttggcgggtggcttgcgatgctaaccagctcggttgctggtgttggtaaaccacgccttgcaacatttgctgctgtaaacgtgcaaaatcactctgtttgaaagcaggtttgagcagcatctcttggctgatttgcaacgtctccggcaagtttttcttcaaactcgataccacaatgctggttgaataggctcccgccacgacttgaatgcttgagccgagcttatccagttgcgcttgaatggcttcggcgctacggttttggctgccttcttgcagcaggctggcggttaagttagccaagccttctttccccatcgcgacttgacgctcgcccgcaggtaattgaatttcaatcagtactgtcggagtttcacgagtttgcgtgccaagcagttgtacgccgttgtcaaaatagacatcgtacagtttaggtaaacgtggctgaaccgcttgtgccacttgcggcatctgcgagcgatcaaagctgtctttgacttcgcgataggcaagctgctcatcaccaattttttgatattccggcagttgacgttccggagtgataaaggttgccggacgtaccgcaaagtccgttttgccttttgccactacactaagtgtcactttcggctggccatccagatagcgagtgaacacctgcttcaccgactctggtgtcactgcgcggattttctctagctgactttcaatgcgatctggctgatcaaaaaaggtttggttggccgccaattggctgactttacctttgacactctctagcgcaaatacagcactggcctcttctgagccgatgatctgttctagacgcgaagcagagacaccctgctgcttaaacttttccagcacttgcagggtttcttgatacagtggggcgagcttacctttggctcccgagggagccatggcatacacataaaaggtacaggcgagttcagcacagtcttggaatgcgcccgcatcaaccgccttttgagttttcaccagctcttgatagagcaggctgttgttgccactgcctagggcactggctagagcatccagtgcgacttgatcctctgcgccccaatattgcgttggccaccctatgagcagcatcggctgctgcacacgatcttccaacgtaataaaacgatcttcactcaaccgtgctggctgcttcggtgcatctaccacatctgggcctttcggaatcgagccaaagtatttttgaacccaagctaaggtttgtttaacatccagatcgccacctatggttaacaccgcattatttgggccataccaacgtaggaaaaaggcttttaaatcattgacatcaactcggtctaaatcactgacataaccaatcgtttgccaagaataagggtgcccttcgggataaagcgcttcacccattttttcccacatcaagccataagggcggttgtcataattctgagcgcgctcatttttcacggtatcacgctggatctcaaacttgcgctgcgaaaccgcatcgagcaaaaagcccattcgatccgcctcaagccacaacattttttctaattgattggccggaaccgtttcaaaatagttggtacggtcgcggttggtggtgccattgagcgagccgcccgcttcagtgatcaaacgaaaatgctgctgatcgccgacatgtttagagccttggaacatcatgtgctcaaagaaatgagcaaagcccgatttaccaatctcctcacgagcggaacccacgtgataggttacatcaacatgcaccaagggatcggagtcatccggtgaaaggatcacggtcagtccattatccaaacgatacttcgagtacgggatcatgactttacccggttcggctttcacctcttcgaccaaggtgacgcctttcggcaaagaagaaaacagcggcaacgatgagtcagaactactgcatcccgctaataacaaaagagaaaatccaaacaacgcgacttttctcatcacatctccttaaaacaaaccgtaatacaacgcagcaagcaatgaataacgcagcgccttacctatcaaaatcatcaaaaatgcagggagtacgtttaaacgcagccaacctgccgctaaacagagtgggtcaccaataatcggcaaccaactcccaagcaacgcccaataaccgtaacgctgcaaccagagcttggctttatgaccttgtttttgtgaatcagttcgatgcggcagccataaacctaacgcgtagttggtcatgccacctaaagtgttcccggccgttgacaccgcaacgatgagccaaaccggatgttgagcgagcgataaactcgccaacaacgccgcttctgagccgcccggtaataatgttgcactgagaaaaccactccagaacagtaagctcagcggcgattcagcaaagagagaagtgagtagcgcagaagagtcattccaccaatctagcatttcatatcaagaagcaacttgcctcgcgtgtgtccggattcaatctgctcatgggcttgcgcggcgtctaacagtgaatagatgtgctgaatttcgattttcagtagcccgacactgaccatatacagcatggtatcgagctgctctggattcggatctaccaacatgcccgtagcttcaaaaccgagtagcttggctttttcgcagataagctcggcggttaacgtcggtacagtaatgacgcgagcgttatcttttaggcatttaagcgcatccaacgccgcctctccccccaccagatcgatcaacacatccacctcttctaaacgctgagagacgggcgcaaattggtaattgatcgcatgagcgccaagcgtggccagatagtctaaattcgcttcactgcaagtggtaaatacttcagtcttagcggcgagtgcaatttgcaccgcgatatgcccaacgccacccgcccctgcaaggattaacacacgttcaccttcttggacttgcgctttgctcaaggcttgcgcggcggtttgccccgcaaggggcagtgcggcagccgcttcgagcgttactgcatcaggaaccaaactcaattcctgctcaggcacacaaacatactgactgtaaccaccaccgcgcaatgggaaaccaataaatcccgccacattatcccgctctttaaggcggctaactccctcgcctaacgccacaactcgtccggagatatcgtaaccgggtgtccacggcagtttgtctttattttgtgctgccgcccatcctaaccccgcccgggttttcacatcgatagggttaacactcgcgaaagcaactttcactaatacttcacccgctttgggggtaggaattggcgcactttgcatggccaacacatccggtgtaccaaattgggtaatgacgattcgtttgttttccatttccactatccctatcgcgcgaataaaaagggatgccgaagcatccctttgaatatataccaatttcttttaagtcgttaactttgcatcgccattttgcgcaaagtgcaaccaactcatgcttaacccactagagccagcaacacacctgccgctaccgctgagcccaaaacaccagccacatttggccccatggcatgcatcaataagaagttttgcgggttggcctctaggcccactttattgacgactcgagcggccataggtaccgcagaaacacccgcagcaccgatcagtgggttgatatcctctttggaaaatttattgaggatcttcgccataatcaccccacccgccgtgccaatactgaaagcagccgcgccgagtgccaaaatacctaaggtttccaaattgaggaaagtctcggcttgcaatttagagccgacccccaagcctaagaaaatggtgacgatattgatcagctcgttttgcgcggttttggacaaacgatccaccacacccgcttcacgcatcagattccccaagcagaacatgccgaccaagggtgttgccgcaggcaaaaacagaatggtcattagcagcaccacgagtggaaacacgattttctcggttttacccacgtggcgtagctgagccatcttgattttacgctcttccggcgtcgtcaaggccttcatgatcggtggttgaataatcggaaccagcgccatatagctatacgcagcgaccgcaattgccccgagcaaatccggcgataactggctggcaaggaaaatggccgttggaccatccgctccaccaatgattgcaatcgacgaggcatcagccatagagaattccatgcccggtacaaagttgagcaaaatggcaccaaacaaggtagcaaaaatgcctaactgagccgcagcgcctaaccacaaggttttcgggttggcaatcagtgcaccgaagtccgtcatcgctcccacgcccataaagatcagcaatgggaaaacgcctgactcaataccgatatggtaaacgtagtacagcaagccaccgggctcggtaaatcctgcattaggaatattggctaacactgcaccaaaaccaatcggcagcagcaataacggctcaaagcctttacgaatggccagaaacagtagcgtacagccgaccaagatcatgatgatctgccctagctcaaaattggcaatccccgtctcttgccatagggtaattaatccgtccatgattttcccttatgccaagctcagcagtgaggcgccaacgcgaacgctgtcgccttctttgacatgcagttcctgaatcacaccactgcgcgctgcacggatttcagtttccatcttcatcgcttctaacacgataagcacatcaccttctgccacttcatcgccttgttcaacttggattttaaagatggtccccgccaaaggggcagcaaccgcttctgcgccttgagtgggtgttgcaacagccagttttggtgctgctttttggccagcgggtaccactgaggtcaattgaccttgtgaacccacttcaacgtcatacaccacgccgtccactttcacactgtagctctcgatacctgctgcaggtttggtgctcgcaggggcggtagccaccggagcgggctctttgcccggcgcaggttcaaacgcctctggattatggcgatttttcaggaatttcaggccaacttgtggaaacagcgcataagtcagaacatcatcgaccttcgcatccgctaaggtgattttttctacttgcgctttttcaagcagctctttagtgagatggtcaagttcatcttgcagaagatcagcaggacgacaagtaatcgcttgtccaccttctaatacgcgtgcttgcagctcagcattcacgctagcaggcgttgcaccgtattcacctttaagaacgcctgcggtttctttggtaatgctcttatagcgctcaccggttaacacgttgatcaccgcttgagtgccgacaatctgcgaggtaggagtcactaacggaataaacccaagatcctgacgaacgcgagggatctcttccaatacctcatcgatacggtgcgcggcaccttgctctttcaactggctttccatattggtcagcatgccgccgggcacctgagcaatcagaatgcgcgaatcaacaccttttaactgaccttcaaacttggcgtattttttacgaacctcacggaagtaagccgcgatcggttcaagttgctccaatttgagttgtgtatcacgtggtgtatcctgcagcatagcgaccacggtttccgtgggcgtatggccataagtctggctcattgaggaaatcgcggtatcaagaatatcaatccccgcttccaccgctttgactgccgtagccgtagataaacctgttgtcgcgtgacaatgcagcgccaaaggcaccgcgcaagactgcttaatacgcgtgattaactcttcggcctcataaggtttgagcagacccgacatgtctttgatacataaagagtggcagccgagatcttcaagacgttttgctaaatccacccaagtttgcgtgttgtgcacagggctcgtcgtgtaagagagtgttccttgcgcatgagcgcccacaccaatcgtcgcttttaccgctttttcaaaattgcgcacatcgttcatcgcatcaaaaatacggaatacatccatgccattgacatgggcgcgctcgacaaatttctcgacgacatcatccgcgtaatgacgataaccgagtaagttttggccgcgcagtaacatctgcattggggtattcggcatcgcttttttcaaagcgcgtagacgttcccatggatcttcgccaaggaaacggatgcaagcatcaaacgtcgctccaccccaagtttccaacgaccagtaaccgattttatccagctcagccgcgatcggcagcatatcttcaatacgcatacgcgtagcaaagagcgattggtgggcgtcacgtaggacgacatcggtgatggctaatggtttagacatgctcattaactccttttaatccttgtaatccagactactgtttcgctgtcgcactgcggtgctgatgcacagccgcggcgattgccgccacgacttgtggactaacggaatcagtgactggttgaactttttgacttttcttgggcgttgcagcagcctcgggtacctcttgcggtatcacacgggacataaactgaacgagataaacgagaagagtaagaaataggaataccacagccattccggtgaccatcagagtggcggcatccaataagagacttccaatatgtgtcatgttgcttcctttgcgtgtcatcctgacattcttcggtttgtgcacattttttgcgcttaacgcagaagaagtgggattatctcgactgaacaataattgtcaatttggttacaagcactcttttagctctggcacaaactggaacaataaatcatcacctgagattgaaaaccagcacaagtgcaaggccaagaggctgctttttgaccgactgaagctaacttagcgcgaaagaggggcaaatactgcgatgaagttaatatagcggggaatatccttcacaaaacaataagttgtagcgcaagggtaaatgaggtgtttgcgaaatgtaaaaaagccctgcattttcatgcagggcttctaatatggcgcgctcgagaggattcgaacctctgaccgcctggttcgtagccaggtactctatccagctgagctacgagcgcgcaatgcttaatgrttcgatacctatatctcagtatcagggcattacccttctctcttaacgagataaaagtggcgcgtccgagaggattcgaacctctgacccgccctggttcgtagccaggtacctctatccagctgagctacggacgcgcaaggcttttgattgttttcacaatccgactccgaacatttcaggaagcttaatagtggccgcgctcgagaggattcgaacctctgaccgctggttcgtagccaggtactctatccagctgagctacgagccgcgcagtgttttaatggttcgataccgaaaatccagtatccagggyattacccttctctcttracgagataaagtggcgcggtccgagaggatcgacctctgaccgcctgggttcgtagccaggtactctatccagctgagctacggacgcgcaggctttgattgttttcacaatcgactcccgaacattcaggagctttaaatagtggcgcgctcgagaggattcgaacctctgaccgcctggttcgtagccaggtactctatccagctgagctacgagcgcgcaggttgtgaactatatcacaaatattttcttctagaacaaaaaaatgaccataggccaataaatggcggtgaggagggattcgaacctcgatacggctataaaccgtatactcccttagcaggggagcgccttcagcctctcggccacctcaccactttcatattccagaagaatatggcgcgtccgagaggattcgaacctctgaccgcctggttcgtagccaggtactctatccagctgagctacggacgcgctgtggcttatcgaaataagcattgcaagaaatggcggtgaaggagggattcgaaccctcgatacggctataaaccgtatactcccttagcaggggagcgccttcagcctctcggccacctcaccgtcttgcggaggcacatattacgatttaccaaaaatatgtcaaacactttcttggtgaaaactcggcaaaacaactcaaccgttggcaaattaaccaaagcgctgagaatttgcactttctaaataaaaacacggggataaacaaaaaggtcggcgttaacggccgacctttcttcgataattagtagttgccagacgcaacgccaccattacctttctcagcttgaatgcgcatgtagatttcttcacggtgcacagacacttctttcggtgcgtttacaccgatacggacttggttaccttttacacctaatactgtcacggtcacttcgtcaccgatcatcagggtttcgccaacacggcgagtcaaaataagcattcttagctccttgagtaatctctgtattttcttgcaaccacactattatccatcaaaagttatgacatcgtaaactctcaatggtgcccgtttaacctaaaaaggtttgttttagaccaaactcttgagggatttccgacgtcacataggtctcgtgcaaaatatttgccgcacgatccacatttgcagggtctaacattagcatagatgattgttccgaggccgagacataacgcacatcgatgccatgttgcgctaaggtctgacgtgcatgggcaactaatgccccggcttgtataccgaccttggtgataaggctcacgggctctgaaccacgaattttatctgcgccgactaattgtagcttggcataagcatcgcgtttaatcacaaatgcactatgggtaggctcatcaatggttgtgcagacttcaatgccgagcatttgacactgcttgatgatgcttgggaaagattcactctccactcttatcagcgccatatcgcgctgaagagcaataccacatactgcgtgagttgcggcactgcctttaattaaactgccttggttcacttcaaaggtagagagcactctgagtggcacggcatgcttccaagcatactgcacgcacggtaggtgcaacacttttgcgcctttgcgcgccatctcttccatggaaggaaaatcaatcacatccagcttacgagcacttggtacaatgcgtggatcacaagtgtatatcccatcgacatcagtgaatatttggcattcgtcggcattcagtgccccagccaatgccacagcactggtgtctgagccaccacggcctaacgtagtgatatccccattttcattaatgccctgaaaacccgcgactatcacaataaaatcttgttctagcaactcggtaatcgttcgagtatcaatatgtttaatcgtcgcgtcattgtgttgattgtccgtcacaatattcgcttgagctccggttagtgagcgggcggcatagcccattttgtgcagtgtcattgccactaaggccattgacacctgctcaccagcagagagcaaaacatcaagttctctagcgtttggtacgctatctacttgttgagctaaacccaccagtcgattggtttcccctgccatggcagagaccactacgacaacttgattgccatcattcttcgccttaatgatgtgttcggctacggtttgcattctttctattgaacccaccgaagttccgccgaacttttgcacgataaggggctttttcaccagtattcaccttcccaagaccaaagtctcatcgggatcaaacttgtttaacttacatgtcgaacaaggtttgatcgttaccaaaataaaaccaagcggctaattggcttagtctatatttgcgccaattaaaccacttggtagaccagataaaattacgctcaatcaacaaatattgattgagcgtaatctatttatcactgttatagacgctcggcaatccaagcgtcgacagactctaaggccgatggcagagcgtgagcatctgtccctccagcttgagccatgtcagggcggccaccacccttaccaccgacttgtagtgcgaccatgttgaccagctcacccgctttgactttattggtcaaatcgttggttacgcccgcaattaggccaactttgccttcagccacattacccagcatgatgatgccgctgcttaattggtttttgagatcatctaccatgccacgtagcgctttgttgtctgcaccgttgagctgcgcaaccagtacgttaacacccgcgatctgcttaacttggttgataagacccgcgctctctttcgccgccagcttatctttcaactgttggatctctttctccagcagtttggcttttgccgccatttcagacactttggcatcatgctgtgcttgctgtgcatcgaggtaatctaatgcgccttcaccagtcaccgcttcaatacggcgaatacccgcagcaataccaccttcagagatgatcttaaacagaccaatatcacccgtgttgctcgcgtggataccaccacacagctcagttgagaaatctcccattgagagcacacgaacttggtcgtcatatttctcaccaaacagcgccatcgcacctttcgctttcgcttcatcaatattcatgatgttggtttcgatactgtggttacgacgaacttcttggttcactaaacgttctacttctttaatctctgcagcggtcatcgcttccagatgtgagaagtcaaaacgcagtgtttcagcacgcactagagagcctttctgcgccacgtgttcacccagcactttacgtagtgcagcatgcaacaagtgagtcgccgagtggttcagcgaaattgccgcacggcgcttttcatcgacgatggcatccacctgatcgcctgtcgccaatacgccttgggcgatcacaccgtgatgcgcaatcgcgttacctaatttttgagtatcttcaacatggaaaatacctgcgtcggttttcaaaacgccagtatcgccgcattgaccacctgattctgcgtagaatggcgtgttgtctagtacgatgatggctttatcaccagctgacagcgtagaaacttccgcgccctccacgaacatttcgcgaaccacactttggccacgactcgccgtgtaaccgcagaattcggtattggtggcggatttgatcagcgaattataatccgtaccaaattggccagcctcacgagcgcgttgacgctgctcttccatcgcttgttcaaaacccgcttcatcaatgctaaagccacgctcacgcgccacatcattggttaaatccgcagggaagccgtaggtgtcgtagagtttgaagacggtttcaccatccagcacttggcctgatagttgatccagcgcgtcattcagaatgctcatgccgcgatccagcgtacgtccaaagttttcttcttcgatacgtagcactttttcaaccagagcttgctgctttttcagctcaacgcctgcagtacccatcacttccgccaatggtcccaccaacttgtggaagaatgcaccttgcgcaccgagcttattgccatgacgaacggcacgacgaatgatacgacgcagtacataaccacgaccttcgttagacggcatcacgccatccacaatcaaaaaggcacatgaacggatgtgatccgcgacaacgcgcagagactgattagtcagatcttggtaaccaattgcgtctgcggctgctttgatcagcgtttggaatacgtcgatttcgtagttggagtgcacgccttgcatgatcgcggaaatacgctcaatacccatgcccgtgtccacagacggcttaggtagcggctccatcgtgccatccgcatgacggttgaactgcatgaaaacgttgttccagatttcgatgaaacgatcgccatcttcctcaggtgagcctggaggtccaccccaaatgtggtcaccgtggtcgtagaagatttcagtacatggaccgcaaggaccggtgtcacccatctgccagaagttatccgaatcgaacttcttgccaccttttttatcgccgatacgaataatgcggtcagcaggaatgccgacttttttattccaaatatcaaaggcttcgtcatcggtttcataaaccgtgactaacaagcgctctttcggcagttgcagaacgtcagtcagaaactcccatgcatactggatcgcatcttctttgaaatagtcaccgaaactgaagttacccagcatttcgaagaaagtgtggtgacgtgcggtgaaaccgacgttttctaggtcgttgtgcttaccgcccgcgcggacacaacgttgagcggtcgtggcgcgagtgtaggcgcgcttttccaagcccaagaaacagtctttaaattggttcatccctgcgttggtaaacaacagggtcggatcgttagcaggcaccagagaagaactttctacaatttggtgacctttgctttcaaagaatgagaggaacgcgcggcgcacctcatccgtgctcataaacatgcagctcttcctgaaatactcaagttagaattttgcgctattgtaaagcaaggataacagttcgcctagtttcttctcttccgcaaactgaatgtgtggcgagcggcagctcaaccaagatgcataaaatccagagcgagattaataagcggaatgtagagggtgaaagcgattactcatcactctcactggcttgaagcgcataacgaatttgctcaaagttgaaaccacggtactgtaagtaccgaacttgtttggcgtattgcgagcgctcgtggctgatgccgcttttgaatttcttgtgtgcgacctctttcgctagttcaaaccaatctatcgtttgctcggcgagggcttgctcaatcacctcttccgcaacccgcttttctttgagttgctggcgcaaacgctgctcaccgtaacctttatgaacgatttgtcgagcctgactcgctgcgtaacgggcatcactcaaataccctagctctaaaacgtacttcacaacctcatcaatcacttcagcaggatgacctttgagggctaatttttggtatagctcatattcgctatgatcgcgacggctcagaagttgtaaggcactttgtcggcaagtggctaagtcgaaactcatggaactccctattaggctaacggtgagttttgagtcactcactcaattggcagccaaaaagaagccctgcattgcagggcttcatcaacatcgagattgagaggctgaacctctttgcattcagcctgccgagtgataggtaattgtgtcgaaatcgggtcgacgctgatttgtcatgttggggtttattatactgttgatttgtacagtgtccacccctgtatagaaaaaagtttggctcagttaacgttttgaacctgatctgctgcgagatgctcaatcaagctttgcaacacatgcgctatggcttgctgacgcacttgttcgcgatcacccgtaaagtggcacgtttccactttgagccaaccttgaacactagcaaagccaaagcagacggtgccaactggcttttctgcactaccgccaccggggccagcaatgccactaatcgcagccgctagcgtagcctttgaatgcaagagcgcaccaagcgccatctcttcaacggtctgttcagaaaccgcaccaaattgttgtaatgttgcttgccgaacaccgagcatttcttgtttggcttcattactgtaagtcacgaaactacgatcaaaccatgccgaacttccggccacttcagtcacccaataagccacaccaccgccggtgcaagattctgcgctagcgaggatctgctgctggttagccagtagcccccctaactgctcactcaaggaatgcagtgttttcatacgcttgcctctcgcttctgtttcattgtgtcactagtgtttcattttgctcggtaaaactgcaggctaaactaccgaattagacgttaattgcaatcgtcccaaatagaaagagtgcccttgggcactctttctcggtctaatttcaaccctcgtatttcaagcatcagatttcaaacatcaaactacccggagccaagaatggccagcgtaggacgctcgggctactttgcccttcactggcaaagaaatagcccacttgtggtgtggcgaagacttgatcgccgcgactcaagcgcttttcgcttaaagagcgatgtgaaagtttggcttcccacagctcttggctttgccaaccgacagacgctaactcaacgcgcacttctgccccaaccgggttaatcgagaccacttcaaacggcaatgaggcttggctgttctctttatctgacagcgccaactcatggctgcgcacatacagcaaaccactttgacgcgtcgcgtcactctctggtggctgaataaaggcagagccattgacccactggccattttgccactcacccgcaaactgattaacgttcccaaagaaatcaaacacaaagcggctattgggctgagcgtaaagctcaacgggtgaatcaatctgctcaatgcggccattactcatcaccaccacgcgatcggaaagctctaaggcttcatcctgatcgtgggtcacaaacacgctggtaaaacctaactcgtcatgcaggctacgcagccaacggcgcagctctttacgcactttggcatccaaagcgccaaacggttcatccaacagtagcacttcaggttgggtggccagtgcgcgagcaagtgcaatacgctgtttttgaccaccagaaagctgctctggataacgatgcgccaaatggccaagctgtacgatttcaagcagttgcttcacacgcttttgaatttccgccggatttggacgctgagcacgctccatcacctgcaagccaaacgctacgttatcggccaccgtcatatgacgaaacagcgcatagttttggaacacaaagccaactcgacgatcgcgcacatgcacattcgttacgtcacgatttcgaaaatgaatcgtaccggaatccgctccttccaaaccggcaataatacgcagtaatgtggttttgccggaaccagatggccctaacaaaccaatcatttcaccatcttcaatcttgagagaaagcggggcaagcgcctgaaactggccaaaatgtttagagatattatctagacgaatgctcataaggttccctgctcattatgctcgaccgcctgaaggcgctcttgacgccactcgaccaaagctttcagtaatagtgttaatagggcgataaacgccagtagcgaagcgctagcaaaggccgcttgcgattgataatcctcgtacagaagctgtacatgcaaaggcaaggtattggtttcaccacgaatgttgcctgaaaccaccgctaccgcgccaaactcccccaccgcgcgagcattggtgaggatcacgccataaatcagcgcccacttaatgttaggcagagtgactcggcgaaacagttgccaccatgatgcgcccaaaatcaccgcggcttcttcatccgaacgtccttgctgctgcataagtggaattagctcacgcgccacaaacggacaggtcacaaacacagtcaccagtacaatgcccggccaagcaaacatgatttgcagatcgcgctcatacaaccattcgcccaaccagccactagtgccatagagcagcaggtaaagtagccccgccaccaccggagaaacagcgaacggaatatcaatcaaagtgatcaaaaacttgcgaccaacaaattcaaagcgggtcactagccaagagagcagcacaccaaacaccagattgattggcactgtcagtagcgccaccaccagagttaacccaatcgcgtggcgcgtatcggggtcattaaagtaactaaaataagcgctaataccgttggcgaacgcttgttggaaaatgctcagcagtgggatcagcagcagtacggccaccaataacagagccaatgcgatcaaactccatttcacccacggcttttcaccgacacgtaaaggctgagagtgtgccataaactgattcctatcgtccgtgaatgctacgcagataagcgccttgccagaggttaatcatcagcagtaacaaaagtgaggtcagcagcacaaccgaggcaattgcactcgccgctgggaaatcaaactcttgcagacgcacgaagatcattaacgaggtaatttcgctgatgtagggcatgttgccggcaataaagatcaccgctccgaactcccctaaactgcgcgtaaaagacaacgccgttccgaccaataaagcgggtttgagtgaagggagaatcactttccaaaacacagcagcgtcggatgcgcctaacgtcatgcccgcttcttcttcttcacgggaaatttcttctaacacaggctgaaccgtgcgcaccacaaagggaatactggtaaaagccatcgccacaataataccaagtggcgtataagcgaccttgatgcctaactcagcaagtacactaccaatccagccattggccgaatacagcgttgccaaggtaatcccagccaccgcggtgggcagcgcaaaaggaagatcgaccagcgcatcaagaatacgtttgccgggaaaagtgtaacgcaccaacacccaagcaagcagcaaaccaaacaagccattaaacagtgaagcaatcaaggccgagccaaccgtcactttataacttgccaccacacgagggtcggcaatcacttgccaatactcgctaaaggtcatgttgctggtctgcatgataagcccagtggcaggcagcagcaggatcaagctgacaaacagcaaagagacaccgaggctcaacgcaaaaccgggtaaaacccgttgctggcgcgggcgagagtgtgcaagcgtttgacccataaaacctctttcgatacatcagggtggaattaaggttgcccatccattgggcaacctagagaaatgtcagacaagattagcggcgcagcagttgatccaatttagccccattggcgaactgggtttgcatcgcttgctcccagccaccggcgatcccttccacagtcagcaattcaacggcgggaaaacgctcagcaaactcagcttgtaccttggcatcgtgcacacggtagttaaattctgcaagcaaacgctgtgctggctcactgtacaggtatgaaacgtattcggtcgccacatcataagtcccattacgttttgccactttctccactaccgcgactgggaattcagccaaaatcgaggttttcggcaccaccacttggtaatcatccgcaccgtattgctgacgaatgttattcacttccgattcaaaggtgatcagcacatcgccaatcccacgctcaacgaatgatgtggttgcaccacggccgccagtatcaaataccgcgacgttagccagaaacttcttcaaaaactcatcttgctgcacttggttatcctgaccaaattgtttttgtgcaaagcctagcgctgccaagtaggtgtaacgcgcattacctgaggttttcgggttcgggaacacacttttcacatcatcacgtaccaaatcactccaatcttggatgttctttgggttgcctttgcgcaccaaaaatgcggtggtggagtaataaggcgagctcgcgtttggtagcagggtttgccagtttgctgggatcagcttgcctttgtcgtgcagaatttgcacatcagtcacttggttaaacgtcaccacatctgccgctaggccttgcagaatagaacgcgcttgagccgatgatccagcgtgcgactgtttaatttcgaccgtcttccctgttttttgttgccaatgctcagcaaacacagggttgtaagccacaaacagctcacgagcaatatcataagatgagttgagaatggtttgatcggccgcagaggcttggaacgagcctgctagcagtaacgccgttaatgtcgatttaattcggttcatgttgttctactccagaatcacaagtgccaagatggcttcctttatgctgctagattatgaggaaaatcgtttataaaaaagaacattaatagaacgttttggaataatttctagcaataaattgtatgccgaagataaagtcgttcttatactgctgacatgaaaataacgccgcttgcaaagagtcgtcttacgcttgcgccgtcaatcaacagaagctttatacccaaacaacttggagttgcaggtaggcggcaagtgagtgagtccccatgagcatagatagactatgtgattggggtgaacaaacgtagccaacaccgctgcagcttcaagtaggaagggtatatcggttgtcactattagaatagaaggatcgctctgtgtctgatttccccactcttgaagattatgtaggtcaaacgcccttggtgcgtttacagcgcctcaatgcaggccgctctacagtattggtgaagctcgaaggcaataatccagcgggttccgtgaaagatagaccagcgcttaatatgattgtgcaagccgaagcgcgcggcagtttgcagcccggcgataccattattgaagccaccagtggtaatactggcatagcgttggctatggctgccgccatcaaaggctacaagatgattctgatcatgcccgataacgccactcaagagcgcaaagattcgatgcgcgcctatggcgctgagctgattttggttagcaaagaacaagggatggaaggcgcacgcgatttagccttacagatgcagcaagaaggcaaaggtaaggtattggatcaattcaataacttggataaccctgacgcgcattatcgctcaaccgggccggaaatctggcagcaaagccaaggcaaaatcactcattttgtttcaagcatgggcaccacaggcaccataatgggcgtctctcgttatctgaagcaacaaaatccgcagattcagatcatcggcttacaaccctcggaaggcagcgcgattccgggtattcgccgttggccgcaagcctacctccccggcatttttgatgctgcacgagtcgatcaggtgctggacgtaactcaaactgacgccgaacagaccgctcgcgcccttgcgcgtgaagaaggaatttgcgccggcgtcagctctggcggagccgtgtttgccgctttgcagattgcccaacaaaatccgggatccgtagtggtagcgattgtgtgcgatcgtggcgaccgttatttatcctcaggattattttcctaaccgagctttccgacactcggcttaggctgagtgtcgaaaccggtttgacttggtatccatatcacgctccctacgcgcttttcggtaaacctcttgcggcgatggcctgatgagccttaaggtcatcaccatgcaaagcaagagctcaattgccccgccctagtcaggtttgctattctctgtaaccgtttttaagtgacccatgcccgccttgtgatgaaatgccgcaaggcctgcacagatgatgataagcagcgacataagattatgatgaaatcgaacgcctcaccgagcgagtctctttcgcaccacaccccgatgatgcaacagtatttaagactcaaggcggaaaacccagacattctgctgttctatcgcatgggtgatttttacgaactgttttatgacgatgccaaacgcgcctctgaactgctagatatttccttaaccaaacgcggcgcatcggcgggtgaacccattcctatggcgggtgtgcctttccatgccgtggaaggttatttggcgaaactcgtccagatgggggaatcggtcgcgatctgcgaacagattggcgatccagccaccagcaaaggccccgttgagcgcaaagtagtgcggattgtgacaccgggaacggtgaccgatgaagccctgctctcagagcgagtcgataacctgatcgcggcgatttatcaccataacggccgctttggttatgcaaccatggatatcacctccggtcgttttcagctcagtgagccgcaaaccgaagaagagatggccgccgagctgcaacgcacttcgcctcgtgaactcttgtttcctgaagatttttcgccagtgcatctaatggcaagccgccaaggcaaccgccgtcgcccgatttgggaatttgaactcgataccgcgaaacagcagctcaaccagcaatttggcacgcgcgatctggttggctttggggttgagcaagcaaaacttggcttgtgcgcagcaggctgcttgatccaatacgtcaaagatactcagcgtaccgctttgccacacattcgttcactgacttgggatcgccaagatcaatcggtgattttggatgccgcgacgcggcgcaaccttgaactcactcataacttggcgggtggaacagataacacgcttgcagaagtactcgaccattgtgctacccccatgggcagccgcatgctcaaacgttggatccaccaaccgatgcgcgataacgccactctcaatcagcgtttagatgcgatcactgagctcaaagaaaccgctttgtatggggaactgcatcccgtgctcaaacagattggcgatattgaacggatcctcgcccgtctagcgctgcgttcagcgcggccgcgcgatttagctcgcctacgccatgccatgcagcagttacctgaattgcactcggtcatgagcgagcttaagcagcctcaccttaccgagctacgcacccatgccgagccaatggatgaattgtgcgatttactcgaacgtgcgatcaaagaaaacccacccgtggtgatccgcgatggtggcgtgatcgccgatggttacagtgccgaactcgatgaatggcgcgatttagccaatggcgcaaccgaatttctggaacgcttggaagccgaagagcgcgatcgtcacggcattgataccctgaaagtgggttataacaatgtgcacggtttctacattcaagtgagccggggtcagagccatttagtgcctccccactatgtacgccgtcaaaccttaaaaaatgctgagcgttacatcatcgaagaacttaaacagcatgaagataaagtgctcaattctaagtctcgtgctttagcgttagaaaaacagctgtgggaagagttgttcgatttgctgatgccgcatcttgagcagctgcaacaactggcggcttccgttgctcaattggatgtgctgcaaaacctcgcagagcgcgcagaaaacttggaatattgtcgcccaacgctggttcaagaagcgggcattcacatccaaggtggtcgccaccctgtggtagagcgagtaatgaatgagccgtttatcgccaacccgatcgaacttaatccacagcgacgcatgctgatcattactggtccgaatatgggcggtaaatcgacttacatgcgtcaaaccgccttgattgcactgatggcgcatatcggtagttatgtgccggctgaaagtgcgtcaatcggcccactagatcgtatttttacccgtatcggcgcgtccgatgatcttgcgtccggccgctcaacctttatggtggagatgacggaaaccgccaatattttgcacaatgcgacccgtaacagtttggtgttgatggatgagattggccgcggtaccagtacttatgacggactctcgctcgcttgggcgagtgccgagtggcttgccaaagagattggtgccatgacgctgtttgctactcactattttgagttaaccgaactgccgaatgtgttacctcatctagcgaatgttcatttagatgcggttgaacatggtgatggcatcgcctttatgcacgcagtgcaagagggtgccgcgagtaaatcgtatggtttagccgtagcaggactggctggcgtacccaagcccgtgattaaaaatgcgcgcgccaaattacaacaacttgagctattaagctcacaacctgccgagactcgtaagccaagccgcgtcgatattgccaaccagctgagcttaattcctgagccgagtgctgttgagcaagccttggcaggcgtagatcctgaccagctcactcctcgccaagctctagatatgctctatcaattgaaaaagctgctctagttattgcccatatctcaagcatggaatctacagattccagaaacaacaaggcaccccaccgggtgccttagttttggatgagtctggaaaaattagttgtcgtattcgacgttaaacagcgcttccatattcaaaccttgtttcaccaaaatctcacgcagacgacgtagaccttccacttggatttggcgaacacgctcacgagtgagattgatctcacgacccacttcttccaaggtcgatggttcatagccaagaagcccaaagcgacgcgcaagcacttctttttgctttggattaagttcatccaaccagttgagcagcgattcacgaatgtcatcatcttgagttgaaaactcaggatcggcattgtgagagtctggcaaaatatccagcagtgccttatctccatccccaccaattggcgtatccactgagctgatccgttcgttaagacgcagcatcttagtgacatcatcgacaggtcggtctaactcaagagcaatttcttctggtgtaggttcgtggtcaaggcgctgtgataattcgcgagcagtacgcaaataaatgttcagctctttgacgacatgaatcggtagacgaatggtgcgtgtttggttcatcagcgcacgttcaatggtttgacggatccaccatgttgcgtaggtagagaagcggaaaccgcgttctggatcgaatttctcaaccgcacggatcagaccaagattaccttcttcaatcagatcgagcagtgctaatcctcggttgctgtaacggcgtgaaatttttaccaccagacgcaagttactttcaatcatgcgtttacgtgcggcttcatcaccacgtaaggcacgacgagcataaagcacttcttcttcggcagtaaggagcggtgaaaaaccaatttcgctgagatacatctgggtcgcatcaagacttttcgcagaagcatcaaactcttcacgaacgtcttcacttgccccttcaacagcaactaattcttcatcactggtgagctcggcatcagtttctagcacttccagtgcttcatcttcaaaatcgaactcttctactttggttacggtattgctgacactcatagcggcctccccctggcaactttgcgagtcattgcgatttacaacctttgcagtatgaccttagcaatatgagttaaggtaagtagcgtttaggattcactgacttcccttgataacggatctcaaagtgcaagcgtacgctgttggtaccagaacttcccatggtggcgatcttctggcctgcttgcacagtttgtccttcctttgctagcagctgatcattgtgggcataggcacttaaatagtgctcattatgttttatgatgattaggttgccataaccacgtaatgcgttgcccgaatacactacggttccatctgcagtagcaacgacagcctgaccacgttggccagcaatgtctatccctttgttgccttgatcgcccgcagaaaagttctttatgactctaccttttgtcggccatagccacttcgctatcttctcatccgaaggtttagcttttgctacattaacattaacattttgtttaccgacaggttcaacatactcctttgtttttgtttgatcaaccgtcttaactggatcttttttagtcaaattttgactattcgttgacccattttgtacatttttggtattagagcttttgctcacggtttgagcaactgttgccgtcgtcgccgctttggcaacacttgcacttgtgcttgaagccacagccacggtagctgcaccgcccgttccaccataagcaggaggagtataattaggtaaccagagcttaattttttgcccaggatgaatggtgtaaggtggagcgagatcgttgtaactgatcagatcatttacatctttatctgtgaggtaggcaataaaatagagcgtgtcgccttttttaacttcatagtaacttccgcggtaactaccacgctcaactttgttgtaatctttacccaatccagagactggtgctggcgtaggtgcagtacagccgaataataagctgcaaaacaataataagcccagtcggaaagagtaaagcgtcatcaggcaagatctcccgcgaccagtggcacaaaacgcacagcttcaacccgctcagagataaactgcccaccttgacgcacaattttgtacagatattgctcgtcttcgcccacagggatcaccatacgaccaccctcagcaagctgatccaatagactttgcggcacttttgccgcagcagccgtcacaaggatcgcatcaaaaggtccacgagcgggccaaccttgccagccatcgccatgtttcgtcgacacgttatagatatccaactgtttcaagcgtcttttcgcatcccattgcagggttttgatccgctcaacagtaaacacatgattaaccagtttggcgagcactgcggtttgataaccagagcccgtaccaatttctagcactttggtttctggggttaacgccagtagctctgtcatcttcgccacgatatagggttgcgagatggtctggccttgacctatgggcagggcattattgtcataagcttgatgcatcatggccggtgcgacgaaaaactcgcgtggcagtgcatggattgccgccaacacttgtggtgaggtaatcccctgctcagttaaaaattgaatcagtctgtcggcttttgggttagccattcaccttttcctttaaccaatgatccatgctacgcagtgactcatgtgccgttaggtcaacttgtagcggcgtgagtgacacccagccacgttcaatcgcatgaaaatccgttcccggaccggcatcttgctctttacccggaggaccaagccaataaatatcatgcccacgcggatctttctgctttatcatgctttcggcgtgatgccgcgcacctaagcgtgtgacttcaataccttgaatgagttctaaaggtcgatccggaatattcacgttaagtaagcgattggtcggaatcgggttagccagatgttgctcgaccaattgacgcacaaagtgagcagcactagcaaaatgagtagttcccgccagagaaaaggcgatcgactgcacgccaagaaaatgcccttccattgccgccgccaccgtaccggaatagagcacatcatcacccaagttagctccgtgattgattccgctcagtaccagatccggtagcgcgtctttcatcagttcattaagcgcaaagtgcacgcaatcagtcggggtaccttgcacggaataggtattctcggcaatttgcgacactcgtaatggatgctctaaggtcagtgaattcgaggcaccactgcggttacgatccggcgcgacaatcacaatctccgctaaatcacgcaatgcatccgccaaagcatgaatgccttgtgcgtaaacgccatcatcgttactgagtagaatcttcatcttaatcttcgctctctgaatcgcggctctcttgttcatggccttgatcgtaatgacgcaccactgggatctcttcgatcaattcacgcactaaggaagtggcaaagctacccgcatccaatgagaaacgcagagtgatttgatcttcttgcacttgccagcttaagttttgcgcttttaaggcgatcgcacggcgatcatggcgcatacgattcccccggatcagcgccattaaatcgggctctgcatccaattcagcttgttccagtggcaaggcttgaccagaagtcggcaaggcattatcgcccgccaaagccgctgaaatcgctacttctccagcttgcaaacgctgatcccaaagggctaaatcaccatcaacattaaacatttgctgctcagctaaagcgatatcaccttcaataaagcgggcaaaacagccctgctcaattcgctttgagacaatctggttgaaaatccacgaacgagccgcagacagatataagctgcgctgattctgattgcgcgaacggacattgtcacgcccccaacggcgcgcctcactgaggttattgccatgacgtccaaaacgctggctaccgaagtaattgggaacgcccaattcagcaaccgtttctaaacggcttaataccgctgcaacatcgcttacttccgatagggtgacgacaaattcattgccttgcaaatcacccggacgaagctttttgtcgtggcgagtcacctcaagaatttcaatgctagggtattgtgctagaaacgcagagaaatccggcgtttcgccattcggcagatgcacactcaaccactgctcggtaacggcatgcctgtcttttaaacccgcccagctcaccgcgcgtgaaggtacgccacaggctttggctaattcattggccacaaagctggtgttctcccctgtcttacgaatacgcaccatcaagtgctcgccgtgtcccgttaaggagtagcccaacacttcattgacttggaagtgttctggcagcgctttgagtttggccttcgcagtcggtttaccgcacaaataagccagaggagagagaatatcagtcatcttaattccaaaattttttataggctgagttaagctttgcgcaaaagtacaaccgcttcacaggcaataccttctttacgtccggtaaagccgagtttttctgtcgtggtcgctttgacattgatgttgcccagatcggtttccagatcttcggcaatcgccgcgcacatcgcctgaatataaggggccattttcggcgcttgggcaatgatagtgacgtccgcattaccaagcacataaccttgcgccttgacacggcgatacacatctttgaggagctcgcggctgtctgcccctttccatttatcatcggtatccgggaagtggcggccaatgtctccggcagcaatcgcgccgagcaaggcatcacttaatgcgtgcagtgccacatcaccgtcagaatgggcgatcaatccttgttcataagggatcttcactccaccaataatgatgggaccttcgccgccaaaacggtgtacatcaaagccgtggccaattctgatcatgatttttccttattacgacttaaatagaactcggccaacgcgagatcttcaggttgagtaattttgagattatcggcacgtcctgccactaaagcaggcttttcaccacgccattcaaaggctgaggcttcatcggtaatcgtgacttgctgctgtaaagcggcgaataacctctcacgcagtgattgggcacgaaacatttgcggtgtcagcgcatgccagagcgcagtgcgatcgaccgtatgcacaatctgctgtaagtgatcgccacgtttcatggtatcccgcacgggcgaggccaaaatcgcaccaatcggatgagctaaagccgtggtgatgagctgagtgatatcggcgtgagtcacacacggacgcgccgcatcatgcaccaatacccattcactgaggcgatgctggcagacatactccagtgccgacaataccgaatccgcccgctctttgccgccatcgacacgaatcacacgcggatgatgcgccagaggcaaattcgcaaaataggggtcatcagcactcaccgccactaccacgtgttcgatgagaggatgttctaaaagatgttcaacggtgtgttcgagcaccgttttatcgagcaaggttaaatactgcttagggcgatccgcttgcatgcggctacccacacccgcggcggggacaatcgctgtcatgttgttcattggcgcgactcctcaccgatgatgcgatagaaggtttctccatctttgaccatacccaattcgttacgggcacgctcttcaatcgcatctagcccttggcgcaggtcatcaatttcagcaaacatctcttggttgcgtaggtgaaggttggcattcacctgctgctgcacttcaatttccgcttgtacagcgcgaaaatccatcacaccgtttttgccccacatcagggtataaagcagccagaccaatagcaggcttagggtcaaagcaaatactcgcataaccaatccatctttctttcaaaaccaacgccacaaaatcgtggcgttggtcacttgctcgaatgctgcctatttataccataaagcctagaaaaggcgcttgctggcaggtgattattgagttaataaaaacgcaaataagcctacaccaagcactaagcgataaatcacaaacggggtcatgcccatacgagagatgagcttcaggaagaagtgaatacagatgtaagcactgataaatgaagtgatgatgcctgtcagtaagaaaccgctgtgtacgggttcaccactggtcaccagtttcaatccgagataactgcccgccaatacgataattggaatcgacattaagaatgaaaaacgcgccgccgcttcacgggtaaagccaagatagagcgcagcagtgatggttgcaccagagcgtgaagtgccaggaataatagccacggcctgcgccaaaccaataaacagcgcttttttccaatccgcttgatattcgtcggctttgagctctgcatgtttatcgacataccagagtaaaaggccaaacacgatagtcgttgtcgcgataacccaagcgctgcgcaaatagagctcaacaatatctttcatcacaaaaccgaacagacaagccggaatcgtagccagcacgatcaaccacgccaatttggcttctttgctgcgatcacctttaaaaatcgaagcaaaaaaagcacttaataacgaaaccacttcttttcgaaaatagagcacgaccgcggcgagcgttcccacgtgtaccgccacatcaaaggccaagccttgatcttcccaacctaaaatagccgaaggcaagatcaggtgtgcggagctagaaatcggtaaaaactcggtaaagccttgaattaaagccagaatgaacgactcaaaataactcatgattgtttcttctcgttaatagaaaaccagatcggtactggggtgagtgatgctaaatcctgcgcttgttgccaaatctgctcaacagttcgaccatcaccagcaatcactcgctgcggacagagctcatataaaggttgaatcacaaacggatagcgatagatatccggtcgaggcagcactggatcattctccgatacacaatcgccatacagcacaatatcaagatccagtgttcgatcctgatacttttgtgcattcggcaaacggccacaacgcagctcgatcgcttttaactgcttcatcaattcaggcagcgcgagctctgtctccatctcaaccatcagattgaagaaaggatggctggcaaacccaacggatggacactcataaatcgtggacagacgccactggctcgccagctcggctaatgcacgaaggccagcttcaatcgactgatggcgatcctgatttgagcccacaccaatataagcggtgatcatccacgcgctcgctcgatgatcacgccgactcctttggcttgcggcactgcgcccggcttggtcaagcggatgcggagccaaggcacagcaaagcgagtcatgatcagttcagccacttcttcagccacacgctctaccagtaaaaaacgcccttgttcgatatgctccagcacagcttggctgacttgggcatagtccagagcatccgctacatcatcactttttcccgctgcacggttgtcgtgcgccatttccagatcgagcaccaatttctgcttgatctgctgttcccagtcgtagaccccaatcgtcgtgatcacttccaactgttcaataaacactttatccatgctcaatcgcttcctgttcacaggtcggatacccaaaccgatgaaaaaatcgtactatccgctcaatcgcgatatgatatacccaaacctgttcaagatgctaaatcctaaaagattttttcttattcaacagggaatacaaatacttattcgagataacttttcgaaacacgcagtttgaggctgttatgactccattggcgctcagcatgatcatttttgcctatctactggggtcaatttccagtgcggtgttgatttgtcgtgttctgcgtctccccgatccgcgtaacgtgggctcacaaaaccccggagccaccaatgtactgcgcatcggcggcaaaaaagccgcagtggccgttttattgtgtgacatgctcaaaggcaccatcccagtttggggcggctacttcctcaatattgaaccttttatgttgggattggtggcaatcgccgcctgccttggtcacatgtacccgatttttttccatttcaaaggtggaaaaggcgtggcaaccgcgttaggtgcaatcgcaccgattgggctcgatttaaccgctatggtgatggccacatggcttgtcgttgtcgtactgtttcgctactcgtcgcttgcagccttagtcactgtgttgctcgcgcccctctacacttggctgattaagccacagtacacgcttccagttgccatgttgtgctgtttgattgtgctgcgccatcatcaaaacgtgaagcgcctgtttgcgggtaccgagcccaaggtcggtgaaaagaataagaagccgagcgatgatgaagagagccgcgtcgtgtaaccgtgcgcggctcaataggtgatcgccatttcatcaatggcagaaaaatcaatatacggttgctaagaacgtttgcaggtggtgtgtcaccgattctgcctgctccaaactactgatatgtcccgccccttcaatcacttcaagttgactgcctcgaatcgtatcttgcatcaggtaagactctaacgctgggcgaggagtatcttcactgccgaccatgatgagtacaggcagagttaagtgttcgatctcatccatcaaatcacgacgcccgaaaatcatgcgccctaaacgcgccacttcaacagcacgctcgccgctcaaaccttgcagagccgagcgaaattgcgccacaacaggcaactcgtttttcaacgtgttagatgcaaaaaacataggaacaaccgcctccacaatcggagcgggcaccgcttgcagctgagcaatggtatctaacatggtaaagtattttttgtgggtcacttccggttcaagacccacgaaagtatccatcataaccagagattgaactcgctttggcgcaagtaaggccagctctgcgccccacattcctcccaccgacaagccaatcacagagaaatactcaatctgcagatgatccatcagcgccaacatatgctgagcgtaatctttgagattgctcatcgcagtaggggcggcctctgaagcgccatgcgcccaaaaatccggcacaatacaacgatagcgttgacttaacgcagccacttgtggagcccacatttggtgatcccacaaatagctgtgcccaaagagcaacacttcgccttccccgacatcaaggtaagccattttttggccatcaatcagcatcgaattcattttagttatttatccatcaataaagtagacgctgactgtaacatgagatgccaagcagacaactctgagcagaaattcagcattatctaattcattcttttgtttagaaaaaacggccactagcgcgaccgtttcaataccatttcgtcgtacttatttctgaattgacgttaactgatcaatcggccaacgcgggcgagcttgcaagccaagttcacacacatcaccatttttcaaacgttgcatgcccgcataagcgatcatcgctccgttatcggtacaaaattcagtacgtgggtaatacacttcgccaccgatttttttcgcgagtttttccaaatcagcacgcaactgcttgttggcactcacaccacccgcaatcaccacacgcttaagtcctgtctcctccaatgcgcgtttacatttaatgactaaagtgtcacacacggcctcttggaaggcgtaagcaatatccgcacgggtctgttcatcgtcgccatttgcagcaatggtattggcagtaaaagtttttaaaccggaaaagctcatatcgagccccggtctgtccgtcataggacggggaaatttaaagcgtcccggagtccctttttccgccagcttggccaataacgggccacctggataatccaatcccatcaatttggccgttttatcaaaggcttcgccagccgcatcatcgatagactcacctaaaatgcggtattcaccaatgtttttcacttccaccagcatggtgtgaccacccgataccagcaaagcgacaaacggaaacggcggcggattctcttccagcatcggagcaagaagatgcccttccatgtgatgaaccggcaccgctggcacatcccaagcgtacgctaaactgcgcccaatcgtagcgccaaccaagagcgccccaaccaaaccggggcctgcggtaaaagccacaccgtctaaatcttgcggcgtcacgtttgcctctgccatcgccgctttgatgagtgggatggttttttttacatgatcacgcgaagccagctcaggcaccacaccaccataatcggcatgcagttttacctgactgtaaagcttatgagacagcagtcctttttcgtcatcgtaaatcgcgatacccgtttcgtcacaagaggtttcaataccaataatgcgcatagttttctcagcacgctgccatctaaaatcaaatatgacgtcatgttacctcgccttggcgcgacaaacaaaccttgtccagaatgtaagcgacaaagtgctttacaaaggaaggacgatcggattaaaattccgcaccattttgatctggctggttatcgacttggcgcacaagggttcttgctgctctggtcatcaaaatatcagcattaacgaattaacccccgaggtgaaaggcatatgccagtagttaaagtacgtgaaaacgaaccgttcgacgtagctctgcgtcgtttcaaacgctcttgcgaaaaagcaggtatcctttctgaagtgcgccgtcgtgagcactacgaaaagccaactaccgttcgcaaacgcgctaaagcagctgctcaaaagcgtcacgctaagaagctagctcgcgaaaacgcacgtcgcgttcgtctgtactaataacagcttcctaaactaaggaatttgttatggctctgattgagaatctcaaagaagagcaaaaactagcgatgaaagccaaggataaaccacgccttggcgctatccgtttagtgttggccgctattaaacaacgtgaagtcgatgagcagatcactctgagcgatgacgacattgttgcagtgctgaccaagatggtgaaacagcgtcgcgactctgtaagccaatacgaagcagcaggtcgtcaagacttggctgatgcggaaaaagcagagatcaccgtacttgaggagtttatgcctcaacctctgagcgatgatgaagtgaaagccctgattgacagcgcaatcactgaatcagccgccgcaggcatgcaagacatgggtaaggtgatggctgtacttaaaccgcatattcaagggcgtgcagacatgggtaaagtgagcggtttggtccgcgctaaactggcttaatcccaacccaattacagcaagccgtgcaatcctttggaaagcacggcttgtttgtatttgaccctatctttcggtgcatgcaaagatttatggcaggacacatcccccgcagttttattgatgacctccttgctcgactcgatattgtcgacgttattgacgcacgcgtaaaactgaagaagaaaggcaaaaactacagcgcctgctgccctttccataacgaaaaaaccccttcattcagtgtcagtcaggaaaaacagttctatcactgcttcggctgtggtgctcatggcaatgccatcgattttgtcatggaatatgaacgcatggagtttcctgaggccattgaagagctggcgtcgaccataggtcttgaagttcagcgtgaagaaagaacgccttccagcccctttgcgaaaaatacgccagccgtcaaaagtgaagataagcgcagcctgtatgacttgatgggcagcatcgcccagttttatcgtcagcagcttaaagttcctgccaacaagcatgcgattgaatacttaaaaaatcgtggtttatctggagaaatcgtccagaaatttggcattggatacatagcggatgaatgggatcttgtacggcgcaattttggtcagcagcgcagcagtgaagatatgcttgtcaccgcaggtatgctgattgaaaacgataacggccgccgttatgaccgctttcgcggacgagtcatgttcccaattcgcgatcgtcgaggtcgagtcattggttttggtggccgtattacagagcaaggtacaccgaaatacctgaactcgcctgaaaccccgattttccataaaggcaaagagctgtatggcctttatgaagtcctgcaggcataccgtgaaccaccacaaatcctagtggtggaaggctatatggatgtcgtggcactcgctcaatatggtgtcgattactctgtagcctctctgggcacctcaaccacaggcgatcacttacaactgttgtttcgccaaactaaccatgtcatctgttgttatgatggtgaccgagctggacgtgatgccgcatggcgcgcattagaaaatgcactcagctacctcaaaagcggcaatatcttaaagtttctgtttctgccggacggtgaagatcccgatagctacgtgcgtaaatacggcaaagccgattttgaacaacaggttgccaatgctacaccactgtcgcagtacttatttgagaacttgattgaactgcaccaaattaacttgggtagccatgaaggtaaatcggcactgcgcgccgttgcaacaccacttatcgacaaaattccggatccttttttacaagagatcctagagaaattactcgatgaacggacaggctttgatcaccaactgcgccgtaaaaaagcacgtaagacagaaaatcgacccgcaccacataaagcaataaaacggaccccaatgcgtgatgttatcgcgctcttgatacaaaatccgagctatgctgaattggtaccagacctagcgagcgtgcgtcatttgatgatccctggtctcgataccttcagtgaagtacttgagaaatgtcgtcaatatccccatatcactacgggtcaattactcgaacattggcgagactcaaaaaatgagacacttctgtctcgtctggcaagttgggaaattccccttgtcgaagacaatcaagaagaactatttttagactcattggacaaaattcttgcccagtgcgtagaaaaacaaattgaaaatttgcaggccaaagagcgaagtgtcggtttatcaaccgaagagaaaagagagctacaagacttgatcttaaaaggcttgaaagcgtaactctgttgagatagtcagcaaagaataaatttgttagtatacgtggtttgcattgcgcatacttattccttcaccagatacgaagttggataccgtctatggatcaaaatccgcagtcacagcttaaacaacttgtccttcgcggcaaggaacagggctatctgacctacgccgaagtaaatgaccacttgcctgctgaaatcgttgattcagagcaggtggaagatattattcagatgattaatgacatgggcattaaggtggtggaaaccgcacctgatgccgatgatcttgccctcagcgatgatactaccatcactgacgaagatgctgctgaagcagccgccgcggcactttctagcgtagagagtgagattggccgcaccaccgatccagtacgtatgtatatgcgtgaaatgggtacggttgagcttttgacacgtgaaggtgaaatcgatattgccaagcgcattgaagatggtattaaccaagttcaaagtgcgattgctgagtatcctggaaccatcccttatattcttgagcagtttgatcgtgttcaggccgaagagctacgtctcactgacctgatttcaggtttcgttgaccctaacgacatggaaaccgaagcgccaaccgcgactcacatcggttctgagctttctgaagcggatctcgcggatgaagatgatgctgtcgtcgaagatgaagacgaagatgaagacgaagatggcgacggtgaaagcagcgacagcgaagaagaagtcggtatcgaccctgaactggctcgtgagaaattcaatgaactgcgcggtaagttccaaaacctgcaattagcggttaatgaatttggtcgtgacagtcatcaagcttctgaagcgtcagacttagtgctggatatcttccgtgaattccgcctaacaccaaagcaattcgaccacttggttgaaactctgcgcacttcaatggatcgtgttcgcacccaagaacgtttggtaatgaaagcggtagttgaagtcgcgaagatgccgaagaaatcgttcatcgccctatttacaggcaatgaatcgaatgaagagtggctggataaagtccttgcttctgacaagccttacgtagcgaaagtccgtgagcaagaagaagagatccgccgttcaattcagaaactacaaatgatcgagcaagagacatcactgtctgttgaacgcatcaaagacatcagccgtcgtatgtcaatcggtgaggcgaaagctcgccgtgcgaagaaagagatggttgaagcaaacttacgtctggtaatttcgattgctaagaaatacaccaaccgtggtctgcaattcttggatctgatccaagaaggtaacatcggtttgatgaaagccgtcgataagtttgaataccgtcgtggttataaattctcaacttatgcgacttggtggatccgtcaggcaatcactcgttctattgctgaccaagcacgtacgattcgtattccagtacacatgatcgagacgatcaataaactgaatcgaatttcgcgccaaatgctgcaagagatgggtcgtgagccactgcctgaagaattggcagaacgcatgcaaatgccagaagacaaaatccgcaaagtgctgaaaattgccaaagaacccatctccatggaaacaccgattggtgatgatgaagattcgcatctgggtgattttatcgaggataccaccctcgagctgccactggattctgcgaccgcaaccagccttaaagctgccactcgcgatgtattagcaggcctaacacctcgtgaagcgaaagtgctacgtatgcgtttcggtatcgatatgaataccgaccatactctggaagaagtgggcaagcagtttgatgtaactcgtgaacgtattcgtcagattgaagcaaaagcactgcgtaaactgcgtcatccaagccgctcagaagttctgcgcagcttcttggatgaataattcaagttggttatgaactgaaaaaggtgagctgagctcaccttttcttttttatacaagctaagtgaataaattgtaagcactattgaacccgctttggctagacacatctacccccttccaatataatctgacacctaatttggccccttagctcagtggttagagcaggcgactcataatcgcttggtccccagttcgaacctgggaggggccaccactttctcttctacatatgtctaccaacgtctatctaccccagtaaaatcaatacttagcaagcaatctttgtctatagctgtcgatgctcatcttgtaacatccacgttttaatgtaccatcgaatgtaccaacagctaaatatcgactattttggtggtacatcatggcaaaaagagtagtccctttaactaacacccaagtaaaacaagctaaagaatccgacaaagaatacactctctctgatggtgatggccttcaattacgtgttaaaacgaatggcacaaagttatggattctgaaatacactcatccaataaccaaaaaaagaaacaacataagctttggttgttttcctgatgtctctcttgccgaggcaaggaaaagacgttctgaagcaaaaactctcttagctctcaatatcgacccaaaacagcataaagatgaacagctcttaaaagaaagagcggagcttgaaaatacctttggtaaatattctgatagatggttgacactcaagagagagagcgtaaagccagaaacagcggataaagcttatcgtgctcttgagaaacatatcctacctaaacttgggaatgtccccattcaagacatcaaacccagaacggtactaagtattcttgagccagtaaaagcacaaggaactctagaaacagttaaaagactatgccgtataatcaacgaggttatgcgtcttgctgtagcttcaggtgacattgaagtaaactacttagcagacatcaccaagctctttccggcccctaaacgccagcatatggtaactatcgaaccagaaagactaccagagctcatgcaagctatagcaaatgcaaatattacactcgctacacgatgcttacttgaatggcaactgcatacaatgacaagacctatcgagagtgctacagcacgttggcaggatatcgactttaaaaataaggtatgggtaataccagcagaaagaatgaagatgaagcgcccccatacaattccgcttactgagcaaactttggcacttttggaaataatgaaaccaataagtagccatagagaatacatttttccaagtaataaaaatccaaagagccatgttaatagccagagtgcgaatatggcgctaaagagaatggggtataagggacaattggtctctcatggtctaagagcattagcgagtacaactcttaatgaacaaggtttcaatccagacattattgaagcagcactagctcatgtagacaagaatgaggttaggaaagcatacaacagagcagagtatctcgaacaacgcagaaaactcatgagttggtggagtagccatataacctcagcatctaattgcaatacatctcttgctgaaagaaaagtgcttaagctagctggttagtagtaataaacaattctaaggccattattcccaaccgaacctgacaccttagtaaaaaatagctgttaccttgtatcataaaggtaacagctatttttttgataaaacactaacctagattaacattaatattcaaggatatctaaccttcgcatgctcgaagctataattttcaaaattaagaaaacctattcacaagatcaatcttaattttttcagattaaaataaaaaaacctacaaaagtcgaatccatgttagagtaaaagtaatacaaatagattaccctcatatgaaatcaataatcaaagtgatatatttacacacttatttatatagttatgtttcactaaaatagttattagtgtgataaatttaaccaaagactatactatttaacttctttcattaaagttcgacactctgaactccattctatggcatccatatacaacttacttaatccaccatctattttaattttatatttatttaaaaaatctaaagcctcacaccatttagcattctggtatgcttcagaagctgatatgacatcacctagtattccggctcgacataatacggcatctcgcatatcgttagatattggaaggcttgataataactcactattatcatttggcaagaatagatgactaagcgatagcatacctgaaataaatgccattgagctaagtttatgatctatttcacccatcattagttcacagaattttgctcgtgttaaaacgtaaacatatttatccaagtcaagtttatcatgtatcgtagaactgcaaagtagaaaaacaaacattcttaattgttcaagacctagatatacaattgcatgctgaatagatgaaataggttttaatggctttccaattgtgttgacatacttcaataaccctaccgtaagcttaggatttcggattaaaattaattccaatctactagggttaaaatctcttttaattacttcgataagcagctcaaaagactcagtatttgcatactcagttgttgcacacctgagaactttagggcgatcgagatagaaaccttgaaacaatagaaaaccattttttttaaggctctctagctgttcattggtttcgactttctcagctaatgcaatacaacaaataggtttaaggctgaaaaacaacttgagaaaatcgtcgtctatacggcgagtatcgattttaacaaagtcaaataatgatagataatcatgccaattttcaaaaacagtacgagtaacatcatctaacgcgaataaatatcccttttctcttaatccccgaataacggaaagcaacttttcagtaggaatagtattctctagtacctctataaccaccttatctttaggcaagatttccgcgtagccatctattagcaaatcttcaggaaagttaataaaacatagcttatcagattcaaccactctatctatagtatcatcaacaaactgttgccaaatgattttttttgtggctaaactttcagaaacaccttcaggatatctatttttctcactattcctaaacagcaactcataaccaacgatagttaagttctcatctgtaatcgcctgttttgctatgaaactatccatgcagcaccaccgctattaacaataatattactataactagcaaaccaatattaactaatcaaaccaacacagttaaactctaatcttgaatcaacaaaacgcctcatattttaaactcatttaataattcattttgttcttttactttgctaacctgagcgttcatttcagttcctgcatttgatgctgcttcagataattttattgaaagatcttttatattaactgtattattatttatttcttcggcaactaagctttgctcttcagccgctgaagctatttgtaaattcatatcagaaatacgatgaatagcctgttgaactagcgatattttctcattaacttgatttgttttttctacaacaatatctgtttccagtttgctctcatccatagaacgagaaacgtttttggcaccttcttgaagttgttcaataatctcactaatttgcatagtggactgctgagtacgctgagctaaggtacgaacctcatcagctaccaccgcgaaacctctacctgactctccagctctagccgcttctattgctgcgtttaatgccaacaaattagtttggtcggcaatatcatttataacatcaagaactgtttctatgcggtctgtagctttcactaattccttaacatcttctactgagctaccaatcctaatagaaagtcgctgaattgcatctgtcgtttcatggacgacagagctcccttctaaagatgcactttcgccttcttttgcagcgtccgctgcaacttgagcactatttgcaacctctgaggcagtcattgccatttcattcatcgcagtagccagttgttctaactcctgaagctgttgctccacaaccaagcgagaaacctctgcttcattggccgttttctccgctccatcaagtacaccactagctatagtctttaattgtctaatctgactccccaacatctcagtaaatgaattaaaccccaatgctaactcagagaattctttatcaagatttgtatcaagttttttagttaaatctccaccaccagaggcaatatccttaattgctgagtctaaagttttaagcggcgacattagtcttcgtagtatgaaaactaaaattaacccaccgaaaaccaaaccaattgcagaataaaatataagctcatacttcattttatttatactttgcattgcaatgctttcatctataacagcgataataaaccagtccccacccaaaataggactagtatacaaccatttattaaccccatttacggaaagcactacctttcctttatctagtctgaacccattatatatatcctttacatttttacctaattcatctgtatttgaatgtataattaccttacctgtattagatgtaataaacacatagccagcttcaaacagatttatatcgtctacgtttttttgtatcctagacagatccacatcaaaatacatagccccaataaaattattcattgtatcagcaactggggagctaattgatactaaaaagttttttccttctgtatccagatatggctcagttataaaaatacgtttatttttctttgcttcttgataccatcccctactccttggatcataatcatcctcaggttcccaattaggatcattttctataactttaccattactatcaaaaccaaaccctgtagaaaggaacgctttttttattgcattaccattaataatgtcattgatatactgttcatcgcttatgcgtaaagaaatactatccacaattgaactagccaaactaatatcgctttctagttttaatgaaacaaatctttctgttttattaattatttcatttataccatcttctattacaactgaaacttccttcttcgcagttgtgtacccttcccaaacaacaaatgctacagtcactaataagataaaagaagatataaatattaatttttttacaaaccctacattcataatataataacctcatattttttattcaaatttcctgacagttccataggtgtaacaccatacttttcaaaaaaataatttgaaaacttacttttagattggtaacctacgatcatagatacataatctatatctaaatttttggtttcaataatttcctttgcaacatccattctgcattccctgacaatattcttaaaggttgtattacattttttcagtcgtctaataagcgtggatcgacttatgttaaagtataagcaagtattctttatcacttgttcttctggtaataaacttaagagataatcatacactctatcatctgtaccgagaaatgtatctttgttttctctatagtcgaacattgtatgtaataaaccaaaatcttttaaatacttataaaatatatcgactataaactctcttcctaacgcatcaaattttaaatcatttatataatctagcattacaaccatatttttaaaattggaattaacactgaaacnnnnnnnnnnnnnnnnnnnnnnnnnnnnnnnnnnnnnnnnnnnnnnnnnnnnnnnnnnnnnnnnnnnnnnnnnnnnnnnnnnnnnnatattatcgcaagatttgtttgttattctaattcttttatttttattgaatgccaatataacaccagaagtaagaattctagactcatttctatataatacttcacactcacctttttcaatccaaattatgaatggctttttaaatgttatatacttgacgtcattttttttattattaactttaataatacgaaacatataacacctcagaaccacatcaagtaaaactttatttatattatattacaatccatttatcgccttaaccacacccaaaagtatcaacagaaaagcaaaaccccaacaactgatacttagacccataatctgattaaaatcttttcaagtttactctccatccagacttactagaaaagatctatattccattgaataataacaactctcggaattataacgttatgttataacataacacttaaagacttattatctttgtggataataaatatattmcatggtactttaggttcaattattatcgcacacgctaattgggttaatttaatacactttatttatcctaaacttaccgagtaagttttttattttaatctcagatattatttcagtatttatattctgtatttttcataaagtatctcatgcattataaatgattactcggctccttccttcatttttacttatacaaagccttatcagccttatcaagtagtgatcctaaattgtctttttactcataggagcatacccacgctaacagtaaaatatatgaggttactaacgatataaattgggtatatctgtaatcattgaagatgcttgatttctcataaaatcaggctcatttcagtctgaggcatccatatcggaactattaggtatctgacggtttcggattaacaagccgtaggtaacacctttaataccttatttcttatcacgagtggtcaacttgggcttttctacgataaaaaccgagccggtaagcaagactcgataatactttgtccattgctcaaaactggtgacacttgcgcaggccgaactaacaactatccacctacatggttatcaagtcagatactgtagtggcatagtgaatttggtcacttagttagaggtgatatcatcacctcataagttaacaggtgacattatgacaaaacgtacaagacgactatttagcgcagaatttaagttagaagcagcgcagctagtcttagaccaaaattactcagtgacggaagcagcccaagccatgaatgtgggcaagtccacgatggataaatgggttcgccagcttagagaagaacgccaagggaaaacacctaaagcttcacctatgacccctgagcaaatagaaattcgggaattgaaaaagaagctggctcgccttgaagagcataatgaaatactaaaaaaagccacggctctcttgatgtcggactcactgaacaattcttgataatcaagaaactcaagcagagccacagcgtaaaaatattatgcgaagtcttcaatgttcatcgaagtagttatcactattggcttaaacgcccagcgttaattaatgcggaaacaataaaactgcgcagcttgattagcgaggctcacgccgcaagcaatggctctgcgggagcgagaaccattgcagatatagtcacaaatcagggtgtaaagctgagccgataccgagcaacaaagctaatgagaactcttggtttagtaagctgccaagaaccaaagcatcgttacagaaaggcttcacaagaacatattgacgttccaaatcacttaagtcgtcaatttgctgttacggctccaaatgaagtctgggctggcgatgttacgtatatttggactggtaatcggtggatgtatttagcggtcgttatcgatctttttgcccgcaaagtgatcggttggtcaatgtctttgtcgcctgatagtcggttgacaggtaaagcgctgtctatggcctatgaatctcgcggaaagccaaaaggtgtcatgttccatagcgatcaaggcagtcattatactagccgtaaataccgtcaattactgtggcgctttcaaataaaacagagtttatctcgccgaggaaactgttgggataatgcgccgatagagcgcttctttagaagtctgaagacggaatgggtgccaactgtgggttatcgtagcttcgctgaggctcaacaagagatcacccgctacattatcggatattactgccaactcaggccacatcagtataacggtggtctaactcccaatgaatcagaacgattatattgggaaaactctaaaaccgtggccaattttagttgaccactacacctctaggtattcgagaacgagaccatcctcaaagtagtagagtggtttcccattgaaggttctgtcatgagtgatagtgtgggctctttgatgagccacgttgagttgatgagtcatgattggttcctgtggtttgttgtgattcccacaggaactggtactaccgttactttttaagctacttatgactatgaccgaaattattcatacgctttccaaaatgcttcgttcttcgtttcgctagatagctcagtcgataaaagacagattgaaacacctccccaaactcctctgagttccgtagcaagtgatactgaccttgtttggagaaatggatagctggtttctctttacctgagtacatggcttccactgaacgcttccatgcattacgaatacggttagccaaactttgctgatactctccaaaatcccccagagagcgaaagatgttccggtcaaagataagtgcaacgtggtaatgactgctcgttgaggtatcacattctttagcccacacataacgaatagtggtctctcgatagggtttgcgatttaaccgagcactacgtcttcgatatgccgctacctgagatttcaaagagcggaagaaacgagtcatcactgctgaatcatcccctctaaagtctgttggtaagttaaggtccactcgaacgataaaaagtcttgcgtattgctctagagcgttctcaaggactgactctatcccttctaggtattcaacgaccaaaccctccttgtcgatgtataccttgtttccgttgaaagtggattcgtgtgtgatggttaaatttttagacataatagagacctatgttttgttaatgacataggtactgatagtgacgttattttctaagtctctctttgggtaggggaacccatcccctaccaagatatcgagtgatgaggtcgttggttgaggtgtgggattagatgagtagatgggtatatatattattaattaccgatccacctcgatttgctctccacctattttttgatgattactgagccatcacatcggctaaatccaaccagctaaccttcatttttttatcaaaaatcacggctcatgcatttttacttctggagttcactcacataaaaagtgaaaaaaataacttaaaatatccagatatatcatcggattacacattaccaaacgtaaattagagtaaaagtcatgccatcaatcgacatagatgaagatacatcagtagaaactacaaccatgacggaaacaccaacactcgatctgaacgctaaagtggaaatcatcaatttcattaacactttcgatgttaaagggaattgttatctataccatgaaggggaagaaaagctggtttcgacacttctccgacctgatgatagaaagaggattagcctaatgaaagagctagaagaagctcgaaccataaggcaactccataagactcgcctattcaaagatcacccatttctaaaaaaacaaaagcggattattctgctaccgtattcttcaatttcaaaaagccatatgcaaacgagtcactattccgagagagagattaatcgaacaaaaatcatcaacaccttttggaaaagcaagctcgaactgcattatgatgctgcggaagcatcgattctggtttgctcatttttagcccaaaatattgatcgcaatacccacggtttagggataagccaaagcaagattgcgattgtattgggaatgagtcttcgccgagtatcagatactttaaatcgacttgagcaactcggttatgtgagacgatatacagaaaaagccaaacgtgggaaactaagtcttggcacttttatacaggtaacagaaaatttttcgtcacaatttttgcccccaaaaaagatcgtgggagagtctgaggaaaagcaaaaacagggttctgagcatcaaccacaagacccccctgagaagcattattttcaatttttgcaaagtttgaacgatctacgactggaattaaagaacttcatcgtgaatagtgaagaaccaatacctcctgtcgtcttacagcagatttttaaagttttgtagtctctttaaagagacaagcaaatcgttggtggttagcttggtaggtatcaactcatccacactctggaagccacaatcacaccgacaaaactattaataaacaacaatcatggaaacttcatcgagcggtctatctaagccaaaaacgtgacataaaccagtaaattcataccatttaagtccatttttgttgattttccttcacaaaaatatagagaatcgagttgctattggtatgatttcataagaggttgaatgaaagacaacagtacaagtgcagtttcttcttggcttggttataaaatacaagaatataggcttacccaaaggcttttagaggctaacaatagcagttgtattgggtttgagatacttgacgacttggaagaacacacaggtagtacatcaacttttgaacaagataaaatttcaacaacaggacgaaatatagtcagcaatcacagcaaagacttatggaaaaccttatcaaactggatggatcttatagattcaggggaaatcgatgtagataacactatcttccttctttttactaataaaagatgtcacagtgaagtgctgcaattactgtcgacatcccaagcaacagaagaggctagcaaagccttcgatgaaattctgaaaattgtatcccacccctctccatctattgccaattatctcaataacttttcaaaatccaaaacagatgcatgcagattaatttctaagtttacatatatctacggttcaggttctgctcctcatgatttacgagagtcatacaaattacatcggttaggtgctctagaagaacatttagacgaaataatgtatgagatcctaggatgggtcagcgatgttctaaccttagcagcagagaaaagacaaccaaccatagtcagagccaaggattttggtgctcgacttggagaaattgagagtaaatacaggcagaaaactatcttaaactacttctgtaatagaagtagtgagagtgaggatgtacaaaatacgatcaaagatgctcccaattatatcaaacagctaaatttaattaacgttgatgattctgagctagaggaagcagccatagcaaatttagaaacaaaagatgcagttgttgaatggactctaaatggcgatgtacaagattatagctatcgatactatcaaagagaactacgtcgctgctggggaatccagaaacaaaaaattcatttagactttaacgggcgtcctgaaactgaagtgggacaaaggctatatatcgagtgcttaaacaatgtgactcgttactatcttgagaacaaaaaggttggcgatttttttgctcacggtacccttcattcaatggccgataagctaactataggatggcatccagaatttgataaaaaacttggagatccagatgcttaaacctgaaaataatttagaaaaagaagcatgggaaatcaataatccggcgatgtgtagttatatgctttggatagctaccttagcttactatcaaaaacaaaaagagccaattcacccaagcagactattctgcctattcccatttattttgtactcggataccagaaacgtactattaagttcaaaaggttcgctaaaatcctacttagccaaattttcaaactctaaagctatttcaggagatattcccctatccattcacttccgaattgatattcaaaagaataagaccttagacgctctcatagttgcatttgattctgggttgcttgttatagatagtgattcaggattaattaaaccaaacgtttcaataaagcctctacccaacagtaagctaacagatacgataaaagaacttgtctattgttcaacaaaaattgggcgttggttatcagaaatgactaatcaagatctagctcgagatttaaaggtgattttttagatgttttttcaaatagaaaaggttgttctttggtcaaaagaagctaaacataaaccacgtgtgattgagtttgctttaaataaagtcaacttaattacaggctcgtctaaatccggaaaatcctctctcatccccatcattgattattgtttaggatcgtctaagtgtagcatccctgtaaatactatacgagatacaacagcatggtatggtgtacagataaaaacaaaacactctcggctacttatagcgagaagggatccaagtaatcaactgtctacatcgaatgctttttttgttgaagctgagaatattgaaatacctcaaaacatagaaaagcataacgtaaacattgatacggtaaaaaatagactaaatgaaattagtggcgtatctaatattagttttgatttctacgacaccggacgaatagataaaaaaagaaccagtactagagatttatctgcatttaactatcaaccgcagaatataattgctaatccaaatgcactattctataaaacagattctttcgagcataaaagtaaactagtcactatacttccatatgtgcttggcgctctaagtaacacagatatagagaaccaacatagaattaagaatcttgaagaagagtatagaaaagttgaaagaagactcttaaaacttaaacgtcaaaacgaagattggctttcttctgcgcaagcatatgttataaaagctatggaactaggactagtcaatagtgataaggatatataccaacttaagccagaacgacttttaaacgtactcaaaaatattgcaacaaaagagatcgactactcaactagcgcggcaaacataaagtatgcctcagaacaagaggctgaaataaccaagcgttctcgagatatttcaaataatttggcaaaagttaaaagccgcctacagaatattaattctatgaatagattagccaatactcactctgacgcatctcgtctaaaaagggagcgactatctttgagcaaatggcttcttacccaaaatgacataaactcttctcttttttctgagccaaatgagattagatcattggtattagaacctctagctagggctttttccaaccttgaggctgagcttgaggtaccgatacatgtacaaggagcattaagtagagaaaagatctacctagaaggtgaattaactcgcttggcttcagagatgaaagatgtaaatacacagctgaaaattttgagaggaaacaagcgaaaattaggctacgatgctttctctgttggaaagtttgttggagaagtcgaaaaagccctaagcttaatgggtgaatcagagagtgagagtgaactatctaaagaatacaaacgactcaaaaaagagctgtcagtcttaagactaaaaattgatcctagagagtttgaacgcaagacaaaactacagcttgcgaaagttaataaattagcgagtgactggctccctcatttagacactgaaaaccccaatgctcctatatcccttcacgaaaaggagctcactataacagtcaacagcagtggccgagaggattacctttgggaaataggcagtggtgcgaactggttgtcctaccatgtagccataactttagcattgcaccaacacttttcttctctggaagcttcccctgtaccaaactacattatatatgatcagccaagtcaagtttatttcccgagtaagcttcgacaccaagcgactcctgaggaagatgagctagctttacttgagcaggatgaagacatcgtacaagttaagaagatattcgaagcgtttaatggtgcaattgaaaagacaaaagataaccttcaaataatagtattagaccatgccccatcgacactagtaaaaagtattcctaaagggcacctagttgaagaatggcgcaatggaataaagcttattccgctggattggctataaagctaaacgcaaggctatcttacaagttgtgcgactataatactccgaactaaaaatcttgtgagtcttaatgaatacacataaaaaagatagccactagctatctactagggcaacaaaacaaaaaggttataaaaaaggcatatatatgaaaaatcaatataagtaaattttcttttcattatatagagaacccgatgtaccactaaatgtaccaacagataaaaccaaaaccaataaattcattatttaacaatacattaaaggaaaatattgagtctgggagggcaccagattccagaaggttagtaggcctagtgcttactaaccttttttgtacctgacgaatttgggtcagacaatgggtcaagtaagcttatccttaacgtttctgaacggtttaagacggcactctaacccaccattttatgctctagaaatggcaacgggagcataagctcccgtctattccagatcagcaaatcaaaggtgtaatgttgttttgattagttgcgttttacccgcctaaacaaactagcattaaaattcctcgtgcatcacactttttgtacaaattgtgagcaaatggacttatttctgaaattgtcacataaatttcagcttattttcactgcctatcaccaaataccttgcggtgactgttcaaggatattccgcgcaacaaaaagctcatcagactgtcgcgattttgcaatatgtagcctctagcctcttggtaaaccatcacataagaggttgctatgctttctacttctccatttgttctgccacgaaaaaccccatttggtttaggtgaacacttagcggaatgggcaacaggactgaaacgtctcaatcaattctatgctcaacgtccagcaagcggtgatactcaagcgtttttgcgctttaccttggatgttcttggtatcgattatcaagtagtacgcggcaagctcacacatgttccagctcaaggggcaactatcgtggtcgctaaccatcctttaggctgcgttgaaggggtgattttggctgagctgctgctttgcgttcgctcagatgtaaaaattctcgctaatcagtatttaaagctggtgcccgagcttacctcactatttatcggcgtcgatgtgtttgaaggtgccgatgccgcaaaagcgaatctgcatgcccttcgtcaagcgcataaacaccttgagcaaggtgggttgctactgatgtttcctgctggggaagtctcccaattggttgacagcaagcaaggtcgtttggaggacaaagagtggagccaatcggtcagccgcctcgttaaaaaacatcaagcgcatacggtcccagtttatattgatggccataactcaacccctttttaccttgcaggaaaaattcaccctatgctgcgcaccttgatgttggggcgcgagctgctcaataagcagcatactcaaattggtatcgcgattggtgaggggatttcacacagcgaagtacagcatctttgtgatcaacagttggtcaattatctgcgcctcaatacctatcttttgcaatcttctcccgtgcgcaacaagaccgccagtgatcgatccttgcctcccgttgcagagcgccttccattagccgatctgctcgaagatatcgcgcagttgccttacgccgaccatatgctgcgccataaccaatttgatgtgtattgcaccacagcggataacattccttcgttgatgcatgaaattggccgcattcgcgagttgaatttccgtgaggtgggcgaaggaacgggctgtgcgctggatattgatcgatttgatcgcgattaccttcacctattcatttgggatagagagaaaaatcagctggtgggcgcataccgtttagggctcgttgataagcttattgagcacaaggggatcagcggcctctactccagtaccctatttcattatgatcaacgcttcctcaataacatgggcaatgcgattgaaatggggcgttcggtgattgacagccaatatcaaaaaagcatggcggccctgcttttgctttggaaaggcattggtacttatgtcgaacgccacccacaatatacccacctttttggccctgtgagtatcagcaacgattacagtgaacaagccagacgtttactcgccgataccatgactctgcattattacgatagtgaacaagccgagttagtgatggccaccaaccctctacctacagggcaagcacaatggaatgccagccttttgacgtcacttgccgacttgcaactcctgtcacgagtgattgctcggatcgatgaaggaaagggaattccggtgctactacgccagtatctaggattaaacggaaagctggtgagctttaatgtggatcctgcgttcaataacgcactagatggcttgatcgtagttgatcttcgcaatgtgcccacgaaaaccttagcgcgttacatggggcaatctgaagctctgcgctatcttgccacccaccaatatttcagcgatatctaacccatcacgccaaggtgcttcatcttggcgtgacccatcaaacatttctggaatcaaaataaaatgctatcgagtcaaaatttcctctcaatatcgccagtttgatactgactagtcattggtatcatgcttcatttacacgcaaagttagtatttcagactaaaacactcctccccttctgccacccttgatgattgactcttttttcagcaacttagactctacagcttcaataacgataacaatgaggaagttatgccaatcacaacctatttaaataaaagccgcatcatgctggcccttgtcctgagcacagttttaggaaccgcgcaggccaacgaaccacccgtttataaactgacgctggccgaaacgtggggggcgaatactcctatcctcggcgatgcaccaaaaaacatggcgaaattggccgctgaaatgtccaatggccgcattcaaatccgtatcgactcggccaacaaacacaaagcaccgctgggcgtgtttgatatggtgaaatccggtcaatacgatctcggtcactccagctcttattattggaaaggcaaggttccgaataccctctttttctcttcgatgccgtttggcatgatcgcaactgagcaatacgcttggttctattatggcggcgggatgccgttgatggagaaggtgtacgcgccgcataacctcttgtcgtttccgggcggtaactcagatattcaaatgggcggatggtttaaaaaagagatcaacagcgttgacgatctgcaagggctgaaaatgcgtattccgggatttgcgggtgaagtgttggcaaaacttggcgcgaaacccacgaacattgcaccgggggagctttatacctcgctagaacgcggcaccatcgacgcactggaatgggttggcccagcctttgatctgcgcatgggctttcataaaattgccccttattactacaccgcatggcatgaaccgggctccgaaacgcaatttttagtcaataagaagaagtgggatacgctaccaaaagacatccaagtgatcttagaaaccgctttccgcgtcgccgctttcgatatgtacaaccaagcgatcgatgcgaatgcgacgagctgggcagcgatgaaaagtgagtacccagacatcaaagttcgtgattttccacccgcagtacttgccgcactacgccaagccaacaatgaacttctgcaagagcaggcagcaagcgatccgctcgctaaagagatcatcgactctcagcaggcttacttaaccaaagtgcgtgattggactcggatctcgacacaagcgtacttaaataccaatccttaatggcaatgcgctggataaacaaagggctaccatctggtagccctttgatttattgaacatttactcgacagttaccgctttagcaaggttacgaggctggtcaacatcggtacctttgattaaagccacatggtaagagagcagttgcattgggatggtgtaataaatcggagccacaatctcgctaacatgcggcatcgcaatgattttcatcgtctcatccgcttcaaagcccgccacttcatcggcaaatacgtacaataaaccaccgcgcgcacgcacttcttcaatattggatttaagcttttctaacagttcattgcttggtgcaaccacaaccactggcatatccgcatcaattaacgccaatgggccatgctttagctcgcccgctgcataggcttctgcgtggatgtaagagatctctttcagtttaagagacgcttctaccgcaatcgggtagtactcaccgcgccccaagaagagggtatgatgcttatcagcaaaatcttccgcgagcgtttcgatctgtttttcaaacgacaatgcggtttcaatctgcttcggcagttgatgcaatgcatgtacgatctcagcttctaactcgcgaccaatgcgctgttgctgcttaccaagtgcagtcaccagcatcaacaatgtgactagctgagtggtaaaggctttggttgaagccacaccaatctcagtacctgcgcgagtcataaaggcgaaatccgattcacgcacgagagaagaacccgcaacgttacaaatcgtcatcgccgccatatagcctttctctttcgctaaacgtagcgcggctaaggtatctgccgtttcaccagactgagatagagtgatcagtaggctattggggcgcgtgacaaatttgcgatagcggaattcagacgcgatttcgacatcacagctcacacccgctaacgattcaaaccagtaacgtgccgtcatccctgcattataagaagtaccgcaggcgacgatctgtacatgttccacttttgccagaatctctgccgcgtgcacaccaatgctttccaccaccacgcagtcatgggtaatacgcccttccatggtattgatcagcgcctttggctgctcgaaaatctctttttgcatgtagtggcggtagtgacctttgtccgcagcatcatgttctagattggattcgctgatttcacgttgtacgggttgccccagagcatcaaatacgcgcacatcacgacgagtcatttccgctacatccccctcttccagatacataaagcggcgtgtgacgttaagtagcgcgagttggtctgacgcaaggaagttttcaccgataccaaaaccaatcacaattgggctacctgagcgagcgaccactaagcgcgaagggtcgttacgatccatcaccacagtgccgtaagctcctgtaagctgtttaacggtggtttgtaccgcttctaataaagaggaagcactgcgcaattcccactccactaaatgagcaatgacttcagtatccgtttgtgaagtaaacacataaccacgatcttgcagcatagtacgcagcatttcatggttttcgataatgccgttgtgtaccaccgtaatgtcaccagaaatatgggggtgagcattgatctcagaaggctcaccatgcgttgcccaacgggtatgcgcgatacctgtaccgcccgcgacttgcgccgcttcaaccgcatccgccaactcttgtactttacccaaacggcgtaaacgcgtgagctgcttatcgctatccacaacagctacgcccgcagagtcatagccgcggtattcaagacggcgtaggccttgtactaaaatttcagcaacatcgcgttgtgcaaccgcaccaacaattccacacatagttaaactccatattttttatactgtcgcgccctgacttaataagtcgcgctaagggatttttatttcacggttgcacggatcacgcgcacttggtgagattcaatttgtttggcaaattcgtcactcaattcatgatctgtgactaagacatcaatgttgtcccagctcagctctaagttcggaattttgcggcccactttgtctgactcaatcatcacgatcacttcacgcgagacttcagccatcactttgctaagcccaaccagctcattgaacgtggtcgtcccccggtcaagatcgatgccatcagcaccgataaacagctggtcaaaatcgtaagagcgcagtaccgattctgcgactttgccttggaaggattcagaatgggtatcccaagtaccgccagtcatcagcagtgtgggttcattttctaattcattgagtgcattcgcgacatgcaatgagttggtcatcacgaccagccctcgcttgtcattcagttgctgaattaacgccgccgtggtgctgccactatcaatcacaatccgattatgatcacggattagtttcgctgcagctttagccagagaaatctttcgaactgaaactttttcattcaattcatcgtgcatcacttctttcggtaatgcgatagcaccaccatagcgacgcagcaattggccatttttttcaagagaagctaagtctttgcgaatagtcacttctgatgtttcaaactgagaagagagagcctcaacactcacctcaccttgttcattaaccagcttaactattgtgtgccttctcagttgtgtatttcgtttcgacattataaaacacaattaaagttacgaatcgaaacgaagtatagttaaaacgaaacaaataagtccatttatttcgatccaaaaaattaatatttcacgctaaaaccttgtcctaagacaattcttagacagtgatattactgtcattcagtggtagaattcggcctcgaaaagaaaaaaaattacagaattgagtaaaaataacgcccatagtccgcgccatactgccgctaactggcgatttttctgaaatttttgatcaaacagtcagtcataaaatgactaaatctgttgaaagactttcagttttggagtgctgtgaactcgtgagctagacttggcaattgacgaaataaagttgctaccgccgagaacacttcaaaaccaccaccaacttcaaaatcattttgtttatcggagaaactcttccatgaaaaagaccaaaatcgtatgtacgattggcccaaaaactgagtctgtagagaaactgactgagcttgtaaacgctggcatgaatgttatgcgtctcaacttctctcacggtgactacgttgaacacggcactcgtatcactaacttccgtaaagtgatggaagtgaccggtaaacaactggcgatcctactggatactaaaggtccagagatccgtactatcaagctggaaaacggtgacgatgtggatctggtcgctggccaagagttcactttcacaactgacacgaaagttgttggtaacaaagagcgcgtagcagtcacttactctggttttgcaaaagacctgaacgtgggcaaccgtattctggttgacgacggtcttatagagatggaagtactggcgaccactgacactgaagtgaagtgtaaagttctgaacaacggcgctctgggtgaaaacaaaggtgttaacctgccaggcgtttctgtcaatctgccagcgctgtctgaaaaagacaaaaacgacctgaaatttggttgtgagcaaggcgttgatttcgttgctgcctctttcatccgtaaaggttctgacgtgaaagaaatccgtgaagtattagcttctcacggcggtcaaaacattcaaatcatctctaaaatcgaaaaccaagaaggcttggacaacttcgatgagatccttgagctgtctgacggcatcatggttgcacgtggcgacctaggtgtagaaatcccagcagaagaagttatcttcgctcaaaagatgatgatcgagaaatgtaaccgtgcacgtaaagtggttatcacggcgacgcaaatgctggattcaatgatcaagaacccacgtccaactcgcgcagaagcgggcgacgttgcgaacgcgatcatggatggtactgatgctgtaatgctttctggcgaaacagcaaaaggtaagtacccagttgaagcggtgaagatcatggcgcaaattgctgagcgtactgaccctgtactgaaagcagaactgggttcacgcctagacagcccacgtctacgtatcactgaagccgtatgtaaaggtgcagtagacaccgcagagaaactggcagcgccactgatcatcgtagcaactgaagcgggtaaatctgctcgttcagttcgtaagtacttcccaacggctaacattattgcagtcaccaccaacaagaaaacagcagctcagttagtgctttctaaaggtgtaacgccagttgtggttgacgcgattgacaacactgacgctttctaccacctaggtaaagagattgcgctgcaatctggccttggcaagaaaggcgacatcgtagtgatggtttcaggcgcactggttgcttctggcacaacgaacactgcatcagtacacgtactgtaatcggatgaatgcgacggccttgcctcgctgaatacgatataaaaacggagcccaatgggctccgttttttattaccacccgaaaaactctttgtgatgagtattgagcaaaagcaccataggtagaaaataaagtgcgctgagcttaatgcctaataccaacaaacagccaatcgttagtctgaccagaagatgattcaacatacactgcctctcagttgctcagtgtgtttgattccctatgcctaagcaccacagaaagtaactgtcactttctttcaatcaatgagcattattgatgaaaaggtcagtagtttacttattactcagtctagctcaataaatcagcaatattagactttagtctagctgtaatgaaaaaatgacaaacggcaatttttaaaataaatacaataagatagaaaaagttcgctcatctcgaaaaagcggctttgtataaaatatgaataaaaatcagcaaataggggcgactttcgtcgcccccactcttcatcattatgctgacttaacattggctatggtgccaacttatataccacatccactcgatcacgaatcaccaaggaagactcttgataggtatctgccacatccattttttcgcttagattcgccgctcgcatcatgatcggctcaacacttggcgtgttgtagtctatccgccaaacgccttctaagcggcgctcaaatcccttagctagagactgagctttgagcttggcatcttcaatcgccgccatacgcgcttgctgctggtatttctcttgatcacgcaccttcaattgaatgctattgacttgattgataccagactctaacgcgatatccagatactgattcagcttactcacctcttcgaccctgacggtaatcgagcgagaagcttgatagcccactaactctggcttaccgtttgctggatagtgatattgcgggttgatgtacagatttgagctcgagatattctgctgtgcgacaccggatttcaccaattttgaggtgaattccgttaccgccttatccactgccgctttcgcttgttccgcattcattgtcgattcaacaaccttcacggaaaactccgccatatcaggtacagcagtcacttcaccataacctgaagtcgaaatatgtggaaaatcccattcctgtgcaaaggtagggcttgaaagaacagagagcagtaaaaccaccggtgcaaataatttcatcgtttcgatccttaatgtcatcgactgcccacatcataagcgaagcagtgcatagattcagtctctacgcataaaaattacacaactttgactcggtcaattattgaggtagtacgcttttcgcataagcagtgatcgcttcgctaatttcaagtaagacgcccgtttcaagctgccaatgatgccaaaaaatcggatatgacagcataaaatcaggcgtcatattgatgagagcaccactttccaattccgaaatgatctgcaaacgtgggatcaaacagtaagccgcgccagaaagcgctaaacggacaaaagcttctgagctgccaaccgtgtggttgatgactttatcacgtggtacagcaaagtaatcccataagaatttattgtgcaattcgtcatattgatcgtaagacaccgcaggcgctttgattaatgaacgcggggtgacccccttagcaaagtatttttgatagaactcagggcttgcgacgcacagatactccatctgacccaaatactcagcactacacccagtgatcggttgtggctccaaactgattgcaccgaccacttcaccatttttgagcttatcgagggtacgtgactcaccataaatcaccagattcaattccacttggcggcttttcattaccttatccagcgccggtaacaaccaagtggctaggctatctgcattggtcgcaatcgacatagaaaccgggcgaacgtgctcttggttcgtcaactccggaaccaactcttgttcgattaaacagactcggcgatagagcccaagcaactttttgccaaccaaggttggccttggtggctgctcacggatcaacactggctgagctaagtatttttctaactgtttaatccgttgtgatacagcagattgggagataaagagctgctcagccgctcgttcaaaactgcctttactcaccacactatctagagcttcaatccaccgataatccagaccacgcattgctttccttaactatttattagccttgttaatatgatattaaaatcattaattatacttatccacctcaaattattatcttgctcagcctatcccttcgatctgacgttgcaacttcaaatcggaacgaaatcacactccaatcatgcggtatgaggtaaaaaatgaactggtggattctgctacaaggattcagcttgggagcgaccatgattattcccattggtgctcaaaatgcttatgtattaaatcaagggattaaacgtcatcaccacttaaccaccgcagccacttgtggggtgctggatatgatttttatcacgctggggatttttggcggtggtgctctcatctcgcaaaataccagcttgttaattggtgtcactttggctggaattctttttttgtgtggttatgggtttctttctttgcgtgctgcgctcaaaccgccccaagcatctgaatccacggcaaatccgatggctgcaggacgtaaagcggtcatttttggtgcctttgcggtcactgtgtttaacccgcatctctatttggataccgtggtgatcttagggtcaatcggaggccaattccaaggtgatgagcgtatctcatttgccattggtaccattctcgcctcattcgtgtggttttttactctttcactcggagcagcaaaattgagcaccacactctctaaacctagagtcagacaagtgattgatatggcagtcgcagcgatgatgttcattattgccttcgcgttgactaagaacttatatctcaatcactggttaaattaagctattaccgacaaaaaagcggagtaaacactccgctttggtattttgtatatagcaaaaccattaattgattttgttcagatgcacatccatttgtgggaatggaatttcgataccgttggcatccagcgcttctttgatcgcttgcatcgaatcaaagtacactgcccaatagtccgaagttttacaccatggacgaaccacaaagttgattgatgaatccgccagcgtcagcacaccaattgtcatatccggatctttgaggatacgaggatctttttccagcgtctcacgcagaacacgtttggttttctgcagatcagacttgtaagaaaccccaatcaccatgtcgacacgacgcgtttcgtgacgtgaatagttagtaatagcaccgccaatgaccgccgagtttggtaccacaaccattttattatctgggcttttcaggacagtttggaaaatttggatagaatcaaccgagccggcgacgccaccaatttctacataatcaccggatttgaatgggcggaatgccacaatcagtacaccggctgcaaaattagacagcgaaccctgtagagccaaaccaacggccagacccgcagcaccaatcacagcgacaaccgacgcagtttgcacaccaatacgactcaacgccgcaatcaacacaataataaacagcgtgtaacgaacaagaccgtggataaagtctacgacagccttatccatctctttctttttcaatacattcgccacactacctgcaacccctttaaccacaaggttaccgataaataggatcagaatagcggaaatcacattcacgccgtactgaatcaaaagatccgaattattggttaaccaagtattcacttggttaaaactttcgacgataggcacttcaacaccaatcgattcaccagccatagtgcattcctcttacaagtaatcaaaaattagcggaaataatgagaaatgataaacatcccactcaaataaaccaccaaaagtcagaattttggcaaaatagcgcatacttaacgcttcgcaaagtcaaagtttggtaaataatgacaaaacagaaggttacgtaataattgctacgctcccgttacaggttaaacaatattcgatctctctgctacccatcccactgagactgcataaaaaaagaaacccgcacttggcgggtttcttcattcaatcgaattcgaaatacgaattacagtacgtcgatcgcgttcagatcagagaatgctttctctagacgagcaaccatggctgcttgaccagcacgtagccatacgcgtggatcgtagtacttcttgttcggtgcatcttcaccagtcgggttaccgatttgaccttgcaggtagtcatggtttttcgcttcgtattgacgaataccatcccatgttgcccactgagtatcagtatcgatgttcattttgatcacgccgtaagagattgactcacggatttcttccagagaagaacctgaaccgccgtggaatacgaagttcagagagttttctggcagaccaaacttctcagaaacatatttttgagaatcacgtaggatagttggagtcagaaccacgttacctggcttgtaaacgccgtgtacgttaccgaaagaagccgcgatagtgaaacggtggctgattgcgttcagtttctcgtaagcgtatgccacgtcttctggagaagtgtacagctcagaagaatccatatctgagttatcaacgccgtcttcttcaccgccagtacaacccagttcgatctccagagtcatgttcattttcgccatgcgctctaggtattttgcagagatctcgatgttctcttccagagactcttcagacaggtcaatcatgtgtgaagagaacagtggtttgccggtttctgcgaagtgtttttcacccgcgtctagcagaccgtcgatccaaggtagtaggtttttcgctgcgtggtcagtgtgcagaatcactggaacgccgtaagcttccgctacagtgtgaacgtatttcgcacccgcgatcgcgcccagaatttgtgcttgttgaccttcaagtttcagacctttaccagcaaagaatgctgcgccgccgttagagaactgcacgataacaggcgctttcacttttgctgctgcttctagaacgccgtttacagagtcagtacctacacagtttactgctggaagtgcaaagccattttgtttcgctacttcaaaaactttctgtacgtcatcaccagagataacaccaggttttacaaaatcaaagatcttagacatggatggaatcctattttctgtcgttttaaaaaataaaaacggtaagtttcaattcttgcaaacgtttgctcaccaatcgcggcattctaccaaacaaatgctcgccgtgcagcaaacaagaaagcgggagtcttacccccgctctcattcgattattacgctttagcgcgtgcttccagcatttctactgcaggcagttttttgccttcaacgaactcaaggaacgcgccgccaccagtagagatgtaagaaacatcggctttgatgccaaacttgtcgatcgccgctagcgtgtcaccgccaccagcaacagagaagccttctgattgtgcgatcgcttctgcgataccacgagtacccgcttcaaagttcttgaattcgaatacgcctactgggccgttccacaggatagttttcgcgtttttcaggatctcagccagttcagccgttgagtttggacccaagtcgaaaatcatgtcgtcatcttgaacttcagaaacgtgtttgatttcggcttctgcgttctcatcgaaagctttggcacaagctacgtcagtcgccacaggaatcgcgcactcttccatcagttttttcgctgtttcaacaaggtcagcttcatacagagacttacctacgttgtgacccgctgcagcgatgaaagtgttcgcaataccaccgccaaccaccagttggtcagcaatttttgacagtgactcaagtacagtcagcttagttgatacttttgaaccaccaacgatagccaccattgggcgagctggtttgtccatcgctttgcctagcgcttcaagttcgtcagccagtagagggcctgcacacgcaataggagcaaacataccaacaccgtgagtagaagcttgagcacggtgcgcagtaccaaacgcatccatcacgaatacgtcacacagtgccgcgtatttcttagacagcgcttcttcgtttttcttttcgcctttgttgaaacgaacgttttccagaacaaccagttcacctgcgttcagttcaacgccgtctaggtagtctttcactaggcgaacttcgcaatcgagagcatcgttcaggtagttaaccacaggcagtagagagaactcttcagcgtactcaccttccgttggacgacctaggtgagaagtgaccattactttcgcgcccgcttccaagcagtgcttaatggtaggtagtgatgcaaggatacgtgcatcagaagtcactttgccgtcttttactggtacgttcaggtcagcacggataaatacgcgtttacctgcaagatccaggtcaatcatcttgattacagacatgatttgtcctctcaaactatttaaagaaatgaaaattctgcaactcggcgaccctgccgagtcggtaaaatcttagctgtttaccgatatggggatacgtccttcgggtttcaatgttcaaacctgatttgaagtgcatgcttagccgctactgcgtggcctgcattgccaatgcggtatctaacatccggttggcaaagccccattcgttatcacaccaaacgagcatttttactaactgcccgttactgactctcgtttgtgtcccatccacaatcgcgctgtgcggatcgtggttaaaatcgatggaaaccaaaggcgcttcagtatagtcaacaatgccacgtaatgtacactgagatgcgttcacaatggtttgatttacgtcattaactttcacatttgatttaattgtgacacttaaatccatcgcggtcacatttactgttggtacacgcaccgaaatcgcttcaaatttgttagaaaatttcggaaatattctttcaatacctttatgcaacttagtatcaaccggaatgatcgattgactggccgctcgtgtgcgtcgtaagtcattatgatacgcatcaatcacttgttgatcgttcatcgaggaatggatggtggtgatggtgccagaatcaatgccgaatgcgtcatccaataccttgatgatgggcacaatgcagttggtggtacaagaaccgttagagacgattttatgctcagcagtgagcgtctcatgattcacgccatagatgatggtgttgtcgagatcgctagcaccaggatgggaaaataaaactaacttcgcgcccgcatcaatatgttgctgaccatcctcttggcaaccatacacacctgtacagtcgaggactaaatccacgcctaaatcacgccaaggtaagagaggaatttccgaaagatgcagaatgcggattgagtcatactcaccattttgatggtgaacatagatatgctgctgatcatggctgatttttttgccaaagcgaccgtggctagtatcgtactgcaggaggtgcgccatcgcatctggcttggcaagctcgttcaccgcaaccacttgaatgcggtcacgtttaccactttcatacactgcacgtaatacgttacgcccaatgcgcccaaagccgttaattgctaccctcagcatcgtatctcgcctatcgctatcagattgtttggcaatagtaaccgatactctaagctttggcacggcgatcctgtgcaataaatgattccaccgccgatcgcgaaacacacagaggattggcgctgccgccaatcctctaaacctctagcaattagaaggcgatgtctaagcccaaccagtagcggcggccatcttctacatagccatactccgcgtaattcacctcttgatcaaacaggttgtacaccgcagctttaatcgttgcggtatcggtgagtgcgtaagtcacgccagtatcgataaaggtgtagcttggcgcgatgaaatcatcgttcgacgccccaccttccggctgcatctccttaccacgatagttgaggttagcccaactattgaggcgatctgtggtttgccagctcaagttggcattgaacagatgtttaggtaactgcagtagcggacggccagcaaaattccctgatttttgctccgaatgggtgtacgtgtagctagacgataactcaacgctttcggtgatcggcagacttaacgtagcttctgcaccataggtttccgcttcatcaatattcacacgataagtaggagctgcaccccattggttggggccggcagtacaaatattcgctgggcaagcgacgcgggtgattttatctttaaaatcattatggaaagcggtcaacgatgccgccagacctgagcctgtgctatacatcaaactcagttctttgttaatcgaagtttcaggcttgagatccgggttgccgtaaatattaccgccgccactaacttgcccccaatccggcgtcacttcacgtaattgcggtgcacggaagccagtagaaacaccaccttttactgtccatagaggatcgagattccatacgccatacacacgtgggctgaagtggctgccgtagtttttatcatgatccagacggccaccaaaggtcaggcggaattgctctgcaagcgcccattcatcttcaatgaatcccgcccattgagtgttcgagatatgcgtgcgagacgaaattttgttggaggttttatcctctaaactttcgtgtttaccttccacaccaaagctcaacatatgctcaccaataggagccactaacgtggatttgaacacagtattatcaatgctcatctcacgagatttattggtgttctcttcatattgcagataggtatcagactgcccaacatcctgccaatccccttggtgagagacggcaacatggttgcgacggtactggttatcggtattgctgcatgtacctcggcatccgctggattgcgccgacttgcccacgttattttcgcgatcttgggctgatacaccggcttccagttgaagttgatgatctggattgagctggtagttgagctttgaggttaagctgcgcagtgatttatcgccgtaaccatgttcaatttcgtcttcatcacgttgcgtggtttgtccgtagacttgcagcgatagagcatcacttaaaggtcccgttacgaagaaattagcgctttgttcatcgcctgaggcgcgattttcttgcaccacggtcgatagctgcacattgcctgaccactgctgctgatctttacgagtgatgatgttgatcacaccgccaatcgcatccgagccgtacagcgtagacatcgggccgcggatcacttcaatgcgctcaatcgcttgcagtggcggcaaccaaccttgctcaatgcccgggccgtcgctgtttggacgggtctgacgtgaggtttggcgcttaccatccaccaagataagggtatagtttgaacccataccacgaatgctgatgtcggtagtatcgccccctccagtgactgtcacacccggtacgctttttagcgcatcggtcacatcacggtaatagcgagattccagatcttctcttgaaatcacactgatactggctggcgcattttgaatcacttgcgcgtatcccgccgcagtgaccaccatggtttcatccgttttcgtcgcgtcttgagcaaaagcgctagccgaaaacattaagcctagtgtcacagataaactgacgggggatggattgaatctggacatttaccactcctttaaatgataattattcttaatttcagaagcggattattcatatattctgtactggagatagatcgacacatggaatagttcggtccaaatatggaacgtctgtggtaattattctttaagggtcaaatacctatgcaagatctcagcgccgtaaaagctttccatgcgctttgccaacataagagcctgactgccgctgccaaagcgcttgaacagcctaaatccaccctgagtcgccgtttggcgcaacttgaagaggacttgggacaaagcttgttgatgcgtcaaggcaaccgcttaacgctcaccaaagcaggagaagtgtttgcggtttactcggagcagctacttgaactggccaataaaagtcaggaagcgttgcaagaattgaacaatcaagtcactggcgaactcacgctggtggtacaccccaatttgatccgcggctggctcagccaagtactggatgagtttatgcagcagcattcgacattgaagatccgtctactcagccagtttcaacacagtgatgaagtgtttgagcccgatttgatcatttggattgaacacgccgcccccatgggttatcgcaaagaacgcttaggctattggcgctatgccgcttacgcctctcccaaatatttggcccatcgagataaaccgacccatcctcgtgagctgattcatcacccatggattgattttattgcttgtcggcgcgcggagcttgaactgcaccatccagagttcggcagttattcactgccagcactagagagtcgtttacaaagcgataatcttgccatgcaagccgatgcgattgctaaaggtcgtggtattggtttgcttcccacttggtttgccaatggttttgaaacggcgcatccgggcagcctcattccttgcgtcaacggatggcaatcacagccaacagaaatcaactgcttctatccgctcggtcgtcacccacttcggctgcgcctatttattgatgcgctccgccaagcaaggcccgatgagtggcaataaaaaatcccgccgcagcgggattttttatcatcgatttttctttgcgtaacaaagaaataaatcgcttttaattacgccagcagttctttagcttgcttcactacgttttcagtcgtgaaaccaaacagtttgaacagctcacccgctggtgctgattcaccgaagctagtcataccgatgatgcgaccaccaaagccaacgtacttgtaccagaagtcggcaatgcccgcttcaatcgcgatacgcttagtcacagcggctggcagaacggcttcacggtaagccgcatcttgcttatcaaacgcatcggtcgatggcatagaaacgacgcgaaccgctttaccttcggcgctcagttgctcgtaagcggcaaccgccagttccacttcagagcctgttgcaatcagaattagctcaggttggcctgcacaatctttcaggatgtaaccgcctttagcgatgttcgcgacttgctctgcgctgcgtggttgctgcgcaaggttttgacgcgagaaaatcagcgcagatggcgcatctttacgctcgatggccagtttccaagccactgccgattccacttggtcacatgggcgccatgtgctcatgtttggtgtcatacgcagagaagcgatttgctcaactggttggtgagttgggccatcttcacccagaccgatagagtcatgcgtgtacacttggatattttgcactttcatcagtgctgccatacgcatcgcgttacgcgcgtattccataaacatcaggaaggttgcaccgtaagggacaaaaccgccgtgcagcgcgataccgttgatgatggccgtcataccaaactcacgcacaccgtagtggatgtagttgcctgacgcatcttctgctgtcagtgacttagagccagaccacatggtgaggttagaaggcgccaagtcagcagaaccacccataaattctggcagcagtttgccgaacgcttccagcgcattttgtgatgctttacgcgatgcgatgttggcagggttagcttgcaggttagcgataatctcgctggttgcggcttcccaattcgctggcagctcgccgctacgcggcgtttgtattcagcagcttcggctgggtaagctttcgcgtaagcggcgaatttctcattccaagcggcttctttgcttgcgcctgcttgttttgcatcccacgctgcgtagatgtccgctgggatttcaaacggagcgtgttcccaacccaagaattcacgtgcagctttgatttcatcgttgcccagaggcgcgccgtgacagtcgtgtgagcccgctttgtttggagagccgaaaccgatgatggttttggtacaaatcagcgttgggcgagaggtttctgctttcgccgcttcaattgctgcattaatcgcgtctgcatcgtgaccatcaaccgctgggattacgtgccagccgtacgcttcaaaacgttttggtgtgtcgtctgagaaccagccttccacgtggccgtcgatagagataccgttgtcatcccagaacgcaatcagtttgccaaggccaagtgtgcccgccagtgaacacgcttcgtgcgagataccttccatcaaacagccgtcacccatgaacacataagtgaagtggtcaacgatgtcgtgacccggtttgttgaactgcgccgccagtgctttctcagcaatcgccatacctacggcattggtgatgccttggccgagtgggcccgtagtcgtttcgatgcccggtgcataaccgtactctgggtgacccggtgttttggagtgtagttgacggaagtttttcaaatcgtcaatcgacagctcatagccgctcaggtgtagcagcgagtaaatcagcatagagccgtggccgttagacagtacgaaacggtcgcggtcagcccagtttgggttttgtgggttgtggtttaagtgtgaacgccacagcacttcggcgatatccgccatgcccattggggctcccgggtggccagagttagctttttgaacgccgtccatgctcagggcgcggatagcattggcaagttgtttgcgagaagacatgtcgactcctaaatgggaagtaagcgaaatgaatggatgcggaaaatcagtggcggctattgtcgcaaagcccccctgctgctgcaaacgatttactggtgctttgctccgattttgtcacactttttagcacattctcgctttgtagtggcaaagctgacttttttaagcaaacgtttggttatgcgctaaatagaaaaagagcttgtaatttgagcgcccgatactagaatagccgtctagatgtagaaacgcctacaaaatgtactaaattgatcgataacgtcattatctctaagcgactcgaaccataggtcgaaaagaactgagacgttagcgaataaccacaaatattggagctatcatggcgattaagcacctgtttacttcagaatcggtatcagaaggccatccagataaaattgcagaccagatctctgatgcagtgttggacgcgatttttgagcaagatcctaaagctcgcgttgcttgcgaaacttacgtaaaaactggcatggtgatggtgggcggtgaaatcacgacttccgcttgggttgatatcgaagagattactcgtcaaactgttcgtgaaattggttacgtgcactcagacatgggcttcgatgccaactcttgtgcggtactgaacaccataggtaaacaatcgccagacatcaaccaaggtgttgataaagccgatcctaaagagcaaggcgcgggcgaccaaggcatcatgtttggttatgcaaccaacgaaactgaagtgctgatgccagcaccgatcacctatgcgcatcgtctgatgcagcgccaagctgcagttcgtaaaaatggcacactgccatggctgcgccctgatgcgaaatctcaggtgaccttccagtatgaccaaggcaagatcgtaggtattgatgctgtagttctgtcgactcaacacagtgattcaatctctaccgcagatctgcgtgaagcggtaatggaagagatcatcaagccagttctgccagcagaatggttgagcaaagagaccaaatacttcatcaacccaaccggtcgttttgtgattggtggcccaatgggtgactgtggtctgaccggtcgtaagatcatcgttgatacctacggcggcgcagcgcgtcacggtggtggtgcattctctggtaaggatccatccaaggttgaccgttcagcggcttacgcagcacgttacgttgcgaaaaacatcgttgcggcgggtatggctgatcgttgtgaaatccaactctcttatgctatcggtgtcgcggatccaacgtcgatcatggtggaaactttcggtactgagaaagtgtcgcaagagatcatcattgaagccgttcgccagttcttcgatctgcgtccatacggtctgcaagagatgctgaacctgctgcaacctatctacaagaaaaccgcagcttacggtcacttcggccgcgaagagttcccttgggaagccaccgacaaagccgcgctactgcgtgacttcgctggtctaaaataagcattatttcaactcatcgctgacaaacggcgaggattgcaatagagttcaaggccctttctcatgaaagggtcttttttatgagttcgatgatagggtatttagaggtagaaattcgctaatggttcgttttgatctgcactgccaagctgagcagaaaatcaaacaatgtatcgctaccgccagcgaggctttgcaacgcccctttaaactgcccaaactcaattaccgtttacgtggacgcgccgccggcaaggcctatttgcagctgggggaaatccgccttaatccggtgctgtttgccgaaaacgtcgatgacttcctccagcaagtgatcccacacgaaatcgcccatctgattacgtatcagctttatggtcgagtacgtccacacggcgtcgaatggcaacaagtgatgagccaagtctttaagcttgagccgaaaaccactcacaccttttctgtcacttcagtacagggcaaaaccttccactaccgctgtgcgtgtcgtgaatacccgctcaccattcgtcgccacaataaagtgctgcgtggtgaagctacctatcgctgccaaagctgccaacaaaacttgatctaccaagcctaacctttgattggctgagaccacttctataggctttgccttgctctcgctaaaaactaacaaaagcatcaacgacaaaggcaatttatgagtgttaaactgataaaaaacctacttatctacgtcttttatgatgatttttcgtttcgttaccacgcttgctgctagcttacctctgctcacctttgccgcccccatctcttttagtcatgccaaaaatgaagcggtgaagatttatcgtgatcatccggtctctttttactgtggctgcgagattcgctggcaaggcaaaaaaggcatcccggatctggagagttgcggctatcaagtgcgtaaaaatgagaatcgtgcttcgcggattgaatgggaacatgtggtgccggcttggcaatttggtcatcagttgcaatgctggcaacaaggtggccgtaaaaactgcactcgtactagccctgagttcaatcagatggaagccgatctgcacaacctcactccggcgattggtgaagtgaatggcgatcgctccaacttcagtttcagtcagtggaatggcgttgatggcgtcacctatggccaatgtgaaatgcaagtaaacttcaaagagcgcactgcaatgccgccagagcgtgcacgcggggcgattgcgcgtacttatctgtacatgagtgagcagtacggtttgcgactttccaaagcgcaaagccaattaatgcaggcatggaacaatcagtatccggtcagcgaatgggaatgtgtgcgtgaccaaagaattgaaaaagtgcaaggcaactcgaaccgctttgtgcgtgagcaatgcccgaactgatgggcagaatctcaccctgcccccttgtattttgccccacttgcatccatgttagaggccagatatccctcttccaactgaagttacactttacgttggaagacggtaacctcgtttaatgattaggaattatccgcatgcgcatccctcgaatttatcatccagaaccgatccaccagcttggcaccgttgccctgagtgaagatgccgcagggcatatcggtcgcgtattgcgtatgcaagctgggcaagaagtgctgctgtttgatggtttgggggctgaattcccagccgtgatcagtgaagttggcaaaaaacaggtattggtcaatatcactgagcgcgtagaaaacagcattgaatcgccgctcgatctgcatcttgggcaggtgatttcacgcggcgataagatggaattcaccatccaaaaatcggtggaattgggggtaactaccatcacccctctgctttctgagcgttgtggtgtgaagctggatgaaaaacgcttcgagaagaagattcagcagtggcagaaaattgcgatcagcgcttgtgagcagtgtggccgtaataccgtgccagaaatccgcccaattatggatctcgaagcttggtgcgcagagcccaccgaggcactgaaactcaatttgcacccacgcgctaaatactcgctcaacaccttacccaccccagtgagcaaagttcgtttgctgattggtcctgaaggtggtctgtcagcggaagaaattgatatgactcgccgttaccagtttgaagaaaccttgttaggcccacgcgtactacgcacagaaacggcggcgctcacggcgatagctgcactacaagttcgtttcggcgatcttggctaaatggagataaaccatgattaaactcggtattgtgatggaccctatcgcgtccattaacatcaaaaaagattccagctttgccatgatgcttgaagcgcagcgtcgcggttatgaaatccattatatggagatgaatgatctacacttagagcaaggtgtagcactggccgatactaaagttgtcgagctgaaagaagatccgagcggttggtaccaattcaaatctgagcaaaccatcgcactttctgaattggatgcgattttaatgcgtaaggatccgccgttcgacaccgaatacatctacgcaacctacattttggagcgcgcggaagatgaaggcgtattagtggtgaacaaaccacaaagcctgcgcgattgtaatgaaaaactgttcaccgcttggttcccagagctgacgccgatcactatggtgacgcgcaaagccgagaagattaaagccttccgtgaacagcatggggatgtgattctaaaacccctcgacggtatgggcggtgcttcgattttccgcgttaaagagggcgatccaaacctctcagtgatcatcgaaaccttaaccaaccacggccagaattactgcatggcgcagacctttgtgccagatatcagcaacggtgataaacgcattttggtggtcgatggtgaacctatgccttactgcttggcgcgtatccccgccaaaggggaaacccgcggtaacttggcggctggcggtcgtggtgagcctcgcccactgagtgaaaccgataagaaaattgccctagcggtcgcaccgactctcaaagagaaagggctgctgtttgtaggcttagatgtcattggcgataaactgaccgaaattaacgtcaccagcccaacctgcattcgagagattgaagctgcgtacgatatttcaatcacaggcaagctgatggatgccattgagcgtcgcttaaaagcgacggcgatgtgagcaaccatagcagtgacatagaggttggacacagtatgaatcttaccaatcattttctggttgccatgccaagcatgaaggatccttacttcaagcgcagcgtgatttatatttgcgagcacaaccaagatggtgcgatggggttaatgatcaatgcgccgatcgatattacggtcggcggcatgctcaagcaggtcgatattgagcccgcttacccacaatcgcaccaagagaatttgaaaaagccggtgtttaatgggggacctgtgtcggaagatcgcgggtttattctgcatcgtccgcgcgatcactatgaatcgagcatgaagatgaccgatgacatcgccgtcaccacctcgaaggatattctcactgtactgggtaccgaggcggagcctgaaggctacattgtcgcactgggctattcgggttggtctgctggccagttagaggtggaactcaccgaaaactcgtggctaaccatagaagcggatcctgagctgatttttaacacgcccgtgcatgagaaatggcaaaaggctattcaaaaactcggcatctcccctgcgcagctttccagcgacgccggacacgcctaataaaatccaaggctgcgatcacgcagcctcatttttactgtcattttttattgaacattttttattaaaagagaaatcgcatgtcacgtaccgttatggcctttgattacggcaccaaaagcattggcagtgcaatcggtcaagagatcacgggcacggcgtctccgctgaaagcgtttaaagccaatgatggcatccccaattgggatgaaattgaaaagcagatcaaagagtggcagcccaatttattgattgttggcctgcctaccgatctgcacggcaaagatctggacaccatcaccccacgcgcaaagaaattcgctcagcgtttgcatggccgttttggtttgcccgtagaactgcatgatgagcgtctttccaccaccgaagcgcgcgcagagctgttcgccatgggcggttacaaagcactgagcaaaggcaatgtggactgccaatcggcggtgatcattctggaaagttggtttgaaagtcagtggggctaaccccactgcttttcttggccgagtagaatcgctgtgattactcagccaagccttccaatttgatcaaagcaaactgcttcttaccacgttgcaacacatagtagcgatcaaacagagcaaagccggataacccaccctcttgctgtactcgctcaccattgacgcgaatcgccccattctccagccactcgcgcgcttggcgcttagaactggctaaacctgagctaagcagcaaatcgagtaaggaatcggtgcgtgatgccgccacacaaggcaaaccatccagttctaactgagccaactcacttaagctgagatagctgacgtccccgctaaacagcgcttgagtaatccgctgcgccgcagcgagtccctcttcaccatgcacaaaacgggtcacgtgttcggccaaaatctgctgcgcttgtggtttgcctgcacgtagcgcatcggcttgacggatttcctcaatctcagccgtgctcaaaaaggtgtaatacgccaagaagcggtacacatcggcatcatcactgtttaaccaaaactggtaaaagcgatacggcgaggttttgctgctctcaagccacactgcaccactttcggttttgccaaatttagtaccatcggatttggtaatgagcggcagagttaaaccacacacctcaaccccattcaggcgacgggtcaaatcaattccgctgacaatattgccccactgatcattgccaccaatttgcagtgcgcagccaaactcacgattgagatgcgcaaagtcataagattgcagcaaagagtaactgaactcggtaaaagagatgccttgatccggacgcgccaaacgctgctttaccgattcacgattgatcatggcattgacggaaaagtgcttgcccacatcgcggaaaaaatcgatcagattgatcttaccgatccaatcggcattattgacagccatcagcgatgcgcagttctcgccctgcgaggtcatcaattgcgtgatttgctggcttaaatcactcacccactgctgtacagtttgcgcactattgagcacccgctcgttggctttgaagcttggatcgccaatcatgcctgtggcccccccgataagcgcaatcgcttgatgtccggcgttttgaaaacgcttaagcatcagcaacggcaccaaatggccgatgtgcaaactgcctgcagtggggtcaaaaccgcaatacagcacttgcggtgtggcaaagcgctcaaccagcgcctccagaggtgtgctttgcgcgatcaaaccgcgctgctgtaaatcatcaaaaagttgctgtgaattcattctgcctcctaaaagtcttggcaagcagagtaaccaactttaaacatagggagcgatgtccctaaagggacaatcttggtaattgatgaccgaaggaagagagacagcctaatccgcggctgcgccaatcagatgattgagaaacagctgaaacagctcgcttaacgagctgacatgcagctgcgcatagatgcgtttacgatgatttttgactgtgccgtggctgatggccagtgcctcggcaatctcttgtgagtctaaaccttggatgagcagtgcggtgatctcctgctctcgcgggcttaaacgctgcgcgccaaaactctggatcgcctgttcaacccaagtgcgtaactcttggcttggctgcgcactttccgctaagcgcagtggctgctgctgccaatgctgctgacacaaggcttgcaacacagtaaaccgctgttgcaacgctgtaatctgttcgcgtggaaaagagcgcggcttaaagcagccgagatacaccacaatcgcacgctcgccatcaagattgaccaccaaactcacttcatcttgccaaccggtttgcgcataaaactggtgttgataggctttttgctgtggattgagcggcattaaatcggaaagatgaaacacccctgagcgcgtgttgtgctgcaaagcgctatagaaaggatcatcaagataagcatgagtcagataacgctgaaacagcaactcacgctgggtcgagagcgagtcatacagataaatcggatgtttgttgggacgatagcccaagatcaccgcgcaatcaaaatcggcaatacagcgtagcactgccacaagatgcgacgtaaattgcggcgtctttaacgccgcaatcgcgtcacctaatgcgagatactcttgagtcgtgatcggcatgcgcactccacctattcagccgagaaagtggcagtatgcccaatccagactcgaagctctatcccaaattcgcttgagttgcagggcgtaaaagcaaagcgcacaaagtaaccatcgctactccatatcaatcttcacattctgcaaagagccgctgccgtagtcatcaccacgcttggttttgagcatcaaacgcagatcgttggctgaatcggcactgtgcagggcatcttgctcactgattttgtcatccaccacaagctggtataaggcttgatcgaaagtttgcatccccacttcctgcgaacgagccatggtcgctttcagctcatgcagttcaccgcggcgaattaaatccgcgatacgcgggctattgagcaacacttcaaacaccccgtgtcgacctttgccatttttatcgcgcaataattgctgggcaatcacgcctttgaggttgagtgacaaatcgagcaaaaactgctcacgctgctctttcggcactaaatgcaaaatccgctctaacgcttggttagcattgttagcgtgcagcgtggccatacacaaatgccccgtttccgcgaaagtcatcgcgtattccatggtttctcggctgcggatttcaccaatcaaaatcatatcgggggcttggcgcagcgagtttttcagcgccacttcataactttcggtatcaagccccacttctcgctgcgtcacgatacagcgcttgtgttcatgcacaaactcaatgggatcttcgaccgtcaaaatatgcccggtgcgatgctgattacgatagccagtcatggctgccatagtggtcgatttacccgaaccggttgcgccaaccaccaacactaaaccgcgtttggcaatcgccaaattttgcagcacttcaggcaatttgagttcttcaaaggtgggaatgcgcgtttcaatccggcggatcaccgcccccggcaattcacgttggaaaaatgcactgacccgaaaacggccactgtcacgcaccacagcaaagttcgcttcgcgcgtctgcttaaattctgcttgccttgcgtcatccatcatcgcatgcaataaggccgtcacatccgccacgctgagcgcttcaccttgtgcacgcaattcaccatcgactcgatacaaaatcggtgcacccaccgtaatgtacagatccgatgctttatgagtcagcatgccatccagatattgattcaactccatctgtctttacctacctaaaatgcttttaaatccaactcgattttgctctgtacttcttgcgcatccaccacaccacgcgcgatcagctgtttggcgttttgctccatggtttgcatgccgtgtgcggcaccggtttggatgatcgaatacatctgcgccactttatcttcacggatcaagttccgaattgccggcgtcgccagcatgatttcatgacacgcaacacggccacccccgacgcgttttaggagtttttgcgcaataaccgcacgcagcgattccgacaacatggaacgcaccatgtctttgtcgctgcccggaaaaacatcgataatccggtcaatggttttcgccgccgagctggtgtgcagagtgccaaataccaagtgaccggtttctgccgcagtaagcgccaagctaatcgtttcttggtcacgcagctcaccgacgaggatcacatctgggtcttcacgcaatgccgagcgcaatgcatttttaaaactgtgggtatcacggtgcacttcgcgttggttgatcaaacacttattgttgctgtgcacaaattcaatcggatcttcaatggtcaaaatatgcttattgtgatgagcattgacatagttcaccatcgccgccaaggtcgtcgacttacccgagcccgttggcccagtcactaaaactaaccctttttcataattggcaattttgctgaagatttcaggagcatccagttgctctagcgtcgggatgacagtgggaatggtacgaaacaccgccgagcatccgcgcgcttgatgaaacgcgttaacccggaaacggccaacattaggcagttcaaaagaaaaatcgacttctaatttctcttcatattcactgcgctgggcatcattcatgatctcaaaaatcaagcgatgtacatcagaatgggtaaaagcaggcacgccaagcttcctaacttcgccatcaatccgtaccataggcggaacacctgcggaaagatgtagatctgaggcgttatgttttacactaaattccagtaactcagcgatatccatttaaattccttaataaagtctggctatgcgtagtattcaacaaaacattgaacatatcactgcacagattgagagcgcacaacaaaagtgtggacgcgctcgaagcagtgtgcaacttctcgcggtaagtaaaactaaacccgtcgaggcaattcttgaggcgactcaagcaggtcaacgctactttggtgagaattatgtgcaggaaggtgtggataaaatccgctattttgccgaacatcacccgcagttagcactggagtggcactttatcggtccactacagtcgaataaaacgcgcttagtggcagagcattttgactgggttcacaccattgatcgcgagaaaattgccttgcgcctcagtgaacagcgccctgtgaatatgccaccgctgcaagtgctgattcaggtcaacaccagcggtgaagcctcaaaatcaggcatcgaaccgcagcaattatttacactagctgaattgatttctcgtctgccaaacctcaccttaagagggctgatgtcaattcctgagaacgtgccggattaccctgcgcaactggcggcatttacccaattagccgaattgcagcaacaactggctcagaaatacccgcagattgacaccttatccatgggtatgagtggcgacatgcaagcagcgattgaagcaggcagcaccatagtgcgtattggtaccgcgattttcggcgagcgcgattacagccgcaacgcttaacgtttgggatgctcgttgcaacgagtgccccttttagatttgagagtatcgaatggaacagagaagcatcgcctttattggcgcaggtaacatggcacgcgccatcattgcgggattgattgccagtggttacgccgccgataagatcattgcaaccgccccttcactcacgcgccgcgagcctcttgaagcgcaatacggtattcgcaccaccagcgataaccttgctgcggcgcaacaagcggatgtggtggtgttagcggtcaaaccgcagctgatggctgaggtgtgtaaaccgctgcaagcggtcgatttctctggaaagttggttatctcgattgcggcgggtgtgtcagtcaaaagactcaatgagatgctggccacccagctcaatttagtgcgtgtgatgcccaatacgccatcactggtaaaccttggcatgagcggtttgtacgcccctgattcggtgagcgaagcggataaagcctttaccacacaactgatgcaaagcgtgggcgaagtgtgctgggtagacaacgaatccggcatcaacagcgtgattgccgccgcggggagtgctcctgcttatttcttcttgtttatgcaagccatgcagcaagaggcgatggcgcaaggctttgatgaagccaccgcccgtttgttagtacaacaatcggctctcggtgcggccgccatggtcaaagccaaccctgaactctcactggccactttgcgtgaacaagtgacgtcaaaaggcggcaccacggcgcaagcgatccagacgtttaacgatcaccaactcagcgacatcgttgccaaagcgatgcaagcggcggtaacacgcgcgcaagagatggaacaactgttttaatgtttaaggcgtccactcaaactgagcggtcgccaaatcaataagggcaacttatgaattcactgagctttctcatcaacaccctatttgacctctacatcatggtggtcattttgcgcatttggctgcaagccgcgcgcgctgatttctacaatccgttttcacaatttatcgtaaaagcgacccaacccgtggtcgggccgctgcgccgtgtgatcccatcgattggcagcattgatttagccaccatcgtttttgcgtacgtcctgtgcgtactgaaattcatggccttagtcttgattgcctccagcggctccgtgtcgttcagtgcagatttcctcttcctcggcttgctctctctgatcaaggctgcaggcggcttgttgttctgggtcttgttgatccgcgcgatcctaagctgggtcagccaaggccgcagcccaatcgaatacgtgttccatcaattgactgaacctatgctcgcgccgatccgtcgcatcattccggtgatgggcggctttgatctcagcgtactggtgctgttcattgtgctgcaatttgccaacttcctgatgggcgatgtgattggtcctatctggtatcagttgtaatggctgcagcatggcgcgaaggagatgacttactgctgcggctctatattcaacccaaagcgagccgcgacagcattgtcggcctacatggtgaagaactcaaagtcgccatcaccgcgccgccgattgatggtaaagccaacgcacacttgagcaagtatctcgccaagctgtgcaaagtggcgaaaggttcggtggtggtcgaaaaaggcgagctaggacgccacaaacaagtgcgtatcttacagccaagccagatcccagctgagattgcagcactgattgaataatcacactccctctttgagggagttttttcacaaggagaatcgattatgcgtaaatggatgatgtcactactgctcaccctattggctttgccagcgagcgctgagcagcaaaaaaccattaaagatattgaagtgcactattcggcgttcaactcaacctttttaaccccaaaggtggcgagcagttatcagctgacgcgcaacggctataccgcaattctcaatatcagcgtgttagatcgcgcgtcactcggtaaacctgcaaccgaagccaagctgaccggccatgccaaaaacctgattggtaacttgcgtgaactgagctttaagcaagtcaaagaaggcaacgcgatttactatttggcggaagtgccgatcagcaatgaagagatgctgacctttgatattgatgtcgatgccggtctgaaaggggcgggaaaattgaccttcagccagaagttctataccgaacagtaattttatacaagatcaggggaatccacgacgcagccgtcgcttttcccaatacaaaccacagagaacagcatgaaaaagatcgttttagccacgggcaatcaaggcaaagtgcgtgaaatggcggacctattgtccgattttgggtttgatgtcgtcgcgcaaagcgaattcaacgtccctgaagcggcagaaacaggcaccacttttattgaaaatgcgatcatcaaggcacgtcatgccgcgcaaattaccggcttaccgacgattgccgatgattccggtttggaagtggattacctaaacggcgcgccgggcatctattctgcgcgctacgcgggcgagcatgccagcgacggagacaatctcaataagctgctaatggcgatgcaagatgtgccagacgaccagcgcagcgcgcgttttcattgtgtgctggtgttaatgcgccacgccgatgatccaacgcctatcgtttgccacggcaaatgggaaggcaaaatcctcaccgcgccacacggcagcaatggctttggttacgaccctattttctgggttccggaagaaaactgcgcttctgctgagctagaaccggtgcgcaaaaagcagctatcccatcgcggcaaagccctgcaaaaactgttcaaagcgattgaagagcagcgtacatgctaacgcctccatcgcttagcctatacattcatattccgtggtgcgtgcagaaatgcccgtattgcgatttcaactcgcacgcacagaaaggcgagattcctgagcaagagtatctggatgcgctgctgcaagatctggatcgcgacatcgaacgttaccagctcaagggagatccgcgcctgctgcactcgatctttattggcggtggcacaccgagccttatctcagcagaagggatcgcgcgtttgctgcaaggcgttgccgagcgtattgcgtttaagccagagattgaaatcaccatggaagccaaccccggcacgattgaagcgcagcgttttgctggctatcgcaccgctggggtaacacgtatttcgattggtgtacagagttttgagccagaaaaattagcgcgtttagggcgcattcacggtcaacaagaagcggtacgcgccgctcagctcgcccatcaaattggcctcaacagctttaatttggatttgatgcacggcttaccggatcaaacgccagagcaagcactggctgacttggatcaggcgatcgcgctcaatccgccgcatctctcttggtatcaactgaccattgaacccaacacgctgttttactcgaaaccgcctaagctgccggatgaagatgcactatgggatattttcgagttaggacatcaaaagctcagtgatgcagggtatgtgcagtatgagatttctggctacagcaagccgggctatcagtgccagcacaacctcaactattggcgctttggtgactacctcgggattggctgtggcgcgcacggcaaactgagttttgctgatgggcgcattgtccgcaccaccaaaaccaagcacccgcgcggctacttggcagcgttgaacaatctggccaaagcttatttggatagcgagcagttggttgccgatcaagacaagccgtttgagttttttatgaaccgctttcgcttgattgagccctgcccgaaagccgattttaccgccaccacgggacttacgattgacgtgatccgcccgaccttagattgggcgctcagtgaaggctatctcagtgaagatgatcagcactggcaaatcacggaaaagggcaaactgttcctcaatgatctgctcgaagcctttatggccgatgaagaagaataaccaagaggcgcgtgcgcctctttatttttatcttttatacccagactacttgcagttgcaggtaggcggcaaacgagtgacaaatttgcacagccatcggctggcctttggtgagagccaaggatggctctcataatccccatgagcgtagatccactatgtgattggggagagcgaatactgccaacaccgctgcagcttcaattagaaaggggatagcttagaaaattgagcgaccaatccgctgcgcgagtaactctaacgcgcgagtccccgcgagcgagttacccgattgatccagcgcgggggaccacactgcaatcgtcatttctcccggcaccacagcaataatcccaccgccaacacctgattttccgggcataccaactcgataggcaaactctcctgccccatcatacaagccgcacgtggcgagtaaggcattggtttgtttgctttgggttggcgtgatcaccgtttcgcccgtcaccacagaaacacctttgttggccagatagctgaaggttttcgccagctcaacacagctcattttcaatgcgcaggcgtgaaaatagttgtgcagtaccggaataacctcattgtggaaattgccaaatgaacgcatcaaatacgcaatcgccgcgttgcgatcactgtgcatcatctccgaagcagccacgactttgtcataagcaatttgcggctcgccgctgagctggcgtacaaactccaacagacgctgacgaggtgcagagaggcgactttgcagcatgtcgcacaccacaatcgcgccggcattgataaatggattacgtgggattccctgctccatttcaagctgaatcaatgagttaaatgcttgtcctgaaggctctttacccacgcggctccacagttcatctggctgatacaagcccatcgcgagcgtcaagctcagcactttggatatcgactgaatcgaaaacccttcctgtgcatcgcctgccgtgatgacttccccttggttggtaaacacagcaatacccaatttatcactcggtactttcgctagtgcggggatgtaatcggcgacgatgcctttactggtgagcgggcgaacttcttcaataatgctggctaaaatgtctgctgttggcttcatggttgactctttattattagtttgtctcaagctacttcagcttttcaatagcttgaggattagggtcaaaaaagccaacatcaaatgttggcttaagcaaaattctctctttacgcagtgcgctggtacttgatgtcccacactccgtggcctaaacggtgaccacgctgctcaaacttggtcagtgggcgctcatcagggcgcggaacgtaatcgccatcggttgccaagttagcaaaaccgggggcttgattcatcacttcaaccatgtgttctgcatagttttcccagtcggttgccatatggaatacaccgctgccaatcatgagcttttggcgcaccatttcagcaaattcaagctgcacgatacggcgcttgtggtggcgtttcttgtgccaaggatctgggaagaataattgcaaagtgtgcaggctgttatctggaatcatgtgcgcaaacacttccaccgcgtcatggcacatcacacgcaagttagtcacacccgcttcacgcgccgaagccaaacaagcaccgacacctgggctgtgcacttcaataccgaggaagtttttctcaggtgcgtttttcgccatttcgaccaaggacgcgcccatgccaaaaccaatctccagcacaaccggattatcgttaccaaacacctgttgccaatccaacagctctggctggtaatcaatccccatggttggccagcactctttcattgcggcttcctggcctttggtcaaacgaccttcacgacgaacaaagctacgaatacgacgcagcactttgccatcttcggtatattcctgggtgatgacttcgctcatttctattgcctgcacattactaaatcagagcgggaattatccaaagaatcgtcaacggtgcaagtgttattactgaccgtttaccatcctgccctcaaactctttgcctctgccgccaacaccaccacagcttcgaactggaaggaggagaatatccccaatgtttgtcggttttacttcaccaccaatctgtggtgcaattttgctccactagtttagacaataataatgagcaagtcgtgactccttttgcacaggccatccttacttggtatgacgcctacggccgcaaaaacctgccgtggcaacaaaataaaaatgcgtatcgcgtttggttatcggaaatcatgttacagcagacccaagtcgcgaccgtgatcccctactttgaacgctttttagagcgcttcccgaccgtacacgccctcgcggcagcgccgcaagatgaagtgctgcatttctggacggggcttggctactacgccagagcgcgcaatctgcataaagcagcgcaaatggttgtgagtgaatatggcggcgaatttcccaccgatttagagcagatgaatgcgctacccggtgttggccgttctaccgcagcagccgtgctctcttctgtgtataaaaaaccgcatgcgattttggatggcaacgtgaagcgcacgttagcgcgctgctttgccgttgaaggttggccggggcaaaaaagtgtcgaaaaccagctttggcattatgcagaaatgcacacgcccaaagtggatgttgataaatacaaccaagccatgatggatatgggcgcgatgatctgcactcgcagcaagccaaaatgcagcctgtgcccagtagaatcgttttgccttgccaagcagcaaggcaacccccaagagtatccgggcaagaaaccgaaaaccgataaacccgtcaaagccacttggtttgtcatgctctatcacgacaatgccgtctggcttgagcagcgcccgcaaagtggaatttggggcggtttgtactgcttcccgcaatcagagatcgccaatattcaaaccaccatagatcagcgcgccatcggcgatagcacaataacatcgcagaaaaccctgatcgcatttcgccacacctttagccactaccatctcgatatcacgccgattttgctgcaattaagccgcaaaccggacatcgtcatggaagggagcaaaggtctttggtataacttaagccaccccgatgagattggtctcgcggcaccagtgaaacaactgttgcacaccttacctttcgacattgatagccacatttaaagaggaagagtgaatggctcgcaccgtattttgtacccgattgcagaaagaagccgatggcttagatttccaactctatcccggcgaactgggcaaacgcattttcgacaacatctgcaaagaagcttgggcacaatggcagaccaaacagaccatgctgatcaatgaaaaaaaactcaacatgatggatcctgagcaccgcaaattgctggagcaagaaatggtgaacttcctgtttgaaggtaaagaagtccatatcgaaggttatacaccgcctgcaaagtaggaaatttcggatttcatctgcttgcaaaaaatgacatcatgccgctgggttatgatgtcattttcgtatcaggagtagcgaaagctcgctttaggaggcgcatgagaaagttagtgttatgtatcaccgctctattattgagtggctgtagtcgtgaatttatcgagaaaatttacgatgttgattacgagcccactaaccgtttcgccaagaacttagccgaattacctggacagtttcagaaagacaccgccgcactggatgcattaatcaacagcttctccggcaatatcgaaaaacgttggggacgccgcgagctaaaaatcgccggaaaaaataactacgtcaaatacatagacaactaccttagccgctctgaagtcaacttcaccgaaggtcgaatcatagtagaaactgtttcacctatcgatcctaaagcccatttacgcaatgcgatcatcaccaccttactgactcccgatgatcccgcgcacgtcgatcttttctcctcaaaagacattgaactcaaaggccaaccctttttgtatcagcaggtactcgatcaagatggtcagccgatccagtggtcatggcgcgctaaccgttacgccgattacctcatcgctaaccatttgaaagtgaagcaagtcgatttcaaaaaagcctattacgtcgaaatccccatggtcaaagatcaaatcgatatccgtggctacaaatacgccagtatcgtgcgtaaagcttctcgcaaatacgacatcccggaagatctgatctacgcgatcatcaaaaccgaaagcagtttcaacccctatgcggtgagttgggccaacgcctatggtttaatgcaagtggtgcctaaaaccgcaggacgggatgtgttcaagctggtcaaaaaccgctctggcgagcccagccccgagtatctgtttaacccagaaaacaacattgatacgggtacggcctatttttacatcctgaaaaatcgctatttgaaagaggttcgccaccccacatctctcgaatacagcatgatttctgcctataacggcggcactggcggagtgttgagtacctttagcagtgatcgtcaacgcgccatgcgtgaccttaatgccctgcaacctaaccaagtgtattgggcgttaaccaaaaaacatccgaatgcggaagcgcgtcgttatctggaaaaagtgaccaaatttaagaaggaatttaacgcgggataacaaaaagcccgcagtttgctgaaaataacggcaatcaaactgatttttcgaaatatttcaaaaaacaggttgacggggaaagggaaaatccgtttaatagcgctccgttgcccggatagctcagtcggtagagcagaggattgaaaatcctcgtgtcggtggttcgattccgcctccgggcaccacgaattttagattgttggtgtaagacacaaacagcaaaggttacgtgtgccggcttagctcagtaggtagagcaactgacttgtaatcagtaggtcgccagttcgattccggcagccggcaccacttaaaatttgcctcgatagctcagtcggtagagcagaggattgaaaatcctcgtgtcggtggttcgattccgcctcgaggcaccactattaaaagttgtgccatagacacaataaaaattgttcctccttagctcagtcggtagagcgacggactgttaatccgcaggtcgctggttcgagcccagcaggaggagccacttttagaaacccagtccttgactgggtttttctttatctgcatttgggatttcgcttctcacttcgcaaacatcccgcctcacttaactgatcgttttcacctcttcttttttatttcgaggcaaaaatttaatccaactcatactttcacacttacttcgtatcaataaataagcaagctcattactatctcgccgacatcaaaccgtcacaaaaatttaatctgcttacaccttccccatagggttcaaactatgaaattaaaaacccaagcttatttattatctgccatcattctcgccgctcttctcgcgctaaccgcgaccggactgtggacgttacgtgtggccagcaatctcgataacaaagcgcgtgtaaccgagctgtttaatagtgcctacagtattttgactgaggtagagaagctggctcaagaaggcaagatgtcggagccagaagccaaagcgctcgccacccgcctaatgcgcaacaatctctacaaagataatgaatatgtgtatgtggcagatgaaaatatgactttcgtggcgacgccgctcgacccacaactgcacgacaccagttttcacgattttaaagatggtaaaggcaatagtgttggccgcttaattcaagatgtgctgcgtcatcaatccggcaagttggtggaatatacgtggacacaaaagcaagctgacggttcgattgaagaaaagctctcgatcgcgcgcaaaacgccacactggggctgggttgtcggcacgggtattggttttaacgaagtgaatgcgcgtttttggtctaccgcgcaatggcaactaagcttatgtgtggtgatcgccgttgcgattttatctctgctactggtcgcgattcgtaaaatactgctgattatcggcggtgaacccaatgaggtacgcagcgcagtacaagcggtggcacaaggccgcattcgtcgtgaatttgtgataaaagcccctaaagagagtatttatggtgcagtgcagcagatgagcagctcacttgcagacttggtggctaagcttgagcaatccatggtggctttacgctctgaattagccggcgcaggtactcgcgccaaaagcattgccgaattaacggatagccagcagcaatctaccgccatgattgccactgcaatgaccgaaatggcctcttcagcgaaccaagtcgccgattctgcgcgtgataccgcattcaacaccgatcaagcggatcagcaaagccagcatacgcaaaagctcatccacaacacggtaagcaatattcaaggcttggcgacccaattacaaactgcgagcaccgcggttgccgatctggatctggatgtcaaaaacatcgctaaagtactggatgtgattggtgatattgcagagcaaaccaatttactggcgctgaatgccgcgattgaagcagcacgcgctggcgagcaagggcgcggttttgccgtcgtggctgatgaagtgcgtaacttagcgggccgcacgcaaaccagtaccaaagagatccagcagatgatccacaatttgcaggaagggtcgcgtaatgcgattcaaaccatccagatttgtgggcaaaccagtcaaagcagtgtgcaagagtcagaaaatgccgcttctgcgctggcattgattgtcagcgcactcgaaagcgtctcttcgatgagccatcaaatagccacggcggccgctgagcaaacccaagtcagcgatgatattgcgcgccgaatcaatatgattgaagaaagtggctcaaaactgagccgagtggtgatggagagccacaatagtacgcaaactctcaccaaactcgcccgcgagttagaacagtgggctgcgcattttgaggtcactcgttaagcatactttcagttcagtgagcgcaaaacgtttcactgaactgatgggttacccgtcgttatgatacccaaacttcttgacgttgcctgtcgtcagccagtgcattcatcccatgagcctacctactctatgattgggatgaatacacttaaccaacacggctgcagcttcaagtaggaagggtataactgaaaatatttatcaagcaggtatttttacgtactttgtgattttctggctacgcttaaaactctctatttcactgagcatgtgggtcttgtggttcatttagcgatattttggtaaacgaaatggacaaaaacaggccattaagtatagaaaaacaacaaacgatattttttttagattttcatgttgacgactaccacgaaaaaccttttaatacaccccgtcgcccggatagctcagtcggtagagcagaggattgaaaatcctcgtgtcggtggttcgattccgcctccgggcaccacaattttgattgttggtgcttgcacgaacaataacaaatgtgccgacttagctcagtaggtagagcaactgacttgtaatcagtaggtcaccagttcgattccggtagtcggcaccattaaaaataataattcctccttagctcagtcggtagagcgacggactgttaatccgcaggtcgctggttcaagtccagcaggaggagccacttttagaaacccagtctatgactgggttttgttttatctgtcgaaagttttatctatcgaaaaccgccccattctaattgctcttttgactgcaaaagaaaggcaaacggttaagtttgccttagaaaagctaagcgcataatgacgatgagcttacttaatgcctttctcctttcggatcagctcataagcgtgttggatttgctgagatttttctttcgcgacgttcatcatctctggcggtaaacctttcgccatcagcttatctgggtggtgctcattcatcagcttacgataagctcgcttcacctcttgtgcactcgcactttcgctcaccccaagcacttcgtaggcatcggccaattgatggcgtgatgaaggctgctgccattgctgcccactatgggattgctgctgcgaaccaccaaagccaccaccttgttgaaatcgaaacgccgcttcctgcatgcgtaaacggcgctctaactgctcggaagaaaaaccaagcccacgcgcaatacgatgcagtacttgacgctcactcgggtgcacatccccatcagcaaacgcggaagagacttgcagctcaaggaaaaactgtagcaggtcaaaacgcccgcccgtggcgattttcacgcgctctaacacttgctctagaggaaaatcgctttctttcccgtcacgaaacgcatcttgtgcagcacgtttttgctctagggtcaggttcatgcgatccatcatgatggtcgcgagttggatctcttctttggtgacttgacccttggcttttgctacatgccccatcaccgaaaatgcggatttaaaaaactcctcttggcgctcagcttggctagggcctgcaccaaaggtaccactttgaaagccagcctgatttaaacgacgagccttatcaaactggtggccaaggaagatcccaaagattgcgccaaaggggccaccaaataggaagccaaaaaaagcgccaagaattttgccaaaaatatgcattatgtgctctcaatctatgaatttttctggagtgaagcggtctgatagtggcgcaagcgtcaatttcctttatgataaggaccgtttatatttcaggctcctaagttcggaatccatcaagttcaacaggccacaagttcaacaggatgtacaaccccatgtcatgcttttcccgcacgtttttagccgcttcgattagcgctgcactctttgcacctcagatacaagcagaagcgagtgtggatgacaatcgcgctcaattacctaatggtgagcagtgtttagtcaaccagcctgagcctactaatcccggccaacagcctatcaatgtcgaagcggataagctagaggcaatcaatgggcagaaggcgacctattcggggaatgtcgttgtcgtgcaaggtaagaaacgcattgctgcggataacgtgactttgcatcaacaagagaatgtggttgtcgctgaaggtaatgttcagttcagtgatggtgagataaaaacacactccaccaaagcgaccaaccatctcaataccgatgaaatgacgctggaaaatactcgctaccagtttttgtgtgaaccgggccgtggtgaagcggtgtatgtttcgaaaacgggcaaagccgtgtatgaaattgaagatggctccatcacctcatgtcctgatggtgataatgcatggcggatgcgtgcttccagcattgatgtggatcagaatgaagagattgcgaccttctacaatccgcgtcttgaagtgcaaaacgtacctgtgttctatctcccctatttgactgtgccaatcggtgatacgcgtaaaactggttttctatacccgacggcctcttacggctcacgaaatggctattcgtttgaagtgccaatttattggaacttggcaccccaatatgacttagaaaccacctttaactatatgcaaaagcgcggaacacaactgaatagtgtgttccgttatctgaccgattttggtgcgggtcaaatcaaatctgaatatcttgccgacgatcagctgcacactgaattaggcgatcgctgggcattccaatatgagcataacggcattttccaacaagcttggaaatttgaaatcgactactccaaagtcagcgatatcaactatttctctgacttagattcgggagtcggtaatcgtgaagatggacaactcatccaagaagggcgtgccacttaccgtagcgacaactgggattctgcgctgttggtgcgggatttccaactactgaccaaggataccactagcacgaacttgccttatcggttaatgccccagctcagctacaactactatgctccagagacgatgaagtatctggatcttgaccttgtcagccatgtctcgcgctttgaaaccgatgcaagaggcaaaccctctgcaactcgagtacatattgaacctgggctcaaaattccgttcagcaacacttggggcaactggacaaccgaagcacgtgtcttgggcacctactatcaacaagatcttgataagaccacagatgccaaactggaagagagtgtgacacgcgttatccctgagattcgcagtgtagcgggcattgtgcttgaacgagatacggtactgcttgatgactacactcaaacccttgaacccaaaattcaatatctctacgtgccagaaaaatatcaggacaatattggtctgtatgattccactttgctgcaaaccgactactacgggctattccgcagtcgcaaatacagcggcgtagaccgaattgagtccgccaaccaagtcagctacggtgcatcgactcgtttctttgatagcaactataaagagcgcctcaatatcgcgtttggtcagattttctatctggacagcaagctcaatccgtccaataaaaatccagacagcacatcggataaaaccagctattccgcttgggccgttgagatggactttaactttgctgactatctgttctatcacggcggcattcaatacgacatcgatagccaagccgttcaacttggcaacagtacattagaatatcgagtcgccagcggttatattcaagctaactaccgctatgttgctaaggattatattcgcaataccgtcggtgacagcattaccaatattgatgacattacccgagacggtatttcacaagcgggcattttggcgggttaccagttgagtcgtaaatggtcggctagcggtcaatattactatgacctgaccacagacgaggcgttagagtggctggctaacctgacttacacttcagattgttggtatgtgggctttacttacagtaaccaattaaaaagctggaatggcaactttgttacggatccttacgcgactccgatttatgagaataacttcagctttaacatcgggattattggttttggcaccagcattggcgcaggctcaagcatgacaggtgtcgatagcgcaggtaactcactcggttatggtcgcccattcttcctgaataactaattcacctagcctgaggaaactcaggcttaaaacattttagataggactgtacatgaaattgtggaaacccacactaattagcgttctcagtgcgctgactctcttcaacgctcacgcagagcccaaacaactcgatagcgtggcagtgattgtcaatagcggcgtcatactacaaagtgatgtggacagcgccctgaaaaccatcaaagccaatgccaagcagaacaagcagcctttgccacaagaaacggtgctgcgcgaacaagtattggaaaaactgatcatcgatactttgcagcagcaagaagcggatcggattggggtaaaaattgatgacaaccgcctcaacgaagcgattaaagagatagcgaaaaacaaccaacagactcaggagcagttgattgcttcggtagcgcaagaaggcttaacttacccagagttccgtgagcaagtccgtaaagagatggcggcgagtgatgcacgcaatgccttagttcgtcgtcgtatcaacattctgcccgccgaagttgatacgttagctgagctgctggcgcaggaaaccgatgccaccgtgcaatacaaaatcagtcatattcaactgcgagtcgatgacggacaagataaaagtaccgcggaaaccttggccaacaagctggtcaacgacctaagaaatggggcagactttgcgcaaatggcgtacgcctactccaaaggtcccaaagccctgcaagggggagattggggatggatgcgcaaagaagagatgccaaccatctttgctgatcagatcaaaatgcagaacaaaggcagcattattggcccgtttcgcagtggtgtcggttttcacattttgaaaatagatgatgtcaaaggcctagaaacggtcgcggtcacagaagttaatgctcgtcacattttgatcaaaccgaccatcatcctcagcgatgaaggcgcgcaaaagcagctcaatgaatttgtacagcgcatcaaaaatggcgaagtgacctttgcagaattagcacagcaatatagccaagaccccggctctgccgcgcaaaaaggtgaactgggctatcaaactcctgatctgtatgtcccagagtttaaacaccagattgaaaccttacccgtaggccaaatcagtgaaccgtttaaaaccgtacatggttggcacattgtagaagtgctcgatcgtcgcgaagtggacagaactgattccgcactgaaaaacaaggcctaccgtatcttgttcaatcgtaaattcaatgaagaagccagtgcttggctgcaagagctgcgtgccagcgcctttgttgaagtattgaaggacgagaaggatgagcagtaaacgcatcattgtcacagccggtgagcccgcggggatcggtcccgatctggtgctcgccctctccgcgcaagattggccacatcaactggtggtgtgtgccgataaggcgttattggcgcagcgggccacgcaacttggcatacaggttaagctactggattatcaacgcgataatccagtgcaagcgcaacaagcaggaaccttgttggttgagcatattcctctcgcggaacccgtcgtcgccggtcaactcaatccagcgaatggacactatgtgttaaaaacgctggaaagagcggcaaaaggctgtatgaatggcgaatttgatgctattgtcaccggccctgtgcacaagggggtgatcaaccgtgcgggggtggctttcagcggtcataccgaattttttgctgaacagtcaaaaactcccctcgtcgtgatgatgctggccacagaaggcttacgtactgcgttagtcactacacatctgccactcgcagaagtgccgcaagcgataacttgtgaacgtctagaacagattgttcatattctccacaaggatttagtcgagaaatttgccattgcagagcctaaaatctacgtatgtgggttaaatccacacgcaggtgaagacggtgtattgggcatggatgagatcgaaaccatcactcctaccctacagcgtttgcgtgagcaatatggcatgcaattggttggtcctttaccagccgatactatttttagtgaaaaatacttgcaacaagcggatgccgttctcggcatgtaccatgatcaagtgcttccagtgctgaaatacaaaggctttggccgctcagtcaatattacgctcgggctgccttttatccgcacttcggtcgatcacggtacggcactcgatctggctggaacgggtcaagccgatgcgggaagcttttggactgcattagcttacgcaattgaattagttgataaaaaagcgcaataacttagagaaaactatgagaaatgatgtccacttagggcacaaagcgcgtaaacgctttggtcagaacttcctcaatgatccttacatcattgatggtattgtgtcggcaattaatcccaaaccggggcaaaacttggttgaaatcggcccagggttaggcgccatcacagaaccggtaggacgtgaagtggataagttcactgtcattgagcttgaccgcgatctggcagaacgcctgcgtaatcatccagaattagccagcaagttgaccattcatgaaggcgatgcgatgcgtttcgacttcaagcagttggtgaaacccaataacaaacttcgcgtgtttggtaacttaccttacaacatttcaacgccgctgatgttccacttgtttgaattccaccgtgatattcaagacatgcacttcatgctgcaaaaagaggtggtgaaccgattagccgcaggtccgggaaccaaggcctacggtcgactaaccgtgatggcgcaatactactgtaaagtggttccggtactagaagtgccacctagcgcatttgtgccaccaccaaaagtggattcggccgtggtacgtttggtgccttatgaagatctccctcatccagcaaccagcttagagtggttagatcgcgtggtacgtgaaggctttaaccaacgccgtaaaacggtgcgtaactgttataaaggtttggctgaaccggaaacactggaaactctgggcatcaacccaggtatgcgcccagaaaatctgaccttggctcaatttgtggcattagcgaactggcttgatgccacacacaaaactcacgcataatcgataaggacgacattcagtcgtcctttgtttatctgccaatatctgactactaagctgaggagtcgctcatggatgtttcgctgccctgtatcaaaattcaggttcaaactcgctacattgaggaacaatcaaatcctgagtatcagcgctttgtgttcgcctatctcatcaccatcaaaaatctcagctcccagaccgtccaactgatgagtcggcgctggttgatcacggatgccgatggcaaacagaccgtggttgaaggcgatggcgttgtgggagagcaacctcgcatcaaagctaacgatgaatatacctacagcagtggcacggccttagatactcccgtcggtgtgatgcaggggcaatatttgatgatcgatgaacaaggtgagtctttcacggttgagattgaaccatttcgtttagccgttccgcatgtattgaattaagggagtttgtgtggcgaattatatcgttggagatattcaaggctgctttgacgagctacagcaactgctcaagcaggccgaatttaattctcagcttgatacgctgtggtttgcgggagatttggtcgctcgtggtccaaaatcactagaaaccttgcgttttgtctatcagttaggggatgcagcacgagtcgtgctcggcaatcatgatttgcatttgctctcagtagcactcggtcaccactccgctaaacggcgcgatcaaacccaagcggttttagatgcgcctgacgccgcgccattactcgattggctacgtcagcagcctttgctcgctgaacatcaagagtttgtactgtgccatgctggcatctcaccacaatgggatctcgccactgcacgccaagctgcgcaagaggtcgagtctgtacttcgcagccccgagtggagcaccctgattgagcagatgtacagtgaccaacccgacgcatggcatccaacgctacaagggatagatcgcttgcgttatatcgttaacgcatttactcgtatgcgcttttgtttcccagatggtcgtttagatatgcaatgcaaactgccaccgaaagaagtgactgacggtagcttactaccttggttccaattaccgcagcgtattgctcttgaaaagacggtgatttttggccattgggcggcattagaagggtatgtgagtgaaacggtgatcggcctagatacgggttgtgtgtggggcggaaccctgactatgctgcgttgggaagataaacactactttagccaagcagcgctgccagcataaaacaacacccgttaatacgggtgttgagtgtattttctctgacgatacctgcaatgacgatccccaaacgacttggagttgcaggtaggcggcaaaataagtgacaaatgtgtctagaaccaatttgcgcagccaacactgctgcacatcaagtaggaaggggatattggcgttcaaaaatcacaaaatccatcccgtaggcatttttttcatcggcaggataatgctcacgagagcgctctagccaatcactcccccattcaggaaactgagtatcaccatccaattttgcatggatctcggtaatatacagtttatgggccatcggcaaacaggccgcatacaagctaccacctccgatgatcatcacctcgtcgacctcacccgctttcgccagcgccgcctcaatggaggtcaccacatccaccccctcaatctgcaaactcgcatcacgggagatcacaatattgtgccgccccggtaaaggacgtccgatcgattggtaggttttacgccccatcactacaggcttacctaatgtacagcgtttgaaccacgcgaaatcagccggtagatgccaaggcatctggttatctttaccaataatgcgctggtctgccatcgcggcaatcatactgatcatcatttttctcttaccttaaataatcggtttgcggcggtagaataacagtccaggtacagcaaggccaaccgccaaacccgcaatgataaacatggctttaaggaagttttctaataaggcttccatcagctcgggcgaaaaacccacatggttaatttcgactaacgcgatcatggctttaaatgcaaaaacaccaggaaccatcgggataagcgcagcaaccgtaaacactttaggatgagccagaaaacgacgagaccaataaacaccaaccatacccactagagtagcggcaaaaaaactcgcccactcaatcggtacgccaaagtgcatcatcaaataacgcgagccatgaccaagtgcaccacctaacgcacaatatttcaatgcgggcacaggcacattgaagactaaagcaaacccaaccgccggaatcgcggcaaaaaacatgtcgttgagtagtccgaaaaacagatcccagcttaacattaccacccccaaattccggtgatgctcattgccgcgacaataccgagcgccgtggctagagtcagcaaactcgccatcacaaagcgtgcgatgcccatattgatataacctttgagcatatctgcgaccgcattaattaatggaaagccgggcaccagcattaacacggaagaggccatgacgatcgtcggtttgttgccgagttgataaatcacagcttgggcagaaatcactgaggtcacgaaagccgttgccgcaaaattgatgagtggattgaactgacgatggccgatttcttggcgaacgatcatcccaactgacgaggcgatcaaggtaatcaagaacaccatccaatcgcccccagccaaacggctgaatgccgcgcaagagaggccaatcatgaccacaactagccaacgattgtaacgctctggactgatgtgattgagttttcgctgcgctaagctgtgatcgagaatgcctttttccatcatgatgcagatcctttgaatctgcgtcaccacacgcatattgatgccgcgatctgggctgcgtcgcgcagtcgtaatgcagtgctctttatagacggtcgtcaccacaagcgagctcgccgagagagagacttcgacttcactcatcccactcgccaaccccatacggcgcattatatcgccgactaaagtactttctgcgccatgcgctaataacatctgccctgcctgagcaatcaaacgagaaacggctctctgtttggattccatgattcctttcctaaaacctaaatatgccgaagagagagtaagtgtgcccgaaacaaactttaggaaagttgatttagacacaaaaaagccgcaactaagttgcggcataccagtaagttaatcagtcacgaacatagataacgtggccgtcatcttcttcatcgtcccaatcatcccaatcgtcatcatcttcagtgatcacttcacgaccagccaatccgtctttatggttataatcccatgtgaaatcgactttttcggcttctgttttctcttccgcttctcttggtaaggtatccatgaactcggcaagcttcatgcacagctctttggtgccttgacgattcgccgcagagattttgaagtaatcgccttcccatgccagagcatcgatgatgttttgaatgatctcatccgcttcttcttctgacatcagatcaactttgttgaacactaaccaacgtggctttttcgccagcttttcactgtactgttcaagctcatcaataatggtcaacgcattgtgtgcaggatcgctttgatcagcaggcatgatatcaatcatgtgtagcagcacgcgacaacgttcaaggtgcttaaggaaacgaatccctaaaccagccccttccgcagcgccttcaatcaagcctgggatgtcagccaccacaaagcttttctccggcagcacgctcaccacaccaaggcttggtactagcgtggtaaacgggtaatccgccactttaggtttagccgcagaaacagcacgaatgaaggtcgatttacccgcatttggcatgccgagcataccaacgtcagccaacagcagcagctctaaacgaatatcacgcagctcacccttggtacccaaggttttttgacgtggagagcggttcaccgaggatttaaaacgggcgttgcccaaaccgtgccaaccacctttggcgatcatgacttttttgccatgttcggccacttcaccaatgatttcattggtgtgaatatcgacggcacgagtacctaccggtacgcgcagctctttgtctttaccgcttttacctgtacagttaccgccaccgccgtttttaccacgctccgcttcataaaagcgctggaaacgatagtcaatcaaagtgttgaggttttcatcagcgaccatatacacatcgccgccatcaccaccatcaccaccatcagggccgccattggtaacgaatttttcacgccagaagctcacaacaccgttgccgccatcaccagcttgaactttaattaccgcttcatctacgaatttcatttttcctccactcaatctcgtgggaaatcttaatcagtctagtaaacctgagaacgtagatcccagaaaacaatcgcctgcttggatcaggctacattcaggtctagggtctagggtctagggtcgaccacactttcgataaataaaaaaccccaccaaacggcagggcttttaaattcatcaagaaacttggcttattcagcagtttcgatgctaacgaatttacggttgttaggacctttaacctcgaacttcactttaccatcagatagagcgaatagagtgtgatctttaccgatacctacgttagtgccagcgtggaacttagtaccacgttgacgaacgatgatgttacctgcaagtacagattcaccaccgaaacgcttaacacctagacgtttgctttctgaatcgcggccgttacgagtagaaccaccagcttttttgtgtgccattgttgaactctcctaataacttaagcgttgataccagtgattttcacttctgtgaaccactgacggtgaccttgttgcttacgagagtgcttacgacgacggaacttaacgatttttactttatcgccacgaccgtgttgtaccacttcagcaactactttaccgccctcaaccagaggagctcctactttaatgtcttcaccgttagcaaccagcagaactttatcaaattctacagttgcaccagtttcaacgtctaatttctctaaacgaagagtttgaccttcgcttacacggtgttgtttaccaccagattggaaaacagcgtacatattttactccgctctttccgcacagcctatgcttatattttatgcgataagggtgtgcgctaaactaatcatcaatagggcgcagattctacgtgaatgatgtgcctatgacaagccatattttgaaaaaaatggcgaaaagctaatcgccaaacaaaagtgccgcaatcatgcctttaagccatgtattaatcaatgatttttagtgtattatgcagcgattccagaagactaaatgccttacacgctcttatttcagccggatttacgatggattttaaagctatccaagcgcttactgccaatgacatggcaaaagtgaacgaaacgattcacgctcaactcaattctgacgtttccctaatcaaccaacttggtttctatatcatcagtggtggtgggaagcgtttacgcccattgctggcggttttatccgccaaagcgctcggttatcaagggtcacatcacacgactgctgctgcgtttattgaattcattcatacggcaaccctgttgcacgatgatgtggtcgatgaatcagacttgcgccgcggtaaagcaaccgccaatgccgcgtttggtaatgccgccagcgtattagtcggtgattttatctacactcgctcgtttcagatgatgacagaattaggatcaatgaagatcctgaaactgatgagtgatgcagtaaacgtgatcgctgaaggtgaagtacagcaattaatgaactgtaacgatcctgataccaccgaagccagctacatgcaggttatttactccaaaactgcacgtctgtttgaagcggcaacccagattggcgctatcctgtgtgatgcttctcctgaagtcgaactggcgatgcaaaactacggtaaatacctaggcacagccttccaactgattgatgatgtgatggattacacttcagatggtgatgagatgggtaaaaacgtcggtgacgatctggcagaaggcaaacctaccctaccactgctttatgcgatgcagcacgggaatcctgagcaagccgcgatgatccgtgaagccatcgagaaagccaatggcatgtcgcgtcttaatgagattctcgcagcgatggagcaaaccggttctttacaatacaccattgaaaaggcgctgcatgaagcggataaagccatcgctgaacttgcgattttgccagaaagcgaatacaaacaagccttgatcacgctcgcccatatggcggtcaatcgcagtaaatagtctgcaaattcggtgagatgaccacagcaactcactcgagaatggattacgttttcttactaaaaaacccctcagctctacgagcttgaggggtttcttttatccgtcccgagctttagacaatgtcgactatggcatcaacgctattttaccaagcgccttgccaaagcatgcctgccgccccaacggcaaacagcagtagggtgctggctccgaccatttctcggccgcagaatgcttttacaccttgctcacgctttgctttgagatagaaagcgaagcccggtacatacaacagggttgagagcatcaaatagtgcaaacctgatgcatacagcaaccatagaccataagccgttgcgccaaagccaatcaatagcaacttccctcgatctctttgctccagagcaagcttaagggtaaaagcgcccaccagaaaatacggcactaaaatcatctctgaggcaaagatcaataagctatcgtaagtgctggaagtatagcgcaccaagatcaaggagacttggatacagagtgtggttaagaacaaggcattaactggacttcccgcttgattctgcttggcaaaatggcggggaaacatcttatctttggcggcaaggaaaggcgcttcggaagccaataccgtccaactcaaaaacgcaccgcaaaccgagatcaaaagcccaaccgcaataatgtacttaccccaaggaccaataatcgtagtcaacacttgcgccatagaaggattcgggtattgcgccaactgattgacttgaatcacgcccatcgacaacagcgtgactaagacataaatcgacagagccgtgagtaacccaagaatggtcgcgcgaccgatgtctttacgctgacgtgctcggcttgataccaccacagcaccttcaatccccacaaaaacccaaaccgtgatcaacatggtcgctttgacctgaccgagcagatcagcgcctgaaatgtgatggagccctgcgaaatccaagctaaatgtggaccagttgaacgccgcaatcgcagacacaatgaaaagtagcaaaggcaccattttagtcatagtggtgatgagattgatcagcgcggcggtttgcacccctcttaatactaagctgtgaacagcccacaatagtagagaagcgccaccaattgaccaccaagtattacctgagccaaagataatctgatcaggcgtatcaaacaacagtcctaaagtactgaacacaatcaccagataagagacgttcgcgaccatggcactaaaccagtagcctcacgccgagcaaaatccggcaaaatcaccaaaaccttcacgagcaaaaccaaacacaccactgttcacatggggtttattgacggctaaatattgaaaagagagcgcaagaaagatcatgccgatcccagtgatcgaccagccgatcatcactgccagtggactggcaaccgctgccatattttgtggcaagctaaacacgcccgcaccaatcattgaaccaatcactagcgccgtgagagagcctaaacccagttttttatccattattttttaatcaccaataacagaggtaaaaagccatcttccccttccaagcatcagtcacaaacaagagaaaatccgcctgcaacagccgaagggccaccattccactcacaagacatgagtcgaagcatacaaaaaacagcgcatattacacgaaaagcagtgggatgaaatgataattagataagtaacataagaattcactagtggaaaaccaatagctggaatttaaaactgaaaaatcaaataattaattttaagacctcccaaatctcaaactacttgaagttgcaggtaggcggcaagtaagtgaatccccataagcataggcatagacataggcaaactatgtgattggggtgaacgagtgtagtcaacaccgctgcagcttcaagtaggaaggggatatcattgagataaaaaaataccgctcttcaagagcggtattttccaatgcttgaatcgattgtcgattattttacaaactcaacaccgatttgaatgtcgcctttgagtgtatctaacatgccatccagcgcggcttgctcataagcgctcagtttgccgatatccagcaacgcttcaacgccatttttacctagcttgataggttgggcaaagaatggagcgtactccccctcaccttctacatacgcgtactcaacaacatcagattcgccttgcagtgctttaaccagtgcaagaccaaaacgacatgccgcttggcccatagaaagagtcgctgaaccgccacccgccttagcttcaaccacctcggtacccgcgttttggatacgtttagtcaaagcggcaacttcttcatcggtaaagcttacgccttctacttgcgacaacagaggcagaatagtaacccctgagtgaccaccaatcacaggcacacgaacttggcccggatctttatctttcagcgcggcaacgaaggtttcagagcggatcacatccagtgtggtgacaccaaatagcttacgcttgtcatacacaccggcttttttcagcacttcggctgcgatagggaccgttgtgttcactgggttagtaataatgccaacacaggccttcggacacaccacagcaattttttctgccaatgctttcacaatgccagcgttcacattgaacagatccgcacgatccatacccggcttacgtgcaacacccgcagaaaccagaaccacatccgcaccttccagcgcaggcgttgggtcttcacccgcatagcctttgatggtaactggtgttgggatatgactcagatccgcagcgacacccggtgtgacaggcgcaatatcatacagcgcgagatcagaaccagcaggaagacggtttttgagtaacagagcaagggcttgaccaatgccgccagcggcaccaataacagcgactttcatcgtaaatctccttgagagtaatctcttatatgtttgtagggtgattaggtgtatccgaccgtcaaacgctatagtaatcacaatctgattacaatcaattaacgtcagctttgcgactttgcgcaatactgctgagaaggcgttacagcatcaaagacgattatcggttaatgttcaattgagacaaagagttatacagcgatctaacctgataacaaaaacatttacagtgacagtgaagacaattttagcgagtcgtttggtgtgtcatgcataggtatgcgagaatatgcacaaatcgatcatttaaccaaagtaagaagaaccatgcgtaacgtagataaacaagacaacctagtccgagccttcaaagccttactaaaagaagaacgctttggctcacaaggcgatattgttgaagcgctaaaaaatgaaggctttgacaacatcaaccaatccaaagtatcgcgcatgctgaccaagtttggcgcggtacgtacccgtaacgctaagatggagatggtttactgcttgcctgcagaattaggcgtaccgacagcgagtagctcactgcgtgaattagtgctggatgtggattacaacaacgcgttggtggtgatccgcacaggtccgggagcggcacaattgatcgctcgcttgctcgactctctcggtaaatccgaaggcattctcggggtagtcgctggcgatgacacgatttttatcaccccgaccttggatgttccagtgaaagagctgtttcactctgtgtgcgaattgtttgaatacgccggttaaccactttctcatttaatgatgtttagtcacgccatagtgcgtgactaaactcacatcttagaaacatcattactcaccacttaaacagactaagcatttgaaattaaaagagtatacttacggaatactcaacgctttgctgtttaataaatgagtcaatcacactataaattttaacagttgtgtaattatctgttgtttttttggtatgattccgctgctttatcgttctttgccgcgaataaagcaacgtttctcaggcaggaaagctcgaagccgcgctgacgctttgggttacattaccaatgaaggaagggaaattcatgtcattacctaaaataatcaaaatgggtgctatcgcagccgcagttatcggctctggtgtcgccagcgcacaggatttcattactatcggtaccggttcggttactggtgtttattaccctacgggcggcgctatctgtaaattagtgaacaaggatcgtaaagatcacaacattcgttgttccgttgaatcgactggcggctctatttacaacgtcaacactatccgttctggcgaattggatttcggtattgtgcaatcagattggcagtaccatggctacaacggtacgagcgaatttgcagaacaaggcccatacaaaaaactgcgcgcagtattctcaatgcacaccgagcctttcaatatcatcgcgcgtgctgattcaggcattgaaaacgtgaaagacctcgcgggcaagcgcgtcaacattggtaacccaggctcaggcgatcgcgccactatgcaagtggtgatggatgccttcggttggaataacgacagctttaaactggcggcggagctcaaaggttcagagcgctcacaagcgctgtgtgacaacaagattgatgccttcatctacatggttggccatccaaatggtgccatcaaagaagcgaccacctcttgtgctgccaaactggttcccgctacgggccctgagatcgaaaagatcgtcgccaacaacccttactatgcatacagcgttgtaccggctggcatgtacagcggcacagatcaagaagtgaaaagctttggtgtggcagcaacgttagtcaccacggaagaggtgtctgaagcggtcgtctacaacctgaccaaagcggtatttgaaaacttcgatacctttactcgcctccacccagcgtttgctaacttgaaaaaagaagacatggtaaccgcagggaactctatcccactccacccaggtgcagtgaaatactacaaagaagcgggtttgattaagtaacgcgtttcaactgagaagggagaggaaatcctctcccgtaaaaataacaaaagaggaggcaaatgcctcctccttagtatcacgttcacgtttggtgatactactttcaggtacaacactctcagtaccgatgacaagtctatggaacatcaataataaggataaggtacatgacgcagacaacaacaccgtcgcaagatgtgcaagagatggtggcgcaagcagacactggcgctcgagcccccaaagggcttccggggcgtgtgctttggtttgttccgctctgttggtcacttttccaactttggtacgcttcaccactcccctttatcttcgacttcggcgtactcaatgatacgcaagctcgctccattcacttaacgtttgccgtttttctcgccttcacggcctatccggcaatgaaaggttcgccgcgcgatcgtattcctttaaccgactggcttttagcactcgcgggcagcttttccgctgcttatatctatctattttacgccgagctcgcaggacgctcaggcgcacccactcagtttgatgtgatcgcctctgtggtcggcatggtattactcctcgaagcgacacgccgggcattaggcccaccactgatgatggtggccgcgctctttttactttacaccttcgctggcccttacatgcccgatgtgattgcccacaaaggggcgagcctaaataaggcgatgtcacacttgtggctcaccaccgaaggggtatttggtgtcgcacttggggtatctacctcattcgtgttcctgttcgtgctttttggtgccatgctggagcgggctggcgcgggcgcttacttcatcaaagtggctttctcgatgcttgggcacatgcgtggtggtccagccaaagcggccgtggtagcgtcaggcctttccggattggtttctggctcttcaatcgccaacgtggtcaccacgggaactttcaccattcctttaatgaaacgtgtcggctttcccggcaccaaagcgggtgcagtggaagtagccgcctccaccaacggccaactaaccccaccgattatgggcgcagcagcttttttaatggtggaatatgtcgggatttcctatgttgaagtgatcaaagcggcgatcctacccgcactgatttcttatatcgcactgatttatatcgttcaccttgaagcgtgtaaggcgggcatgagtggtttacctcgtcgtcatcaatcgacggtggctcaaaagctgctctcatttaccgccacgattcttggtttatgcgtgataagtgccgtggtttattacggtatcggctggactaaagaagcctttggcgacgcagcaacgcccatcctcactgtggtgttattggccgcttatgttggcttagtgaaaatatccgccccctacgccaaagagggtttagggattgatgagaatttgcagtacgtccccgatgtcgccccgacgttaaaatccggcctgcactacttgctgccgattgtggtattggtgtggtgtttgacggttgagcgattctcgcccggcttatcggccttctgggccagcgtgtttatgattttcatcctactcacgcaacgtccactgatggctctctttaatcgcacgggttcactgggtgatgcggcgaaagagggcgtgactgaccttttggaaagcttagtctcaggtgcccgcaatatgatcggtattggggtcgcgaccgctgccgctggcacagtcgtgggggtagttaccctgactgggattggtttagtgatgaccgactttgtcgagtttatctctggcggtaacttgatgctgatgctgattttcactgccgtgatcagcttaattctgggtatgggcttaccaacgaccgccaactacatcgtggtttccaccttgatggctccagtcattgtcactctaggcgctgagcatggcttaatcatcccactgattgcggtgcatctgttcgtattctatttcggtattttggccgatgatacgcctccggtcggacttgccgcatttgccgcggcggcgatcgccaaatccgacccgatccgcaccggtatccaaggctttgcctacgatatccgcaccgcgattttgcctttcatgtttgtgtttaatacccagttgctgctgatgggtattgatagctggtggcacttaatgctgaccatactctcttccatcaccgccatgttgctgttctcggcggcaacccaagggtggtggttaaccaaaaccaaatggtgggaagtcgtcgcgctactggtgctgaccttcaccttcttccgccccggtttttggtgggacatggtttatcccgcgcaagtcatgtatgccggcactaagttagagcagattgtcgagcaagctcccgttggacaaccgatccagatgatcgtcgcgggagagaatcttaaaggcgaatacacctctaaaaccgtgcaactgccgtttgaagatcgcgctgtcagcgctcaagagcggatcgcctcaatgggcttaactctgcttaatgataaaaaccgcatgctagtagaaatggttgagtttggcagcccagccgaagcagcgggcatcgatttcgattgggaaattcgctcagtggtggtcgatagcgatcgaccaatgaaagagtgggtattcttgcctgcgattttgctgaccttactgctggcttggaaccaaaaaagacggataaaaaaggcgtaacaaggtgctacgtcaatatgcctgagtcaaatcaggcatatacttatcccgtcaatcaatcatcgccaacgcatccctaagacgcatgttgcgggatgacgaataaaccctagagagcgtcatgtataaacatattcttgttccggttgatttgaatgaacaaggctttgccgacaaagcggtgcaacttgctgtctggcatgctaagcattccaatgccgaaattcacttgctgaacgtgttgcctggtattcacatgtccatggtggcgacttattttcctaaagacgcggccgcgcagatgaaaaatgatgtgcgagcacaactcaaagcctttgcggagaagcacatcgctgaagaggtggtgtacaaactccacatcgccgaaggcaaaccttacgccactatccttgattatgccgagcgcttaggggctgacttaattgttatgccaagccacaaacgctcacgcatcgataaagtgatgctcggctccgtggccagtaaagtggtagaaaattcgcctattaatgtcatggtcgtcaaaccacaaggttaatcggcactcatcttcaatcgtttattcaaggcgcatattgcgccttttttgttcaccgattcctatcacactaattggttttgcctgtttgaataactgagaacgattatcgataatcaactcatcgaacaagatcaggtggactgaatcatgaaaaagacattaagttttgcagcaatacactttaccatcgcgtttacggtagcgtatgtactgacaggcgatgtcatcatcggcagcctgattgcaatgctcgaacctatggtgaacaccgttgcgttttacttccatgaaaaagcatgggtgaaatccgctgctttacaacgctttgcgggcgacccaagaatcaaaacggccagcttcgcgacgattcactttaccgtagcgttcagcgtggcttacctgttgacgggcagttggttggtcggtggagtgatggcgatgattgaacccagcatcaacacttgtgcctactactttcatgagaaagtttggcaaagcaaacacgcaggccatcttggctgtgctcactaagtgtgatgccaaagcatcttcaaacgccttcttgatgaaggcgttttgtattgttgatgcaaaaaacgttacagcgggaaatggctaacacaatgcgcttcactcaagcccagtcggaaacgcttaacttgtccatccaactgcacggtgatcagatacagatcttctgctcgcgggtggcgcacatcgtagatcttaggggcatcaacctgaaagagtacgctcgcatgatcgctacgcacatcaatcggcacttgataggttcgcccatcaaattttaccgcagcggaaaccaagcccggcgaataggtggtgaaaaacaggtttaccagcaactcgcagccgctgtggtgccaaatttgctcagttgaaacatgggtcagacgcaaatgacggatgcattgtagataaggcgctttccagatccccattcgctgatcataactgggcacatcctgctcgcccaagaaacacaactcgctctcctcttcatccagcaacccatcctcatccacttctaaaaatagaatttcaaatcggttgcgacccggcttcaataatgaacgaatctctttgcggtaaatcgcttgtgagccatcacagtcaaacagcgccacaccgttaaggcgcacttcagcgtggtaatcaatgccttcaatcaccaaatcaatagcggcaaagctcaacaaatcgtcatccacctctatatcgtgcattaaatgccactcttgctgcgcaatatcgtcttcgctcaatgttttgggcaaaacggcacttaatggcgctggaaaggtgatgtcatcttgagggatggagagatccgtcagtggagagagttgccaaaggccggcgagtgagagctgcataaggttccaattcctgttggtttgcgcgcattatacccgaagtgaaatctattgcagcgtccatgtaacacagtgattgtggcttacaatcgattggtacaggcaaaaaaataccagccctgtggctggtatcttagactcgaggattaatgctcgtcgtcttcatcctcatcttcgtcagagtacaaagcgtcttcgccttcgtaatacgtaccccaaccgtcataaatgatgtcaaacttttcagccagattgaccagtttttccacttgttcatcaatcagtttggcatctaatgcagactgcatggtggcatcaaagcagagcagcttattaccatcttcatcttccgtttcttccgcttccagcacttcaaaacccattttgaacgcttcaacggccgctttttccagcttatcgaaatcttctgcaaacagatggtgttcaatctcatacaaggcatctggatcactgccatcttcgagcagggcctgaataatgtcgcgagtctcttccttttggatctcgattaattcttctacagatagataatcatcttggtgagacatgatgtgctccagatagtcaatgggatcggaaatttgtgcggcgcactatcgcatggattgaagggaatttctagccacaaaacgatctgggaagatctttcactgaactcacgatcctttctttataaggtttttaacatttttttatcaaatgccaaattcagcataatctgtgctctctctatccgttgaaatcgagcggctgattgcctgtttatggaaagataatgcatagctaaaaaacgactaaaaaaggaaaaaatgccacccttcccttcaagcactcacccattgtgaataaatagttaatttaagaaccaaaaatgcataaacacatcggcttatgctgcgcatagctaagcaaattgagcaacaacacacttcttaggtgcaaaaagaatacagcgctaaaaatcacagtcaaaaaagacaaataatctaaaaaataaaaataaagcgaagtttaataacacaaagccaacttgcaacttcataaaaatctcttcataactatatcgaaccgaagaattggcaagcaggatgcttgttatacccaaactacttggagtggcaggtaggcagcaagagagtacatccccatgagcatagataaacactgcgactggggtgaacgaacgtagccaacaccgctgcaaataggaaagggataagccatcgctacctacacatcgcaatgggtggcacaaaagagaggaaggaaacccgatgaatcgtttgtatgtgggctctgaagtggggcaactgcgccgtgtattgctaaatcgtccggagcgggcactcacccatttaaccccctctaactgccatgaactcttgtttgatgatgtactggccgttgaagcggcgggcgttgagcacgatgcctttgccaatacgttgcgcacgcaagatgtggaagtgttactgctgcacgatttactcgaagagacactcgccattcctgaagccagacagtggctactgaacactcagatcagcgattttcgctttggtccaacctttgctcgcgagctgcgccacgctcttaaccatcttgatgatcatcatctcaccacgcttttactgggcgggctcgctttttctgaattgcacctcgaatcggattccatgctaccgaaaatgcgccagccactcgattttgtgattgagccgctgcccaatcacctgtttactcgtgatacctcctgctgggtgtatggaggggtgtcactcaatccaatgatgaaaccggctcgccagcgtgaaaccaaccatttgcgcgcgatttatcgctggcacccgatttttgcccagcatccttttatccactatttcggtattgatgatctgcactacgacaacgccaatatagagggtggtgatgtgctggtgatcggcaaaggcgcggtgttgattggaatgtctgaacgcacttcaccacaaggagtggaaaatttagcggccgcactctttaaacatggtcaagccagcaaagtgattgcgatcaacctgcccaaacatcgctcgtgcatgcatttagatacggtgatgactcatatggatgtggatactttttccgtttatccagaggtcatgcgtaaagatctgccgacttggcgactcacccccaagggcaataacggcgatatgcgcgttgagcaagtccccagctatttacacgccattgagcaagcacttggggtcgattatttgaaaatcatcaccacaggtggcaacagttacgaagccgaacgcgagcagtggaatgacgccaataatgtcctcactgtcaaacctggggtagtgattggctacgaacgcaacgtttataccaatgagaaatacgataaagcaggcattaaggtactgaccattcccggcaatgagctaggacgaggccgcggcggcgcacgctgtatgagctgcccaattgagcgtgacgggatttaaactctcaacgcaaaaccaccgcgaatggcggtggttttgtgtcgtagtgtctattgtcagactaacggttaggccaacgaaccagcaaaattcggttactctgtcccacccacggtcagggcatccaacttcagagttggctggccaacgcccacaggcacgctttgtccggctttaccacacacgccaacaccacgatccagcgccagatcgttaccgaccatagatacctgctgcatggcttcaataccagaaccaatcagagttgcgcctttgattggacgggtgattttgccattttcaatcaagtaagcttcagaggccgagaacacaaacttaccggaggtgatatcgacctgaccgccaccaaagttcggcgcgtaaatgccttttttcaccgaagcgatgatctcttctggtgtgtgctcgcccggtagcatgtaagtattggtcatacgcggcatcggcagatgagcgtaagattcacggcgtccgttacccgttggtgccacgcccattaaacgagcattgagcttgtcttggatgtagcctttcaaaatacctttttcgatcagcacgttgtattgaccacttaccccttcatcatcaacgttgagagagccgcgcagatctttgagtgtaccgtcatcgacaatcgtacacagatcggaagtgacttttttgccgactttgcctgcaaataccgacgagcctttacggttaaaatcgccttccaggccatgacccaccgcctcatgcagcaacacacccggccaaccagaaccgagtaccacaggcatggttccggcaggagcggctaccgcttcaaggttaacgagcgcttgacgaatcgcttcatcggcgaaagaaaacgcgattttttgtcccgcttcttcttgtaagaaatagtcgtaaccaaaacggccaccaccaccggcgctaccgcgctcacggcgatcgcctttttgcgccaacacactgatcgaaagacgaaccagaggacgaatatcccctgcgtacgtgccatcggtagccgccacgaggatctgctcatgcacaccacttagactgactgacacttcggtaatgagaggctctttagtacgaatgtacgcatccagttgtttcagcagttcggttttttgctgtttttcccaactttccagtgggttatgcgcgccataaaacgcaggatgttgcgcgcgcttaaacgcttgtacggtgaggttttggccttgttgagcaatcccacgcgccgcgatggcactctgctttaaaccttctaactgaatttggtcggaataagcaaaaccggttttttcaccactgacggcgcgcacaccgaccccacaatcaatattgaatgagccgtctttaatgatgctgtcttccagcactagagattcatgccagctggattggaaataaatatcggcataatcaatctggcgagtcgcaatactggacagcgtatcggcaatatcctgttcagtgagcccagcgggtgccagcagtgccgtttcaatttggttcatcgtcatcagtgtgtgttctctattaattgatgggtaaaacgcgtgtgctgtgtaatgggcattgcgcgtctcacagaatcgagcgttgcaagatcgaactcgaccactttactttgtacttcggcgcctaaattggcgatcacttcaccccacgggctaatcaccatggaatgtccccacgtctctcgtccgcatgggtgatgtccagtttgacccacggcaatcacccagcattgcgtttcaatggctcgggcgcgtaataagacttcccagtgggcttggcccgtcaccgcagtaaaggccgcaggaaccagcaaaatctgtgcaccttggcgccgtaaatctgcgtacaagtgcggaaaacgcacatcgtagcaaatcgataggcccaacgctccaaacggcgttgaggtgacgaccacctgttgccccggcgtaaaggtttccgattcgcgataacgctgatggccatcagcgacatcgacatcgaacatatgcagtttatcgtaaaccgccactcgctcaccttgtgcattccacaataggctactggtagtaaccccctcagcgtggcggatcggcatactgcctatcaataaccatacaccatattctttggcgaggctcgctaaggcgtgctgaactgggccgtgatccagtgattcggcttgttgatggtattgttcacgattccccaacagcagggcattttctggtgtcacaatccattgtgctccttgctgagcaagcttggccacctcttgtttgagataagtcagattacgacttatctcagggcctgaggtcatttgcaccagtccaactcgttgcattttcttccctattcagtcagtttacgcagcttttccggcaacttgaattcgcctttactgcgcgaaagctctttcactgtcggtgaatcgagcggtccttttacttcatagttgacttgagtaaacacttccactaccggagagatcaccgtagtgatcgccagcacatacaaggcggtttgaggtgtcaccgcaaacgccgtcaataccggaatgcctgatgtaatgtctgggacgaaattcacttctgcatcgaccgtgcgcgtattgagatcggcgagacctttaatcgtcatctctccggccaccgcatccattttgatgttattggtgacaaaaattccttgggaaagctcaccactgccggagatcgaatcaaacgccatccctttatcaaatacatcgctaaagtcgagctgcattttgcgtatgattgaatcaaggctaaatagaccaagtaaccttgccgccccactcacatcggaaatcaccccttttccaagtttggtatccaccttgccttgcaaagtgttgacctgcattgaccacggagcgccatcccattgcgtgcttgcggtaatctcaaacggcgcacgctggatacctgagttgatcccaaaacgtgccatcaagtcactgttgttatcgcccttcatatccaaattcatttgagttcggctctgagtatcggtcagcgtccaagtgccattaacatgcagttggttggtaccactagtgaaatcaatgctcttccacagcagcgtatccccttggcgctgaaaatcgacattggcttggccgattttgtagccttgcaaccaaaagtctttgatggtcaacgtaaggttaggcatccattgatggaatttacgatcaaaatcggtgataagcggtaatttctggcgatcaagatcgaccagcaacgcctcttcccccgcctcgagctgaggcaaaaacagatgcaggcgctcaagcgcaatactcaaatcataaggctcaatataattggcttggcctttgatctcttggctatccagattgagaagccagccgaggtctttgcgccgcgcattaagatccacgtcatgccaatccaaccctgcaaaggtcagctctttaaccgccgcatccactcgctccggcattggaaatgcaggcgtatttaaactggctagcttagattttcgcgatttaggcgcaggcttttcattcaaaatggagagccaatcatccagattgaacgcttggctacgcaactggacatgatgccccaccactgggctaattttaaaactgccctgcccaagcaccagattcgtggctttcagaaccggtactttaggcgttaaatcaatctcggcctgatattttgcttgcggcagttgcaagcgcgcggaaaccatctcttgattgcccgaggcttgcaacagagcctgccctttcactttgagtgcttttttaagtgggaaggggtagcggctctctaacccgcgcaaatccgccttaccatccaattggtaagtaaagcccacatcattgagttgaatgtcaacgctcgcctgccaaggtgcatggcctttcactcggcttaaccagcgttcgcccacaaacgggatcagcggtttgacttcccaatccccaaccatatcaatgccaaccgcataacctcgcttggcatcttcgcctttaaaatcgatcgagacgggctgtttgagcaaacgggcatcaagccccgctgcactcacgcggtcattatcgaactcgattttgccagacacagaggtaaggctcatcggcggtgtatcaatatccaccgcgttattgctcagctcggcaaagccccaagcccgcggctctgcgccactgtggaatggaatattgagttgaaactctgagcgcaccggtcctttaacttgaatcgtggtcagcgccgcgcctacggaatcgactaacggggtcgccatcatgtaattgcgaatcgcgttaccttgctgggcactggctaccgcttcaatctcaatgtgacccagctcggccaattcaggaatacgaccggtgatccgttcagcactgacttccatcaaggtagcagagcgcgagtcgagatacatggcgtcattttcaaacagcagatcgagctgcaaatcggtgatcggtggccaagccgtatcaaaggcaaatttggcctcttttaaaccaacccaagcttggaacacgccattgtgcatacgataaggaaactgatctaacgcgccataccagatcagtttcgcggtattgacttgtcccgcttgaatcgcggtcgagagataatcggtcagctcacgccctaacgccaacgtcggcaagtagcgccatgtctccccagcattaaagagatcggcttcggcataaaatgagaggaatgggctagcatcatccgggaaatcgaggcgaaatgcgcccagcgcttgcagatccggcgtcgctaccgtgactttatcggaccagagcgaccatccatattgctcttgctgccagaccagattcactgcgccttggcggatattcagaggagcttggaacacctcaccatagggcaagacgtcatccaccatgctggctttaatgagtgctttgctcggtgaaccttgaatttgcgcttgcaaagcattgacttggggtagcaactcccattgcgctattccgccatcaattaatgatgccgaataacgtaatgattccaacgttgcgcctttggcaatccgcacatcttccaaagtccctttcggctttaaggttgtcagccaatgattgagcgtttgtgactcggggatcaacttagccagaggtaacaggttctcaatattgagctgagagagattgagccgccactcatcgggctgccaatccatcgccacatccaaaagcggccatagctcatcatcacttcgtaaacgcagtgagtgggcattcacttgccaacctttctcggttggtttgagttcgacaatccctgactcaagcagcagttcatgggtctgctcaccgttttgccacaccaactccgaaggcttaaattcgacatagccatctttcggctgattgtgttcaagggtcgcccaagcatttaagcttacttggcctttttgaatgccagtttgatcttttaaatatcgtgttaaccaaggtaatacgcgcactttatccgcgctgacatagaaatcgcccgacacatcgcgcagcgaaccatgatcaataaagttagcgcttaccaacaaagagttgatgttgatgcctgcaatactgaccaccccttcagcaaagtggcgtagaccttggttttgccaacgcagtttttcaatatcgagttggcgcagatcgccggcaaaagtgcgatacaaaatcgctgagtttttgagggtgaaatcatccagttgacgcagtaagagatcatcgagctgtttgactacgcgaccttgacgcgactgtttcggattaggattttgctctaaggccagccagtcgatcgcccgtaaatcaaggactaaaccattgacagtaagatcggcaaccacaggttgccgctgccacagtgattgcagcaggtcgaactcaatctcgacactggccgcattcagctgaatatcgttactgtccggccaatgggcttgtaaggtttgcagtgagagggaggggtgcgtattgcgccagtaaccttgtacatcagcaatcgccacttgtaccgacgagttttgattcagccaatgctgaatctccgcctgaaaacggttcatctgtggcagcaaaatgcgcagggctgtgacggctaaagccagcacaatcagcaggctgaccagcagccacataaggatccgcccgaggcgggttactgtcgaaatcacccgatgccctatttacatcatcacaacatcaaattgctcttggttgtagagtggttctgcttgaattcgcacttctttaccaatgaacacttccaactccgccaaggcatgtgactcttcaccttgcaaagtatcggccactgccggtgaagcataaaccacgaatttgtccgcatcgtaggctcgattcacgcgcgtaatttcgcgcaaaatctcaaagcacaccgtttccaccgttttcacgctgcctcgcccttcacacgttggacaagtcgaacagagcacatgttcaatgctttctcgggttcttttacgcgtcatctccaccaacccaagctgagtaaagccgttgatgttggttttgacccgatctttcatcaacgccgtctctaaagaggtgagcactcgcttacggtgctcatccgacgccatatcgataaagtcaataatgataatcccacccagattgcgcagacgcagctgacgagcaatggcttgagtcgcttcaatattggtgttgaaaatggtctcttcgagattacggcggccaacaaacgcgcccgtattgatgtcaatcgtggtcatggcttcggtctgatcgatgatcagatacccccccgatttgagctccactttgcgttcgagagagcgctgaatctcattttccgtatcgtacatgtcaaaaatgggcttatcgccgtggtacagctctaatttagccgttagctcagggacatattcggaggtaaactctttgaggttttcgaactcttgtcgtgaatcgatgagaattttggtcagttcggtgccgacaaagtcacgcaaaatgcgctgcgccagaccaagctcgccatacagcatagagcggttcttgtatttgctgcgccgctcaatcacttttgaccacaaacgcttaagaaacgccgcatcttgagtcaactctttttcgtttgccccttctgctgcggttcggataatgaacccgccatgctcatcgcaataatgagaaacgattttctttaggcgctcgcgctccgcttcgctttcgatgcgttgtgatacgccaacatggcttgcccccggcataaacaccagataacgagaagggagcgtaatatcggtagttaagcgagcacccttagtaccaagcgggtctttgaccacttgcaccacaatatcttgcccttggcgcaccagctcggaaatatcgcgcacttggaactgctgcttctcactttcggcaacacactcggtgtggggcacaatatccgaggcatgtaaaaaagcggccttgtcgagtccaatatccacaaaagcagcttgcatgcccggtaatacccggctgactttgcctttgtaaatattgccaacaatgccgcgtttggcttcacgttcaatatggatttcctgaaggattcccccttcaatcatcgccacccgagtttcactcggggtgacgtttaacagcaactctgcactcatgagcgcacctcaatgattaaaatgattagaatttgtgcagaagctggtcagtctcgtagagtggcaatccgactaccgcgtggtagctgccttcaatcctcgtaacaaatcgtccacccaatccctgaatgccgtaactgccagctttatcgcagggctcaccactttgccaataggcttctatttcttgttctgacaaagttttaaaccacacctccgtggtcaccaccacggagtgagtgatgccgcggcaagtcacactcaccccggtcatcacttggtgttggctaccggaaagtttgagtaacatgcgttttgcatcagcaaaatcacgcggcttttccaacacctgttgatctttcacaactatcgtatctgaaccaatcacgaccgcctcggccgcgaccaaggccgctcccgctaaggctttatcgcgagaaagccgttcaacatattgcgctggcgactcagccgctgcgcgtttctcttcgacattcggaaccacgacttcaaactggtagcccatttgagcgagcagttcacgacgtctaggggatcccgaagccaacactaatttcgatattgtcatttcacatgccaatggcgtcgaactcggcgcagtaataaaaacatccacggccaaagtatacaggcaatcactccactccagagtgacaacggattgaatgtcacattctggatcaggtactcaccacagaaaatcagcacttccaatcccatcgacagcaaaccaatcacaatcgcttgctgccatagagccatgttgcgcagtaccaagaaattcatcgcgaccagatagatgatgatcgacatcatcatgccgcgaatacctaaggtggaaccgagtaacagatcccacaataagcccatgaccaaagcgctgccgacattcactcggtgcggcagtgccaatacccagtaacaacagaccagcagcagccaaggtggccggaacagatctaaggttcccggccatgggatggtttgcaaaatcagcgccagtaaaaatgaggcaagaatgaccatgcggcctttaatatcactgctgagcattggcttcttcctctaatagcacctgcggatcagcctgcatcactttttgtaagcgatcttcgtttggccaaatcagcaataagtagcgcaagcgatcaaattctactacaggatcggctttgatcgaggcaaactcacggcgcgtgtctttatccacctgtgacacaatcgccactgggtagccttcagggtaaaccccacccaagccagaggtgacgagcatatcgccgacttcaatatcggtactggtaggtatatgttccagttggatttgatcggtttgtccattgcctgaggcgatgactcgaatatcattgcgaatgttctgtaccggaatcgcggtattagggtcaatcaggagcaagactcggctattgtgcgccgccacaaaggtgacttgtccaacaatgcctttttcattgatgatcggctgaccttcgtacactccatctacccggcctttatcgatcacaacttggtgacgatagggcgacgtatcgaccgccatcacttcggtcaccacctttttctcatcacgcaaaaaggaggatccgagtaacttacgcagccgttggttctcttctttgtactgctcaagcagtaacagattacttttcagggtcaggacttcacgttttagcagttggttattttcccgtaactgctgatgagagctgatgctgtcataaaaatcgtcaaacagtacgcgcggcagatccgctgcgtactgaataggcgcaaccagactattgagcagaaagcgtacatgtgagaatgcacctaaacgactatcagccagcataaggctggctgatagcataaccgcaaaaaatagccgtagctgcagagaaggtcctcgaccaaagataggtttcatccaataaccatcctaactctgagcaaagtgccatgcataaggcacaacactacggtttattcttcgctaaacagatcgccgccgtgcatatcgatcatttctaaggctttaccacccccacgcgccacacaggtcagcgggtcatcggcgatcaccacaggaatgccagtctcttccattagcagacgatccagatctttcagcagtgcaccgccgcctgtgagaaccataccgttttcagagatatctgaagccagctctggtggacactgctcgagtgcaaccatcaccgcagacacaatccccgtcagcggctcttgcagcgcctcaaggatctcgttcgaattcagtgtgaaactgcgtggtacaccttctgctaggttacgaccgcgcacttcgatctcttgcacgtcatcgcccggataagctgagccaatttcgtgtttgatcttttctgcagtggcttcaccaatcaagctaccgtagttacggcgcacataattaatgatcgcttcatcaaaacggtcaccaccgatacgcacagaagaagagtaaaccacgccattgagcgagatcaccgccacttccgtcgtaccaccaccgatatcaatcaccattgaaccggttggctcagaaacgcgcaaaccagcaccgatggcggccgccattggttcatcaatcaagtaaacctcacgagcgcccgcacccagtgccgattcacggatcgcacgacgctcaacttgggttgaaccacaaggcacacacaccagtacgcgtgggcttggctttaacacgctgttgtcgtgcacttggcgaataaaatgctgcagcattttttcagtgacgtaaaaatcagcaataacaccgtctttcattgggcgaatggctgaaatattaccaggggttctaccgagcatctgttttgcggcatggccaaccgctgcaacggttttaccgccacgacctttgtcttgacgaattgcaacaacagaaggttcatcaagaacaattccctgtcctttgacataaataagtgtgttggcggtacctaaatcgatcgataggtcgttagaaaacatgccacgaagttttttgaacatattcttcgttcgtcctgcaagaaatgagaaaaggaaaattgcactaaatgtaccaatgccttgccatcacagcaaggcgttgatccataaacatggactgaaacacgcaatttctaacagttctctaacggaatgagagaaatctggatccattgagtgcttaatcattaattcgattcgcgccaccagatcacccgatcactgccgcgatacaagccaaattgcgctcgaccttgggtggtttgatcaaaattgttgtcgccatctttgtcttcggcaagccacagcaagttgtgcgcattgagatccaacaccgaatcaatcacaccaagagcccctgctcccggcgcactaaagcgaatggcgcgctgacctgagtttaaattagccgccgaatgctcagccaagacttggggaggaaccgcaacgccagtggtcaatacggtataaccgttgttattaggatccgattgcaaggtaaagcctgtgatcgcaggcagtgcggtgcaactgtcctcaatcgtacgaacaaaaccattgttggtgaaatgctcgacatagatgggttgctctgaggcttgagtctctggcccatacacatcttgaatgactaatttgccccaatacagcggcatagctccatcaatgtgtgaaaacgtatatcccaaacaaggggatgacgcattttgtcggtaacaaactccatcctgatccgttaagttagaggcattcaaagtcaaatcaaacgctgaattaaacaccggtttaggttgtaacggtttttgataccacaccctttccccatttaagacaatgccactgttgtttaatgcctgtctgctgatgggcgaagtctgcagattatcgaaaccaagattcacaccgtttgcgctatcactgtaagtgcgaccattccattgattgttataacgccaccaagggtcgatgaggtaattttgcgtatccgcattattggcggatttaggctgtaaatagagtcccgggctattggaatactcgaacggctgaccgagataactaaaggcattaccggttttacatgccgcatctaaggtgacattactcatcggagataccgaaaagtaagcgggaataaagcgcccaatcgatcctgttgacgtcaccgcaatcggtagattggcgctggctaagtcaaggccaagataatgggtgggtgcgaacaaagagaaatcaaacaccccgacttcactcactttttgcgcaatagtcgttgtacccccaagtagatgagtgtattcatttacgcctaacacacccgactgccctgccgatggctgcaccagagtgtgttgtagcgcgatattttgttgctggtagttataagccgttaaattgtttgtgaaatcattatcttcaatgggcgcagcaacaacggctcgaataatcagatcaaagttttcatcggctctcgcaaaaacattacaactgatattctcagcagagcattggccatttggatgtgtcgggttatatggattattcgcactgagtaccaatgccctaggaacacggataaaactatcttgcccttcaagcaacagatcttgctcatcaccgctgcccgtgaaacgagcatgcagagctagactacccacttcacgataagagatcgggaaactcgcctcaccattttgattaaagttcaaacttatcgaggtcgcgttatttgcagactgaccaattggcgttccatttacccccacactgacagattggaatccactattattggccgtcggattgaggtattcactccaaaacgccactgatttttggacattgccaaaacttggtaagcattgttgtgaagcattatctttgcgcaccgcttttatggtgcccgtcaccgtctggttagcataagcattgggtacatcgacaataaaaccgctgtctgcaaaattgaccgtacaattggccgtcgaataactgttgggattgttcgtgtagctacagaggttgacctgaaaaggcttactggcaggagtcgagccaagtacgttgactgacacattccctacactattacgtctcagttgcgccgtggcaattccattattgaaattcacttgtgagccacccaaccaaccaccagtcgcactcggtgctgaatttggggagagcgtagccgtcacaggatccgtgtacagctgactacaattgtcattcgcacaagctttgatctgaacctcagaagcgctacaagtcagcccttgctgtggcagagtgaaacggaagtggtcaattaattgtccaactgggcgagatttcaatgcgcacactttgaagttctcaatttcatggttattgactgatgcgcctgtcgagcccgcgagagaaagtagaaagtccgcgggggttgccccttgattgggattactcaacacgttatgccaatcaatgaccgtttgcatagtgccattcacagagcgatcgacacgaacccaaacgccccccccactgcgcgaatcgatggtgatgaaataacgatggccggggcctgcaccagaaaaagaacatccccaccattgacatgtccgacgcacatctaatttaggattgaggttggcagcagtgcccactaaatattgataattcgctgactcagagccacgaatcgccacagcttgctgacgaaaaccggggccaccttgtcgcccttccgtcgcgttcgaatagttaccccattcatctaagccgacacccaaccatccccccgcaaaacctggtgtatcaggattagtatcggttctttgcgcataacctagagagccaccaaaaccgcccgttctcggagtgaccgtcgcatccgaaaaaattaccgagaccccatcggctccattaccggttaaattcgcccatgcataataatcaaactctacggtaaccaaattgcctgctgcaggaaaaatacgctgataagtcactgctgtcgcttgattggtaatcgcttctgttaagcgcattcggttactaataatactcggtgtgaaattaccgctactggtgtagggaatccaattttgtccaagagatgagcgattaaaatcatcggtaaaacaagcatagccttgctgttcattttggttaatctcagtattagcctccataaataatcgacgacttgtgacccgtccattaatgacagatgtgttatgcagagttaatgtgccaccgacatagagataagcctttacctgattcgattgatttaatgtgatgttgttataaccaacaatggttaaattgcctgatcctgagacattaatctgtgcactattccaatcagaattattgcgaataaaaaggcgtacatccccatccacaacgacttcacctccttggttaagttgcagagattcaatccagtaatcaccgctggaaagaacaagagtcgcaccacttcccatatccaaagatttaattttatattcagtctgtccggtaaaacttaatgtacatgaggcataaagttgtacagtcccaatattcgtttttgatagaagaatactttgcccactattacaccaacctatttccgttccactaacgcttgatgttttaaatgcattaatcccagcaaggctaagcgaaggcacagtattaccagaaacttggcaaagattattatcacaacgagtattaggccgttcattggtagcattaatagaacaaaaatctacaactgaattattcgttccgttaattcttgcgctgttgtactgaattaactgcggatttggtgcgccactacaactgccatggccttgaacaacactgggaaaataaattgagtgatcaatatcctgaaatgccaaagcataagcagagagcaatgcaaaacatcccaatcccactagcgttttggctaaccacttattcacttttcactcctacttcaataatgcgttgtaagctccaatctcctacctgacaacgccctgttgcactgagctgatacaccgcttgcccattatccaatgccccaagagacagacatgatacggttgcctcacattgtgctaatccttcccctgcaaaatccatagattgaggagatgtcgtgtagcaactgcccgcgctcttattgctttgataaaaacgactgagctcgatattaagtgccgagcgggcggccatttccgcgcgagtaccaagcaccatagacaccagttgttggctactacgcgcttgattgcgattggccaccagcgcaacaaatccaaccactacgataataaaaaccacgagaatcaaggcattgccctgctgcttacggtgtgttgtagaccagagcatcatgatcaaaccttacttgctcacctttatcggcaaaagtcagctcaattttgactaatccattgcgctgcaactgtggggctaacacactgaaattggctccactcaggctctgcgccattaacaccccattccctaaataggcaggtgacaaggccgttctattcaaactatagcctgcatagcggtagatgctgttaccttggtaacaatatgccacgggggtagtataaaaataggcgcgattcgcgggcgactgtagggtaaacaaagtgccctgcactaaggggacattcaccatagtgcgatcctgtggtggggtgaaatcaacagtactggcgacttcggcaatttgccccgctgctggtaagagagcggcgcgtaacgcagcaggatcattgggagaaatcactaaacgctctcccgcttggatcgacttagtgatgggcaagaggcgcagagtattcacggtattcgtcggtaatgactgataaatcgcgctgtttacaatcggcagaaactcaatacaaccattggccacgattacgctattgggtacagcttcacgcagttcacggctcatacgttccgttaaaaaacgcccttgctggattaaggcttcacgcgcagtggtatcgacgtaaatccccatcgcttgcccagcaatattgcccagaaataagccaacaatgccaagcaagataatagtgatcaccatttcgattagggtgaaaccacggctcatcagtagttccccttaatcgcagcaaacggatacgcattaccttgcggatcgtaaatcactaatgcaatacgtttgtagtgggttcgctctgtagcaggcgttgccgaaaattgaccgccattatctgatacataaaacacttgtatcgatacgctaaagcgttggtattcagaggaaatatccgtacccagcacatcagtgacgggtattgggcttgatgtgatgtaatcatccacatcgttgaattctgtgttattggattcacctgtatctttacctaacgcggatggtgcactgcaaagcgtacgtccagccgtttccgtaatcacacattcaggtaagccaccattcgggcctgagtgttgatcaaaagcacgccccaaaacttcatccagtactgcccgccccaattctgcggctttcaccgataacacttgctcagcactctgtttggagcgtggatataacgaggtggttacgccgaccagtgcaacgcccaacaccacaatcacgatgatcatctcaaccaaggtaaaaccacgcttagcaatcatcggcttaacaggcatagatatacccttcggtattgatgcagacttggcgaacctcattgtgcgtcgaactgctgatgctcaccgtgcacccagcactgatacattgcgtagcacggcctaaactatcgaaatcaagaaaagaagccccacccgaacccgccaaggaaagcgccacaccactgacggcggcatccacccacgaaggatcggtagggttactgggaaaaacgctaagacaactgccttgcatagcctgcggagaaacttgaatggcggcgttgctggtcaaaagccaacgattacaataccccgtacgctgcatcgcgcggctttgggttaaccgcagtgaggctaatatttcactctgcgtggttaccaccgcaaaggaggaaggccccaaaaatcggcttgccgcataagcagagagtatccctagtaggataatcaccactaccagttcaataagggtaaaacctttacctataattttcataaaataggctcgttacatgcacgagccatatttaaattattgcgctggtttaccacaagcagttccagcaaccccagtctgcatagcaaccgttgcaggattattagaggttgcagctgtataacggacacatagatcgttataaccattgaagcctatgtcaatccataaattagcttgattactatttgttcctgtagacgattgcaacgcaataaactcactcgaagtatctagcgtttgcataataccacctagatttgctgttgaatcatttactgccgttggataaccaaacttatgggcaatgccatcaataactgttccaggtgtatttgcatctgtatatgctgtgtagtctaacgtttcaatgcctttaattgcagctcgtccatatgagatacccattgcaccagcaactgcacctcgaagaccttctaaagacgcttctcgcgcatcgccttgcaggtttaagaaacgtggcgctgctgtgacggccaagataccgagaattacaatcaccacgaccaattcgattagggtgaaaccaccttgtcttttcattattaccatctctctttcatgtgaatacgcagcattactgcaaggttacggtcacgcgaccagtgttaacttcataaacaaattcatgttggctgcctttttcattttgcgcataagtgcatgtggcagcaccactattcgctttcgctgaatatttgtaattagaattgctcgccgcttgagtttccgtgcccacttgaggtgggttttgcagcaaattgttcattaaatctatacaagcctgatccgtgagacctgaaggataagtcgcatcatcggtattcaagcccaaaggataaccatcacgatagccgctggttgcggaggtggttaaccaaaaattaactccatcataattaatggaagggtaattattggcggtcaacgtggggcgagcttgcgcctcccattgcgctcgtgcagagagaacaccagtggcaaagccccctgcaaccccctcaatactggctttcttcgcctcatcggtcacatcaagaaaacggggcaaagcggcgacagccagtaacccaaccaccacaatcacgatgaccagttccaccaatgaaaagccttgctgcattttcttcatatttttcaactcacttacgtaacgtacggcgtgcattatacgcctatttttagctttgatgtggttaaagtgtcaaaaattcagcgcatcaaaaaactggcatttatcgcaaagtagcgatccttcaattccacgtcgagttgcaccctatcaccgtattgataacggcactggtagccattcgcgcgctggagggcagtcactcttggtaaccaatccagcaccttacgatcaggatagagcaaaaatagcactttttcacaatcaactccttgatcgagcttgggaaaaacccacccatgttgcattggaatctcggcttgttctatctgtaagagtgcaggacgcccttgcaatacccactcttgcttataagtgtttgcccgatcaatcagttgcaaccttgtcatctctaaggcggtgtgtagcatatcactgaacatcgaccgccataccgaaaacatcgccgtcaataaaaccaccaccaagacaaaccagagaacaaatcggacgcgctcaaatcctattttcattatcagcccttgagtgcatccatcatgccccacataggaaggaagatgcccagcgccaataccagtaccatggccgcgacaaacaccaataaaataggttcaatacgtgccgtgagtgtttttaaatcatagtcgacttcacgatcataaaaatcggacacttccaacagaagttcatcgatacgcccggtttcttcacctaccgacatcatctgaatcactagaggggtaaaaatgttggcattgatcgccgtagcagaaaccgccaccccagattcaatctggcttttcatctctaaaatacgctgctctagaaacttgttgtctatcgcttctgccgacagcgctagcgattggttgagcggcacgccggccgaaagcatcaaggaaaaagtacgcgcaaaacgtgagagctgcgcacgattcactatgtctcccacaatcggcatacgcagacgcaaatgatcccaccgaatgcggccattcgtggtattaacccaagcccgaaacgcaaacaataaaccgactatgatgccaagcagtaagccccagtagttcacaaagaaatcggacgtggtaatcaaaatgcgcgttggtaagggtaagtcgaccccaaagcggctaaacatgctggtaaattgtgggatcactttgacgttcaaaataaacatcgccaacaacacaaacgtaatcacgaaggtcgggtagcgcatcgccgttttgattcttttgcgcgtttccacttcttgttcgtaatagccagccaattgcaacaaagcctgatctaatcgccctgtgttttctcccacttgaatcatggaaacaaacaaaggactaaaaatcgcgggatgcaactgcatggaagccgacaagttgcggccattggtcagctcattacagactgaatcaagcgctgctttgagctgcttattgtggcagttctgggctaagccgcgcatagagcgcagtaaaggcacccctgctttggttaagctgaacatttgtcggcaaaaaatcaccaacacttccagcggcacggagggagtcagtagcgctttccagttaaaatcgaaggcacttttttccgccgccccctgcgcaatcgaagtgggcacaatacctttgttgagcagcatttctgcggctaattcctcagtggcagcctcgactaacccagaggctttgctgccatcggcattacgcccctgataataaaacgtcgccatgcctactcctacagataaatcggttcaaccaaaccagaggaatcaccttcacccagcgacatcacttcatcaagactgacgatgccttgtagcgctaactccatcgccgaagccagtagcggtttataatctgtgttactgcgtgcggctttagagaaggccacagcatcatttgcccgcaagcaatccatcatcggctgatccagctcaagcatttcaaatacaccgatccggccgcgataaccggttaagttacagttctggcagccgcgtccacgagtgaatttggcggcagcttgattagggaaacgcgtcacaagccattggcgacgcgcttcatccacctcatcatgtccactacaatctggacagacttttcgcactaaacgctgcgcaaccacggcacgtaccgcactggcaaccagataatcgggcgcccccatatcaatcaaacgcagcgcgctatcgacggcatcattggtgtgcagagtacttaagactaagtgaccggttaatgcagcgcgcaggccaatttcgaccgtctcttggtcacgcatctcaccgaccaaaataatatctgggtcttggcgcaagaaagtgcgcagtaacgtcgagaaatcgagattgattttcgggttcacttgcacctgattgatccgtgaaatccggtattccaccggatcttccgcagtaatgatttttttgccggacgtattgagctcgttgagtgcgccatacaaggtggtggttttccccgagccggtaggcccagtcaccagaatcatgccatgagggcgtttcaactgatggcgcaaacgcagcaataaatgaggcggaatacctgactcttcgagctttctaacccctgcagattggttgagcaaacgcatcaccaccgattcaccgtgctggataggcatggttgacatccggatatcgacggattgtccttttacacggatgttaaagcggccatcttgcggaaggcgtttttctgaaatatccagattcgccattaattttaagcgcagcactaaggctgaggcgatattcacttcatggagcaaggtttcatgcaataccccatcgatccgttggcgcaaacgcagtacgttggcatccggctcaatatgtatatccgaggctcccacttgaatcgcatcttcaaacagcgagttgatcagtttaacaaccgtcacttcatcgctatctgaatcggtgatctcaaaatcaaaactatcattggttttgtgttcggcatgcaattgctcggcaaacgagacaatttctttggtgcggcgatagtaacgatcaaagccatcgaccaactgcttctcaggggcgatgacaaactcaaaaccataatcaggcaactggttgagcaaggcttcttgagcaaacaaatccgcaggatcactcatggctatgcgcagcgtatcaccactgcggcctatcaccagcgcacgcaaacggcgggcatgaacttcaggcagtaaaggaacagcatcaatatcgacatgggcacggctcagatcgatcactggcaaactcaattgctgcgccaaaaagttcagcaactgggtttcgcttaaaaagccaagcgaaattaaggtatcccctaagcggcgtccggtatttttctgggcattgagcgcttgttcaagctgcgcttcgctcacaatcccctcttcaaccagcaagtcaccaagccgtttacgcagtttattaattggcactttgtgtctcctctaaactggccagtaattgcaagcgttgatgaataaaagcttgtgattgactggataatccgactttattgagagcctgttgataggcgtgctgcgccgccggccattgcagagcgcgctcttgttgaatcgccaaccccagccaccaacggccattattgggatctttttccgtcagttgctgatagctttctcgcgcgatctcatcttgtttggttttctgcgcgagagcagcacgcagtgacagatactcaatcgagggctgcgaaggaagataagccaaaggtaccaaagccgaggcctcttgcttttctttgaccagtaacttagcgagcgccaaacgcagtacttcaccgtcaggattacgttcaatcccggcttgcatcagatcaaacgctttgcgcccatcgcctttgccataatagagtgccgccagtttttgcctggccatttcatcatgcggggtataacgcagcgcttccgtgtaggcggagaccgccgtctgtaactcattactttccatcgctttttgcgcgcgttgcagggctttttgcgctaactgttccggcgttaatgagacttgctctacgatcatcaccggcgatgagctcggtaagcttgagacctcttcttcgaaaaagctcggctctgaattatcgacaagattcagaactggttctgcgtttagctcagaccctagcgcggtttgctctcgctgacgattcgcagtctgcttgagtgaggtgggtgagccttctaccttagcaagtactgcgtttttgacactagtttcgttcttgggcaacgtttctttttggaccaaagtttcattcttaaccaaagcttcgctgttaaccggtgcttgatataaggcgatactttgctgtgtggtcttttgggtcggtgacggcacttctggccgcacaacctccgctgacgacggaatagtatccaccgattgcaatgagatagaccaaccaccaacggcaagactcacgccaaaacctagcatcacccataaccacgctggacgagctttcggctttgcaacatcaatccgctcaatattcgaaaggcgtgagtgacttcgctgcgcactctttgctaatgcttcattcaccacactcatggtttgctccatccccacaaaattggggttttaaatcttggtttgcagctgtcataggtgtcatgaatcgctgcaaaaagatgatgttgattgaccaacgggctctgctcatgccaagcgagtaacagcgccttatgacaaatttgattgatcaaacgcgggatcccttgtgatgcacgccagacggcttttttcagggtcgcattgaacagcggatacggcgcttgggctttctgtaaacggctctcaatgtacacctcggtttcagcttgagttaacgggcgcaaattggcgttaaaagtgatccgctgccgaaactgacgcaagtgatgctgcgcgagtcgaacatcgagttcaggttgcccaattaagacaatctgcagcagcttagtttgttccgtttctaagttgccaaataagcgcaaagtttctagcgcctcatcagacaacgcctgcgcttcatcgaccaaagcaaccacacgtttaccttgttggtgaagctcaatcagtcgtgtttggatctgctcgaccactcgcacgggcgatgctacatccaactgtaattccgcggcgaccgcctgccttaattcttcgccgctcagcataggattcggcagataaatcagcgccacctcatcgcctaagtgcgtcaacagcatgcggcagaccatggtttttccagtaccgacttctccagtgagcttgctgacaccttcccccatctcaatcgccgcacttaaggtttgaatcgcctcaaagtgcggtgcgagccccagaaacaattcggtatccggagtcagatgaaaaggtaactgttcaaggccaaagtgcgataaatacatacgcttattgactatccgggaaccattcctgtagcaaactgcgcgagcgctccagctctttttgccaagtatttaccccaacgaccgtcggcttgagcaaaataaccagttctgttttctgtgtcagttttgtggtgttacggaacagatgccctaacgcgggaacatcgcctaaaaatggcacttttgacacttggtcaacggtatttgacttcatcaaaccaccgatcaccactacatcgccgtctttcgcccgaataaccgaatccgactctctaattgaacttctcgccaatggcagctcaatctcttcacttcggtataaaattttcttggtttgctgctcgacttcaatcaccgcaggatgcacatgcagtaatacgttgccttgatcgtcaatttgcggcgtgacatccaatgaaatcccagagaagaaaggcgtaagcgtaatatctggcgacgcttgcgcgttatccccagttccaaccacactggataagtcggtcacatagtattcatccgtcccgactttgatcaccgctttctggttgttggacgcagttactcgcgggctagacagaacatttaaatcaccttgcgtcgccataaaactgatcacggcatcaaagctgccactggagatcaccacattggattgaccacctaacaaattacctatcgcatctaagccaggtaatacagaagtgataggattgccattactgtcttgagtaatggatccggaacctatcttgtaattggcaccattggaggagaaggctttactccaattaatcccctgctggtaaccatcactgagggtcacttcaagaatcttagcttcgaggatcacttgtcgatgcattcgctgttgcgagatccccagaaactcgtttacttgacgaatttcatcgggataagcgcgcagggttaatactcccgcctgtggattgacaatgaccgtttggccaccgctaccgccaagcaactgagccaccgccttttctaacaaaggccagaaatcactctcgttcgtggtttcaatttccgttccgccacgagcatcgcttctgttggaattagaattgctcgaagaaccatccgaagagctattactactgatgctggacgaggagctactacttgaatttgagttattggtgtccgtattggtgatggtgcccgtcgtaatcgacgttaacgaacgccctgtgcgtttaaattgcagataatcaaccggaatcgtgaccgtacgcaatccagccggatagacttggatcactttaccctcttttaccacctcaaaaccgtacaaatcacgcacgacacctaaggcttcatctagggtaacgtcggtcaagttgagagtaattcgcccagtcaccgcagggtggattgccgcactgtactcggttccctgcactaaactggcaaaaaaggccttggcttcgacatcctcagcttggattcgaaaacgctgcaaagttttcggctcactggcagtaagagtatccatatcaggcatcaaatcagcctctaccgaaggcggtaattggtcaatttgacgactgttcgtctcgttaatagcttggttcagggcttgtttagcttcaacaggatcacgatgtcccattgagcatcccaccaaagaagtcaccactgaagcgagtacgattttacgcataagactctgttaccttattgttttatatcgagcgtaaacagggctaatcgccactctttacctgcccgggtgagtttcacctgatcgggatggatcgttgccacacgatacccattcaccacatccccctgtgctacgactctttgttcaatgatcgcatagcagcttcgtccttctgcacaaacaatgctttgcagagtcggcaccggataactcggcttttgcaattcgggtttagcggggcttacccaacctaaaggcgctgtcggatcttcacctgcataactgtaggtgacggcaattaacgccaagagcacaccatatctaaccaccgataaactcctctcgactgcctaaagtatagacttctaggatcacccgagcctgtgggtagctttccactcgataatgaaagcgacgccaataatatttcacaggcaaagcttccaaggcttgcagataatctcggatagcaaaataggagccagttaactccatacgcacagggtgaatatagtattcagactccgatctcgattccgttgcgcgcacaatcggctctgcgggtaaggactccaaggagaccaacttcaactgttgcccttgttttaatacgctttcgagcaaattaggcatctctgatggagcaaccatcgaggtcattttggccgccagcagctcggaaatttcctgactttgcaacgtcagttggctcagctccacatccaactcttggtctggatttttcgccaactgcgcttgcagcgccatgatttcgccttgaagttgcaggttgcttgacgtcagggtttgcatttgcaattgacgtgcttggccctgttttaaggcgggctcaatcaatcccagcaatagcatcatcacaataagcacgctaccgcacagcgtaattaacaccttctctcgttgcgacagtgcggagaagcgactttcaaagttttgccaacccgatttcatctttgttctcctcgctgagtgttgagttcaaaggtgatcatgtcttgatcattacggccaattttcagttgctcaaagcttctgcccatcagatgcagttcttgtttaaattgactgatccagtttggaatcgcggcaggatcacgagcgagtccctgcacatttaattgcgaggaatccaaagtaatactgcttaaagagatatcgctacgcgccaattgagccaaagagttcaatacgccggaatagcccgtttgctgagccacatcaaactgcccaatcgcgtctaatgcttgctgtttgctagagatctcttgctttatgcgccctatcgccgcctgtttagcgggcgaaggaagatgaaccgccacctgctgacgtaagtgagccgcttgttctgttaacgattgattatgttgttgctgctcttgccactgctgttggatcacccagttttgataacccacccctgcgtacccaagcaataacacaacgctcaaggccaaccacgctaacaagagattggttaaggtgaacttttcacgcttcggcttgaggtgatcttgatagaaattgatggtttcttgcgggatattgcgcgcataacgtgccagttgttcaccacagatggtcgcttcaccatccagtcctgacgctcgcacacttaagcgctcattgagtccggtgatcaaagcctgttgatcttcaccatcacaacacacttttagctgttgtaaagagccgccctttaactgggcggataagtaatcaatcgagcgctgtagctctaacgccaagctatctaactgaagggcactggctgcgttatcagtcacaggcgcagtgatcccacgtaaagtgcgttgaaaactgcactgacgatcaacgaaagcatccagcttaaagctgccacccatgctgcgatgcagcaacaggaagtggctcaattctccgcccaccaatccccaaatcgcttgctcggggatcactcgtcctagcgttaatcccgccgacaccgccatgctttgcaactcaagaatagtacgcttgctgatcacataggcttgtactttaccactgccgggaagagggtgagcatccgccactacatccgtcactttctcactcaacatatctttgagcaagaaaggcaaggctgccgaccactcttcacgcggaatactcggctgttcaatctgataagtttgataaagctgtgaatgcagtacaaggtggatttgtacatcatggacagcgtgcttttgcagcgtttgcaccaataccgcttgccaactttgttgctgtaacggctggggaggaataggcgataaatcatcggatgtgaagtacaggtgctctggctgcaccacaacatataactgttgcgaggcaaccttaggggcaatcagtttctctatccaactcggtttcttcattctctaccactgctatttggttcgccatcgattacgtttgccgatgggctttacagagagacgcggggggcgtttcaatggctctggtggcaaaggaggcaacatctgttgctcctcatcaaacaagcgaccttgcacaccactgacacccagcatctgtaaggtttgccactcttgagtagtttcaaccccaaccgcaaccacttctgcttgggtaccgccacatacacctaccaaactgcgaacgaacagctgattttcatggcgttggtcaattttctttatcaaactccgatgaagtttaagatagttgacttttaagtctttgatatagtgcgtgctgacaattgttcgtcccgcttgtcccaccactatcttgcaacccagccccgccaacatgcgaatgatggggcgcatatagtctaaatggttgaccaaatgcgcttctgaaaactcaaaagagagcgccgttctaagagaaaaaggcatctgcatcaattcgttgcgaatccagcgagcataccgtttatcgttaaatggaacaacgtgcaagtttaccgagagtggttcaaccagttcagagcgcttcaaaaaactcacgacagagctgaatacggcacgatccaacatggcttcatagccgaccgtttctaaagctgagctaaaacgcgacgctttgagaatgccttgttgcggatcctgaatacgcgcaaataactcataatgtaggaactcccgctctccattagcagaaatacgataacaggcttggcgatagagcaaaatctcttccggacgaagcacctgttcaaacaatgtacgccaccgaacgctaccgcgatcctcttgtaactgtttaggtttttgaaaacggctccacgcattcaccccttgcagttgagcacttttgagcgcggtttccatctcatcaataatccgtccacgccgctcaccttcttgatacatggttacaccaatgtggaaccaattgtcttctggcagtggctcagggggattgatgcgctcaatcaacttaatcgcctgtgtcgctacttgagcaatatctttactaccctgatgaggaataaacagcgcaaacacatcctcatagtagcgagaaagtatggcatccggataacgctgtactatgttggataaacactcccccacctcaatgataaactcatcgagcgtacgtttagggctctcttctcgcgctgactctaagtcatcgacccgcagcatcataacgccgccgtgagcgccactctccagtaaagccgattccagcttactgtcatacaacacccgattcgccgtcccggtcagttgatcgaggaaggtttggctacgaataaaggtatcaaaacggctacgttcttgacgggcatcttgcaactcttcaatcaagcgatctaaggcttcacttgcggtgaaaggccactctcgcggatcccccttggcatgttgctccactcgtccagcaagaatcatccgtcctcgctcttccagtaactccgatcctagtagttgctctttcaaccatttcagaccgcggatcaagaaaaatacgatcagtagcaccgctaaggtggtcgaccacatggcttgcagtgaatagttgtaattgaggtagggaggcaccgctttaaaatgcatcacataaccgggattacgtttgagcggtaaagcgacttgatgcaaacgtgaagcttcaatggtgttggtggtgtctttaaaacggtagatggggcccgcttcggaagtaagctgcatttcaatgatgccactcgcttgaagcattttgggcatccaacgctgcatagagtaagcggcgtctggatcttccatctccttatcgacaacctcaactatcccttgtagatagtggttgaggtattcctgccccaaacgctgaaaagataaggtgccaccaaggaacaggataaacatggcactgatcaccgtcatagtgacgaacgccactaaccgagtgctcagttttaatgtcggtgtatacctcatttgtgccacgttccttatgtgcgccgctacctatcattcagaggcgagaagtgtacattaaacaattgagataactatataaaaaagccgcggaatccgcggcttttttcgtcaattacaatactaaaacgggatgtcgtcatcaaaatccatcggcggctcattatactgcggttgcgagtactgttgaggcgcagattgttgcataggctgatgctgcttcgccggttgttgtggttgtccccaacttccttgctgcgcaggaacattcatgccgccttgggctggcattccaccttgctgtgcacgtccacccagcatctgcatgataccgttatagccttgtacaaccacttcggttgagtagcgatcttgaccactttgatcttgccacttacgcgtttgcagttggccttcaatgtaaacttgagaacctttacgcaaatattcaccagccacttctgccaattttccatacagagtaactcggtgccattcggttttttccttctgttcacctgtggctttatcacgccaggtttcggaggtcgcgatggtgatattcgctactgcgccgccgcttggcatataacgcacttcaggatcttggcctaagttaccaatcaaaattactttgttcacgccacggcttgccatgttttgctccgtaatcaagtcatgtctatcaatttgaagtagtcggcaaggataacaccgttttgctcactgaaccaatcgaattcccttattctgatggtcgccgaactcatttcactgaccttgtttgcccattttcaaggcggcttcaccgaaataactcactgataaacttatcggttacttagcctattgaggtgctccgcaaactgcttttatcgcatagcgccaaaatctatttttcgccatattaagtgcattatttcatattaactgagtctgtaattcatcatgcaacgagccaactatgcacgcacgatttatttattaacgacacagccaaaagcgttacatcccagtattcaagccgccattgagcagttgaatctgcccgtcccggtgattgaaccagaacgcttattgcgcgagtatcaatccgataaacacaaaatattgttgctcgaccatgcggaaaatggcctgattcgccagcaattgggtcccctaaagcttaccagcccgtacttcgaaaccatcttgtttaatgtcgagaaacggttaagaacagaagatctgctcacttttggcaacctcaaaggtctgttttatgccaatgaagacacaggctttattgcccacggtcttggggagatcattaatggccaaaactggctacctcgccatgtcagcagtcagttgctgcattactatcgttacgctttccaaagccatcaagttcaagccacggtcgatttgactgcacgtgaaattcagatcctgcgctgtttacaaactggcgcatcgaatatgcaaatcgctgagaatttatttattagtgagttcacggtgaaatcgcatctttatcagatatttaaaaagctaaacgtgaaaaatcgagtcaaagcgatcgcttgggttaatcaaaatttactgtaaaggcgctcaacctagcggagtgaattcaccatgagtgagtggagaaaaatgtagtaacaatgcgacttcacacacattttttcggccaagagcctcaacgtaatgcagtcgcgaatcagaagtggtagagtcagcaaaaaatttctccctagcacaccatagagcaaaaatgatgattaagaagtgtctatttccggcagctggctacggtacccgattcctaccagcgactaagtcgatgcccaaagagatgatgcctgttgttaacaaaccgctgattgagtacggtgttgatgaagcgattcaagcgggtatcacaggcatgtgtattgtgacaggtcgtggtaagcattcgatcatggatcactttgacatgaactacgagttagagcaccaaatccgcggtacgaataaagaagagctattgggtgatatccgtaaaatcatcgaaagcgctaactttacttttattcgccaacgcgaaatgaaaggcttgggtcacgctatcttaacgggcaaagagctggtcggtgatgagccgtttgccgttgtgctagcggacgacctgtgtgtgaacgaagagcaaggcgtactggcacagatggttgcactgtacaaacagttccgctgctctatcgtcgctgtgcaagaggttccagaaaacgaaactcacaaatacggcgtgatcgcaggtgagatgatcaaagacgatctgttccgcgtcgataacatggtcgaaaaaccagagccgggcacagcgccaagcaacctcgccatcattggccgttatatcctcacgccagatatttttgatctgattgagcagaccgagccgggcaaaggcggtgaaattcaaatcactgacgcgctgctcaaacaagccaaagcgggttgtgtactggcttataaattcaaaggtaagcgcttcgactgtggtagcgttgaaggctatatcgaagccaccaacttctgctacgaaaacatgtacaagaaaaacgaccaaaaagtggagttggctaaaaagtcgacgcacaaaggtcagtaattcgctatctaaacaatgcatttaaaagccaacctgtaacctctcaggttggcttttttgcttttgatacaactgtttttttatccagtaattgcttgcactttgttcacgctatgtaatacttgctgcacttcgtttagcaaagagcaacccagatggacaaaatcgaagtacgcggcgctcgtacccataacctcaaaaatatcaatctgaccattcctcgtgacaaattgattgtcatcaccggcctctctggttcaggtaaatcctcactggcttttgatacgctgtacgcagaaggtcaacggcgttatgtcgaatcactctcggcttatgcgcgccaattcctttctctgatggaaaagccggatgtagaccatattgaggggctttcacccgcgatttcgattgagcagaagtccacttcccataacccacgctctactgtgggtacgattacggaagtgtatgactatttacgtctactctacgctcgggttggtgagccacgctgccccgaacaccaagtgccactgaaagcgcaaaccatcagtcagatggtagacaaagtattggaattgccagaaggcagcaaaatgatgctgctggcaaccatagtcaaagagcgcaaaggcgaacacgttaaaacattggaaaaccttgctgcgcagggctttattcgtgcgcgtatcgatggtgaaacctgcgatctgaccgatccaccgaaactcgaactgcacaaaaagcataccattgaagtaattgtcgaccgtttcaaagtgcgcagtgatctgcagcaacgcttagccgaatcctttgaaaccgccttggaactttccggcggtatcgtcgttgtcgccccgatggaaggcgatggcgaagagcagattttctcggctaactttgcttgtccacattgcggttacagcatgcgcgaacttgaaccacgcctgttctccttcaacaacccagccggtgcttgtccaacctgtgatggtttaggagtacagcagtatttcgatccagatcgagtgattcaagatgccaatttaagtttggcacaaggtgcgatccgcggttgggatcaaaagaacttttattatttccagatgctgactgcactggccgagcactacgattttgatgtacacacgcccttcaataagctgagcaaaaagattcaggaaatcattctgcacggctctggtcgcaccgaaattgaatttaagtacatcaatgatcggggtgatattcgccttaaaaaacatccttttgaaggaattttgcataatttggagcgccgctatcgcgataccgaatccaactcggtacgtgaggagctggcaaaatacatctccaacaagccttgcagcagctgtgatggtacgcgcttaaaaatcgaagcacgcaatgtgtttattaatgatactgcgctgccaacgattgtagaactgagcattgctgatgcgctaacgttcttccaagagctcaaactggaaggccaacgtgcacaaatcgctgaaaaagtgatgaaagagattaatgaccggctgcaatttttggtcaatgtcgggctcaattacttaaatctctcgcgcagcgccgagacgctttccggtggcgaagctcagcgtattcgtctagccagtcagattggtgcgggtttagtcggtgtgatgtatgtccttgatgaaccctcgattggcctccaccaacgcgacaacgaacgcttgctgcaaaccctcacccacttacgcaatctagggaataccgtgttagtggttgagcatgatgaagatgcgattcgcatggcagatcatgtgattgatattggcccaggtgctggcgtacacggcggcatggtggttgccgaaggcaatgtggaggaaatcatcgccaatccaaactcactcacaggtcaatatctcagtggcgtgaaaaaaatcgcggtaccagagcagcgcacaccaaaagatgcgaagaaaacggtagagcttaaaggcgcagtcggtaataacttaaaaaatgttgacctgtctattcctgttggcctgtttacttgtgtgacgggcgtttcaggttcgggaaaatccactctgatcaacgataccttctttaagattgcccatacagcactcaatggcgcgacgacggcgacacctgcgccttatcgctccattcaaggtctagaacactttgataaagtgatcgatatcgatcagagcccaattggtcgcactcctcgctccaaccctgccacttacaccggaatcttcactccaatccgtgaattatttgcaggaacacaagagtctcgctcgcgtggttatcagccgggacgctttagttttaacgtccgcggagggcgctgtgaagcgtgccaaggcgatggcgtgatcaaagttgaaatgcacttcttacccgatgtgtatgtgccttgtgatgtgtgtaaaggtaaacgctataaccgagaaacactggaagtgcgctacaaaggcaagacgattgatgaagttttggacatgaccgttgaagacgcacgcgagttttttgaccccgtacctgtgatagcacgtaagctgcaaaccttgatggatgttggattgtcctacattcgtcttgggcaatcagccaccaccttatcaggaggtgaagcgcagcgggtaaaattagcgcgtgaactctccaaacgagatacgggcaaaaccctgtatattttggatgaaccaaccacgggcctacacttccacgatattcagcaactattgagcgttctgcaccgcttgcgtgaccatggcaataccgtggtggtgattgagcataacttggatgtgatcaaaacggctgactggatcatcgatttaggccccgaaggcggccaaggcggcggactgattattgcagaaggaacaccagaagatgtggcgcagatcgaagcttcacataccgcacgtttcctcaagcctttgttgaattagaaaaaaaggctaaagtaatgaaaccagcgaactgtgcgctggtttcttttttaaggtgaactgcatggcaactttgctgttaagtggcactcggttggaacctcacgctccgaacctaccactcaataaaccgtttctttttgccttggccgtggtttatctgctcgccatgcatttctttatgcctaaccccggcggtgctggactggcactctccttcaatactacggtctggatcgcgaccagcataacactggcgattggtctgtatcagttggcgaataatcaagcgctgcgttattccaagctgaccattggactttggttaagctgtgctctgctaaccctacccatcacttactcgaatgccgattggtttcatactcttggccgcttagtgggtctctgggctggatttactctgtttctcgtcttacaacaatttcgctttagcaacaaacataaacagcgtttgctgtggtttattctactgggtagcgtcattgaagccgtgatcggtttaattcaatacttttggttagagccgggtaacccctttggttatgacaccgaagcaaatcgaccgtatggtattttccagcaaccaaatgtgatggccagtttcctcgcaacagggctggtgttgtcaggttatttgctggccagacaaccggaaaaatatgactcgcgctggagcaaaatcggcatcctttacgcgacaccgctactcacggctcccttactggtcgtactcgcctctcgcactgggtggctggccagtttattgagtatcgctctggttgccccttacttatatcgattcgcttcacgtcggcgctttacgctctggcttcttgccataactcttgggatttgtgcaggttttaccgctatgtatggccaaggaacctctggttttgtcgcgaataaggctgacttagaaagcccacgtcgtttcacatttccacaaaccatagatatgatcatcgaaaagccttttacaggctatggttatggcaaatttgaggcgcagtatctgctttatactgctcgccaacatcagttaaatagcagctatccagcaggcttagcatcgatggatcacccacacaatgagctgttgtattggggggtagaaggcggattactacctgtaatgggtatattactcgccgcctgtttttgtgctctacgcatttatgccgccaaacgtggcactcgcatggccatgctggctctgtttgtgccgatcaccttacacgctcaattggagtatccgttttaccactccgcaattcactggatcacctttatcatcctaatctactgggtagatcaacgggtcgcacgctatcgactggccagtttcaccacgctcaccaaatctttattgcgtattaccagcttagtgctgccgattgtcaccagcttgtatatggtcacagcgttacacaccaactatgtgttaacgcaatttgaaaaatctcagccactcaatcctgaattgctgaaaaacgtgactaacccattggtatggcaagaccgatttgattgggatatctacagcacctatctgaacatcgggctccatgaacaaaaagcggagcttatccaaccctatatcgattggtcgttacagatcattcaacataaaccgcgcccggccttctattcaaacctgattttggcttatcaaggtttaggcgatacgagccgtgcgcagcaaatccgccgcgaggccgaatttctgttccccaatcaagatttcagtacagtccagtaccacccctcgataaaggtcaacagtgccacatctgatgctgaggttccctcagccgcgacaccctaagctctgcgagaaacaataagggtggcttttaagccacccttatttctctttcatacagcttttctcttgcgtatggtattaacgcagcgactcttcgagcgctcgcaaacagagcgcgatattttctgaacgcgcgccatagcccataaccccaatgcgccacgctttgccggctaatgccccgagcccagcaccaatttccaaattgtattcattgagtagatggctgcgtactttggcttcctcaataccttccggcacataaatcgcgttcaactgcggtaaacgatacggctctgcgaccacaaattgaaaaccgagttgctctaacccttgtttaagcttctcatgcatcagacgatggcgctgccacgcgtgctctaaaccttcttgttgcaaaagcagtaacgcttcgtgcagcgcgtacaaactattaaccggagcggtatggtgataactacgtttgcccgcgccactccaataacctaataccaagctttgatcgaggaaccagctttgaatcggtgtttttcgcgattgaatcttctcaatggcacgaggtgaaaacgtcaacggagccaatcccggcacacaagagaggcatttttggctgccagaatacaccgcatccagttgccactcatccaccagcaggggaacgccaccgagcgaggtcaccgcatcaacaatcgtcaacaaaccatgctgcttcgctagagcacctaacgcttgcgcatcacttaaggctccggttgacgtttctgcttgtacaaaagccagtattttcgcatccggatgctcatctatcgtggcttgcactttttcaacgctgactgggcaaccccattcatcatcaaccaccacaacttcggccccacaacgcacagcgttatcgcgcatccgctcaccaaacaccccattgcggcaaacaatcactttatcgcccggctcgacgaggttaacaaaacaggcttccatacccgcactacccggcgcagaaacggcaatcgtaaattcgttttccgtttggaaagcatatttcaagagctgtttcagctcatccatcataccgataaatagtggatcaagatgaccaaccgttgggcggctgagcgcttgcaggacttgaggggaaatagccgaaggtccagggcccatcaaaatccgatgcgggggaataaaactgcgaattgtcataacgactccttgttgtggcgaccagaaccactagcctaatgcaattcagtagcagcaacaattcgacctatgtccagagtgttaatccttgtcacactaatgtcatttttatttgcacttttagaacattttgtcgttgacaagatttcgccaacaccgttcaatgtgtgagctatctagcagaagaggagcactgcccaggcagatgttttgtggagcctcaactccaatacagaacattcagggggagtagtgccgaggtgaatcaaagttgtggctttggtttatcggttgaacgggctgaatcccttcaactgtcatcagctcgaatctgatgaagagcttctgagggaaatctttctatagtcactcctctattttgctctataaaaaacactctcttcacaacattggacgttgggttaccaacaactcgtttttcaggaagtctgggagaattgccgtgagcacatttaacgtcgccaaatttggtggtactagtgtcgccaactttgaagccatgagccgttgttcggccattatcgaaaacaatccacaaacacgcttagtggtcagcagcgcctgctctggggtgaccaatttattggtcgaactcgccaatggcgtggcctcaactgaacgccgccaagccattttgcaacagttggccgatatccattatgtgattatcgaccagctcgccgatccgacacgcgtcgaaaaagaagtcaaagccgtgctagattctgtggccagtgctgcagaagcggcgtcatttcaatccagtaaaaaactgaccgaccatctcgtcgcctgtggtgagctcatctccacctacatcctcactcaactgatgcgtgagcgtggtgtcgacgcggtacgttttgatatccgcgaagtgctacgcactgacgatcattacggtcgcgccgaacctcaattgaaagaaatcgctcaattagccaaagaaaaactggtgccactgtgtgagcaatatgtcgtcgtgactcaaggttttatcggctctgatgcgcaaggtaataccaccactttaggccgcggcggcagtgattattcagccgctttgattgccgaagccgtgcaagcaagtggtttagagatttggactgacgtaccgggaatctacagtaccgatccacgtatcgcgccaaaagcggcgccgattcctgagataagctttagcgaagcctcagaaatggccaattttggtgccaagattttgcatccatccaccttgcttccagcggtacgccatggcattcccgtgtttgttggctcatcaaaagaaccggaaaaaggtggcacttggatccgtaaacaagtcgaaagcgcgccactgtatcgcgcacttgcactacgctgtaatcaaaccatggtgacactgcgtagcgcgcagatgttccatgcttacggtttcctcgccaaagtgttcgaaattctcgccaagcataaaatttcggtcgatctcatcaccacatcagaaatcagcgtgtcactgacactggataaaaccgatacctcaggcggtgcgccagaattgcctgaagcggtgcgcgccgagttagaggagctatgtacggtcgaagtcgaatacaacctgtgtctgattgctctgatcggcaacaagatgaaagagagccgcggctacgcgaagcaagtgttcagtgtattggaagattacaacctccgtatgatttgctatggcgccagcgcgcataacctctgtttcttgctgcatgaatctgtctctaaacaagcggtgcagaagctgcataaagagctgtttgagcaagagtaaaatcaaactcacgagataaaaccagaggccacatgatgtggcctcttttattgtggatggaggtcttactgattaagcatcaaggttaggcgctagccacttttcagcttcttccaaacgccaacctttacgctcagcgtagctgtgcagttgatctggttggatctgcgctaccgcaaaatagcgagaatcgggatgcgagaaataccaaccggataccgaagcgcccggccacatcgcatagcttgtggtcagtgacatacctatggtctcttcgacatttagcatctgccacaaagtcgctttctcggtatgctcaggacacgcgggataccccggcgcgggtcgaatgccctgataacgctcacggatcaggtcatcattggagagattttcatcgctcgcataaccccaaatctctttacgcactttttcatgcagatattccgcaaaggcttccgccaaacgatcggctaccgcttggatcatgatcgcattgtaatcatcaccctgagctttataagcatcggccaaggctcgctcaccaatgccaccagttactgcaaacgcgccaatccaatcacgtttaccgctctctttcggagcaacatagtccgacaaacagtagttggcccctttcggtttctcagtctgctgacgcaagttgtacagcacatgcgcgacttgcgtacgcgattcatcactgtacacctcaatgtcatcgcccacgctggctgctggaaacagtgcacacataccactggctttcagtagtccttctcgctctactttatcaagtaaggcattggcatcatgaaacagacgtttggcctcttcaccgacctcttcatgctccaaaatggcagggtatttgcccataagcgaccaagtcataaaaaaaggcgtccaatcgatataaggacgtagtgtggctaacgcaatgttttcaaacacatgcacacccggtttcgcaggagcgggcggcgtgtaatttgcccaatccagcgccgctttattagcacgtgcctgctctaacgtgactgggcgcgatttgggcgttttacgagcatgctgatcacgcgtgcgctcataatcgagatccaaacgttcgataaatccggggcgctgttcatcagacaataatgatgtgcacacccctaccgcgcgcgacgcgttattcacgtacactacaggcgcatgataattctgttcaatcttcaccgcagtatgcgctttagacgttgttgccccaccaatcaaaagtggcagttcaaacccttgtcgctccatctctttcgccacgtgtaccatctcatccaaagacggcgtgataagcccagagagaccgatgatatcgacattttgctcgcgtgcgactttgaggatctgctcgcaaggcaccatcacaccaagatcgatgatctcgaagttattacactgcagcacgacgccaacaatgttcttaccaatgtcatgcacatcgccttttacggtcgccagcaaaatcttaccatttgaagtgctaccacttttttgcgcattaatgaaaggctcaagatacgcaacggcttgtttcatgacacgcgctgattttacgacttgcggtaggaacattttcccttccccgaacaagtcaccgaccacgttcataccatccatcagcggcccttcaatcacttccagtggtttactggcttgctgacgtgcttcttcagtgtcttggacgataaattcggtgatgcctttgactaaagcgtgctctaggcgcttagccacaggccatgcgcgccactctaatgcagaagcatcctcttctttaccaacactgttttcgcgatacgcttcggcgatctcaagcagtctttccgtgccatcgctacgtcgattgaggatcacatcttccactgcctcacgcagtttcagcggaacgttatcgtagatttcaagctgccctgcgttgacaatccccatgtccatgccgtgtttgaagcagtgataaaggaaaacagcatggatcgcttcacgcacatagttgttgccgcggaaagagaaggaaacgttagaaacaccgccagaaatcatcgcatgcggcagctcacgcttaatgtccgccactgcattaatgaaatccagtgcgtagttattgtgctcatcaattccggtcgcaacagcaaagatgttcgggtcaaaaataatatcttccggtgggaagcccacctcatcgaccaaaatatggtaagcccgacgacagatctctaatttgcgctcacgggtatcggcttggcccacttcgtcaaatgccatcacaatcaccgcggcaccgtagcggcgcaccaatttggcttgggcaataaacttctctttcccttcttttagagagatagagttgacgatgcctttaccctgaatgcatttcagacccgcttcaatgacttcccatttagaggagtcgaccatcaccggaactttggatatttctggttcagaggcgcatagattcaaaaagcgcaccatacacgcctcggcgtccaacatgccttcatccatgttgatatcaatgatctgcgcgccgttttcgacttgctcacgcgccacatcgagcgcttcgtcgtattgctcttctttaattaaacgcttaaaacgcgcagaaccggtgacgttagtacgttcgcccacgttaacaaacaaggtttcaggaccaatattgagcggctctaaacccgagagacgacattctactttcagatctggcagagcccttggttttacaccctcgacggctttggcaatggcggcgatatgctcaggtgtagttccacagcaaccaccgaccaaattcaaaaagccagcttgtgcccattccgcaatatgttctgccatttcctcggcagagagatcgtattcaccaaacgcattgggcagtccggcatttgggtgcgcggaaacatagcattctgaaatgcgtgaaagctcttccacgtactggcgcagctcatcaggacctaacgcacagttcaagccaaacgaaatcggccgtacatgacgcaaggcgttgtagaaagcttccgttgtctgtcctgacagagttcgcccagaggcatcggtaatcgtgccggaaatcatcacaggtaagctgatgcccagctcttcaaatacgctatcgaccgcaaacgcacaggctttggcgttaagtgtatcgaagatggtttcaatgaggatcagatcgctgccacctttgatcaaagcgcgcgtcgattcggaataggcttcaacaagcccatcaaaagtgacgttacgaaatcctggatcgttcacatctggcgaaatagagcaagtacggttggttggcccaagcacaccagccacatagcgtggccgacttggatctttagccgtccactcatccgcgacttcacgtgcaagcttagccgcggcaaagttaatttcagcactgagcgattgcatgtcatagtctgccatggcaatcgtggttgagttaaaggtgttggtctcaagaatatccgcccccgcttcaaggtaagcggagtgaatctctttaataatttgcggctgagtaagcactaagaggtcgttatttcctttcaaatcacagtgccaatcgacaaatcgtgcaccgcgatagtcttcctcttgtaacttataactctgaatcatggtacccataccaccatcaatcagtaggatacgttgtttcaattgctgttcgagttgttgtcttacttcttttcccacaataccgcctcattccttatgcgtttgccacatcctatcacacaaaattcagaaatctagacgtctaaaacagccattctttcgtgactcaccttgacgatgtgagcagaaccctatgtgatgaaaaagtatttgctatttactcaacagagaaagacaatttcgttcacaaattgttacacacactgagaagagaatgtccgtctactacactttgtgcttcctctctgcggcagccatgttgattgcatttattaatagcaagatcagccgaatgcagactactatcgcaatcaccgcaggttcgatgatgttatcgttactgatcttgatcgcgggtcaaaacgactggtttcatctcaatcaaatcgccaccgaaaccgtcaccagtattaactttgaaaattttctactcaaagggattttagggtttcttcttttcgctggaggtcttggcattaagctgccaaatctaaaagatcagaaatgggaaattacggtattggctcttggcgcaacgctgttttcgactttctttattggatttactctctatggtttctgccaattaatcggtatccagtttgatttggtttactgcttgttatttggcgcactcatttcccccaccgacccaattgctgtcctcgcgattgtcaaaaagctcaaagcaccgaaacgtatttctacccaaattgaaggcgaatcactgtttaacgatggttttggcttggttatcttcgtgaccatctttaccatcgctttcgggcatgaaacaccaacggttggcagcgttacccttctcttcatccaagaagcgatcggtggcattgtttacggtttcttattaggtctcctgttccactacctgatttcagcaaccgatgaccactctatggagctgttgctgacgattggtattccgaccgctggttatgcatttgccgatgtgatccatgtttctggtccactcgctatggtcgtatctgggatcatgattggtaactggactcgtttcataggcttctcaaaagagagtgaagagcatctcgatcacttctgggaactcgtagacgaatttctcaacggcgtcctattcctgctgattggtatgtcaatgctactgtttgagttccatcaagaagactggattttaatggcttttgcagttccactggtgttatgtggccgctacctcagcgtatttgtctcctacatcggatttaaacgctaccgtagttacaacccttggtcgattcgtattctgacttggggtggcttacgtgggggactcgcgttagcgatggcgctctctataccttctggaatcatggtaattcccgagaaattgattgatgtaaaagagctgattctggtgatgacttacgccgtggtagtgttttctatcctagttcaaggctcaaccattactcctatgattgagaaagctaaaaaggctgaaaaagccctccaagctgaaagaaatacagacaatcaatcccctatgcctcagcaagaacaacaacactaatctccgttgtttaatcgacaaaccgcagttaaacactgcggttttttattaccctcagaatcctttcccagatgactagaccacttaaacgacttggagctgcaagtaggcgataaatgagcaaattcttatgcgcatagataaagtcttaatgacctaagccttggtttgtggacttgaagctacagcggtttctgctgcatttgcttacctgcttaccgagttttctccaagcatatagtgcatatagactctgatggataagcttaaggataacgttgataaagtacactcgtaggataaacgtaaaaagagaaagacaaaaagagcagtaagaagagttggacagtttgggatgattgaacatcgtagaggatgagtactgggataggcgataagcagtaattacctctggctttcaatgatttccagaaagcaaaaaacccagtcctaagactgggtttcgtaataagtggcggagcggacgggactcgaacccgcgacccccggcgtgacaggccggtattctaaccgactgaactaccgctccgctgtctggttagaccaattaaaagcctggcgatgttctactctcacatggggagaccccacactaccatcgacgctgtttcgtttcacttctgagttcgggatggaatcaggtgggtccaaaacgctatggtcgccaagcaaattctgtttttgatttcactttttcttaaaaagtgataaccaacaattctggaaagctgtcttcgttctcacacacattcttatgcgcttagctttgagtccactacaaaaccccttgggtgttgtatggttaagcctcacgggcaattagtacaggttagctcaacgcctcacaacgcttacacaccctgcctatcaacgttctagtctcgaacaaccctttaggacagttaaactgtcagggaagactcatctcagggctcgcttcgcgcttagatgctttcagcgcttatcaattccgaacttagctaccgggcaatgcgtctggcgacacaacccgaacaccagaggttcgtccactccggtcctctcgtactaggagcagcccccttcaatcttccaacgcccacggcagatagggaccgaactgtctcacgacgttctaaacccagctcgcgtaccactttaaatggcgaacagccatacccttgggaccgacttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactatgacctgctttcgccnnnnnnnnnnnnnnnnnnnctcgcagttaagcgggcttatgccattgcactaacctcacgatgtccaaccgtgattagcccaccttcgtgctcctccgttactctttgggaggagacnnnnnnnngtcaaactacccaccaggcactgtcctcaacccagataatgggtctaagttagaacatcaaacatacaagggtggtatttcaaggacggctccaacgcnnnnnnnnnnnnnnnnnnnnnnnnnnnnnnnnnnnnnnnnnnnnnnnnnnnnnnnnnnnnnnnnnnnnnnnnnnnnnnnnnnnnngggtctttccgtctagccgcgggtacactgcatcttcacagcgatttcaatttcactgagtctcgggtggagacagcgtggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtcatcttgcgattttgcacagtgctgtgtttttaatnnnngttgcagccacctggtatctgcgactctcgtcagctccatccgcgagggacttcaccatcaagagcgtaccttctcccgaagttacggtaccattttgcctagttccttcacccgagttctctcaagcgccttggtattctctacccgaccacctgtgtcggtttggggtacgattcctgacnnnnnnnnnnnnnnnnnnnnnnnnnnnnnnnnnnnnnnnnnnnnnnnnnnnnnnnnnnnnnngctcgacgtcgtgtctcagccttagagagagccggatttacctaactctcaagcctacgcacttgaaccaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaccccctttgtcgttactcatgtcagcattcgcacttctgatacctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttacatcttccgcgcaggccgactcgactagtgagctattacgctttctttaaatgatggctgcttctaagccnnnnnnnnnnnnnnnnnnnnnnnnnnnnnnnnnnnnnnnnnnnnnnnnnnnnggaccttagctggcggtctgggttgtttccctctccacgacggacgttagcacccgccgtgtgtctccggatagtacttactggtattcggagtttgcaaagggttggtaagtcgggatgaccccctagccttaacagtgctctacccccagtagtattcgtccgaggcgctacctaaatagctttcggggagaaccagctatctccgagtttgattggcctttcacccctagccacaagtcatccgctaatttttcaacattagtcggttcggtcctccagttgatgttactcaaccttcaacctgcccatggctagatcacccggtttcgggtctatatccagagactgagcgcccagttaagactcgctttcgctacggctcccctatacggttaaccttgccactgaatataagtcgctgacccattatacaaaaggtacgcagtcacaccacgaaggtgctcctactgcttgtacgtacacggtttcaggttctatttcactcccctcacaggggttcttttcgcctttccctcacggtactggttcactatcggtcagtcaggagtatttagccttggaggatggtccccccatattcagacaggatatcacgtgtcccgccctactcgatttcacgctcgatgaagcgtcggttacggggctatcaccctgtatcgccaagctttccagcttgttcacctacttcaccgagtgcttaagggctaatccaggttcgctcgccgctactaccggaatctcggttgatttcttctcctcggggtacttagatgtttcagttcccccggtttgctctgttaacctatgtattcagttaacagtaactgcttatgcagttgggtttccccattcggaaatcgcagactcaaacggctcttactgccttatctgcgcttatcgcaagttagtacgtccttcatcgcctctgactgcccaggcatccaccgtgtacgcttagtcacttaaccatacaacccgaaggagtttcgggttgtgtttaaacaacctaagttgtctcgcgtttaatttacatgagtgcgagacagattttgccggactcaaatttgaacaagaccgaagtcttattcgataccaagcacacttgaatgtgttgttggtgtttatctttcgataaacattgagaactttacaaacaacaataaattgttgttttgtcagctttccaaattgttaaagagcaagattttctgatgaaaaccatttttaaacattctcagcgaaaacgcttaaagatggtggagttatgcgggatcgaaccgcagacctcctgcgtgcaaggcaggcgctctcccagctgagctataaccccatcgttagtggtgggtctgagtggactcgaaccaccgaccttacgcttatcaggcgtacgctctaaccacctgagctacagacccacttgatgctcaaatctaaaccgaatcaatctgtgtggacactcatcacgataatcatcgtgtaaggaggtgatccagcgccaggttcccctagcgctaccttgttacgacttcaccccagtcatgaaccacaaagtggcaagcgtcctcccgaaggttaaactacctgcttcttttgcagcccactcccatggtgtgacgggcggtgtgtacaaggcccgggaacgtattcaccgcaacattctgatttgcgattactagcgattccgacttcatggagtcgagttgcagactccaatccggactacgacgtactttgtgagattcgctccacctcgcggtatcgctgccctctgtatacgccattgtagcacgtgtgtagccctactcgtaagggccatgatgacttgacgtcgtccccacaccttcctccggtttatcaccggcagtctccctggagttcccaccattacgtgctggcaaacaaggataagggttgcgctcgttgcgggacttaacccaacatttcacaacacgagctgacgacagccatgcagcacctgtctcagagctcccgaaggcactccagcgtctccgctagattctctggatgtcaagagtaggtaaggttcttcgcgttgcatcgaattaaaccacatgctccaccgcttgtgcgggccccccgtcaattcatttgagttttaatcttgcgaccgtactccccaggcggtctacttaacgcgttagctccgaaagccacacctctagggcacaacctccaagtagacatcgtttacggcgtggactaccagggtatctaatcctgtttgctccccacgctttcgcatctgagtgtcagtatctgtccagggggccgccttcgccaccggtattccttcagatctctacgcatttcaccgctacacctgaaattctacccccctctacagtactctagcttgtcagtttcaaatgcgattcctaggttgagcccagggctttcacatctgacttaacaaaccacctgcatgcgctttacgcccagtaattccgattaacgcttgcaccctccgtattaccgcggctgctggcacggagttagccggtgcttcttctgtaggtaacgtcaaatgattaaggtattagcttaaccaccttcctccctactgaaagtactttacaacccgaaggccttcttcatacacgcggcatggctgcatcaggcttgcgcccattgtgcaatattccccactgctgcctcccgtaggagtctggaccgtgtctcagttccagtgtggctgatcatcctctcagaccagctagggatcgtcgccttggtgagcccttacctcaccaactagctaatcccacctgggcatatccggtagcgcaaggcccgaaggtcccctgctttgctcttgcgaggttatgcggtattagccatcgtttccaatggttatccccctctaccgggcaatttcccaggcattactcacccgtccgccgctcgccacccaaggaacaagttcctctgtgctgccgctcgacttgcatgtgttaggcctgccgccagcgttcaatctgagccatgatcaaactcttcaattaaaagtttttgaagctttcgcttcggctcaatgaatactgatactatctttcgatagtgaattgactgtgctgaatgattgctcattcaaatggtcactcagttcattgataaatcttttttgattatcatcaacgagtgcccacacagattgattggtttatattgttaaagagcgttcttcttggcggtctgcttcagaagaggcggccattttagcgagaatcaatttcgtgtcaaacacttttttcaattttcttttctggcctgttgaggcatcgatttggctgtgagcccttgctgcgtcaacgagggcgcattatagagatccgcttcacactggcaagtgttttttgagaaaatttatagaaataacgcttaaccgctgcatttgcgcgcaatggcttatttatcccactttactcagaccttgatgacaacttatccacagagttattcatttgtaggctgagataaagcaagaggctacatcacggcagcctctctttattatgtgtaaatagaaaatgaacgcgtttattgatgtgtatcgttatgatcttcgtgtaacccacactcacgctttaaaccaaagaagcgagtttgctcttcattcattcccggctgccatttctgtgtggtgtgtgtatcaccaaccgaaagataaccttgttcccaaagtgggtgataaggtagatcgttatccttgagataatagtgcacctctttattggtccaatcgatcactggcaggaatttaaacacgccattttgtaccgatagaatcggtaggcttgctcgtgattgtgactgttcacgtcgtaagcccgagaaccaagtgccaatgttgagttcatctaatgctctacgcatcggttctactttattaatctggttgtagcgttcgattccttcaacaccttgttcccacagttttccgtagcgagcttcttgccaagccgctgatacaggcgcggagtaaacttttaagttcagattgagccgctcagtcaactcatcgataaactgataggtttctgggaacagatagccggtatcggttaaaacgacaggaatgtcactcttcactgaagttaataaatgaagcatcactgcggcttggataccaaagctcgatgacagtgcatgattgccctgcagattttctagaccccagacgacgcgctcttgcgcagtgagggattccagatgctgattgacttccgttaggcgcagcgtttgctgcaccttatttaacgttagtaactcttctagtgttggaacggtacgattaggcatagaaatccctcttcgagatgattacctcttcgataatgcctgcacgaatagtgaaatcaccaaatccttcaccgtccagacgctcgctagcccaacgtcccaccaactcatcaatttcttgaagaatttgcgtatcggtaatgttctctttatacatcttaggaatacgcgttccatttcgattgccgcctaaatggaggttgtagcgacccggtgctttaccgactaggccaatctcagccaacatggctcgaccgcacccattcgggcagcccgtcacacgcaaaatgatgttctcttcttttggtaacgcatgttttgccaaaataccttccacttctgtgacaaaagaaggtagaaaacgctcggcttccgccatcgccaatggacaagttggaaaggcgacacacgccatagaattgatacgctgctcactcacaccatcatcaatcaagccatgttcacgtgcgagctgctcaatgtgcggtttctgatccgctggcacaccagccacaatcaagttctggttagccgtcatccggaaatcgccttgatgcaccttagcaatttcagcaacacccgttttcagtggcttacccggaaaatccaatatgcggccattttcaataaacagggttaaatgatgtttgccatcgatgccttcaacccaaccaatccgatcgccacggctggtaaactcataagctcggcttggtgcaaacgtaattcccgcgcgtttttcaacttcggctttaaatacctcaaccccgacacgatctaaggtgtacttggttttggcatttttacggttagaacggttcccccaatcgcgttgcgtgctcacgactgcagccgccacctccaaggttttttccagaggaataaaaccaaagtcatcggcacgacgcggataggttgaagtatcgccgtgcgtcatcgcaaggcccccacccaccaacacgttaaaaccgaccaactggccattttcaccaatcgcgacaaagttcaagtcattggcgtgcacatccacatcattgtgtggcgggatcacaacggtcgttttgaacttacgcggcaaatagtttgaacctaaaatgggctcttcatcgggtccttcgatcttttcgccatccaaccaaatttcggcataagcgcgtgttttcggtagtaggtgttcactgatcttttttgcccactcgtaggcttgcagatgcagttcagattccacggggttagaggtgcacaatacgttacggttcacatcccctgcggtcgcaatcgaatcgataccaatgctgtttaaggtttgatgcatcagtttgatattcggcttaagcacaccgtgaaactgaaacgtttgtcgtgtggttaaacggatactgccgtacagagtatgttcagttgcaaacttatcgatcgcgagccactggtgaggagtgatgatccctcccggcatacgcgcacggagcatgacattatgcaaaggctcaagcttctgcttgctacgctcagcacggatatcacgatcatcttgctgatacatgccatgaaagcggatgagctggaagttatccgcggtaaagccgccggtaatgcgatcttgcagatcttgctcgatcgtcccacgtagaaaatgactctcgcgctttaggcgttcattatccgaccatgggccgagcacttcgccaagcacctcttgtactgatgggttttgatttgcgctcattagtagacatccctttgataacgttttgctttacgcagttcactcacatactcttcagcttgctcacgattcaagccaccttgttgctcgacaacagtaattaatgcttggtgcacatccttcgccatgcgtgatgcatcaccacatacgtagaagtaagcgccttcttgtaaccattgccataccaactctgcttgttctaaaaggcgatgctgcacatacaccttttcgtgctggtcgcgactaaaagccacatctaagcgatttaacacaccagacttcaggtacttttgccactcgacttggtagaggaaatcttgggtaaaagtgcggtcaccaaacaacagccagttttttcctgctgcaccacggttttcgcgctcttggatgaagctacggaaaggggcaattccggttcctgggccaaccatgatcagcggcgcattatcatcactcggcaatttgaagttgttattgtgttcgacgaagactttaaccggagcgccctcttctaattgatgagctaagaagctggatgcaccacccaagcgttgctctccctcatactcatactcgaccaccccaaccgtcagatgcacctcttcccccacctcgctttgactagaggcaatcgaataaagacgcggcgttaaacgacggagaagtgataacagttgaatcgcggaaagggtgactttttcttcgcgcaacacatcaatcacttgcgtacgcgtcgcgtattcacgcagtgcctctttatcttgggctaaagaggtgagcttttcgctttgtgcaagctcagcaaattgcgccaccaactgcggattagctgcagtaatttcataatgatgagtcagtgccgaatgcagagaaagcgtttcgccatccacttgtacttcttcatgaccagaaagtcctacgctatcgagtagggcattaaccagctgtggacggttttcataccacacacctaatgcatcacccggttggtatgtgatgccagaatcggccaaatcaatttcgatgtggcgtacatctttgcctgaatcacggccagtaattttttggctcgtcgataagctcgccgtgtaaggttgctctttactgtagtgactctcagctgtctggctcactgcgaaagtagccacgctcgtcactgccgcggctcctgtcagctcatctttcaaaatagacaggacttgcttgcgccactcggtcgctgcagcctgataatcgacatccgcatctaagcgctcaaccagacgttgcgccccaaggttttctaaaaactgatcaaagtctttgccggtttggcagaaaaactgataactggaatcccccaatcctaagacgccatatttaagattaggcagcttgggggcttttttggatttgagaaactcatgcagtgccagtgcattatccggcgcttcaccttcaccattggttgaggcgacaaaaattacatgggtttctttggctaagtctttgcctttgtaatcgctcgcgtcaaataactgggcctgaatgcctgcagcttgcgcttctttcaataacgcctgagcaacgcctttcgcatttcccgtttgcgaagcgaaaatgatcgtcagcttacccgaagcagcagacgcagtctgcccagcggaaatgtgtggaacgctcaatgcattggattgactcaatccccagaaataaccactgacccaagctaattgctgagcattcagttgggttacggtttgttggagttgattgagctgtgcatcatttaacggactagcgagtgccgctagcgccgggggtaaagtgtttcctgtagacatcgtcacgacttccctattcattgcatgacgatagattaatcactctttttaataacaagaaagaatagatgtgaatgttttataactttttgacttaaccatctcgctactggttttcaattcgaacttgacgaaacccaaccgccatggcggattgcgaagcgctatcgagatcgatataacgacactcttcgccattttcatcggtgagcagcacgaatccccccatttgatggcgaaattcgacaatccattccccttcttgaaaggagggctcaataatggcctcaacgagctgctgggtttgatatagctctcttaactccggaatcgtcattttgctttccatccttggcttattgataaaactaagcatggtccaaatagtaaaaatgagccaacttgtggctcatttaaaacgtattggttagcaaaaaactcaataatgagaaattcatcagaagctaaattgagcccccacaaaccaaccatcggcaaaaacaaaagattgctttacatcggtggactgcttagccagttcagtgaactcaagatctaccactcgatagcccgctttgaatgcgaggtctcccgctcggatcggcagatggtattgcaagccagccatcacatcggatgatttcaggtcactattgttaccaaaatcaaactgaccaatcacatcaaaaggcgtatgaggaatggtaatttcggcgctggcataccagttaaacgtggtttgatcaaaatcgtagcgacgggcatctggcgcacggtaatcactgttcgcatattgggttagagtgatacccacatcgaacttcatcaattcgcgattgagcaatggataataaaaggtgtaatcgatcttatcgaacgaagcgaaatccgcttctaaattggtataacgcaagcccacattcggcaggtaaggaaaaccgtgctcaaacgtaaaataaaggttaggcgcgttcgcatcatcacgacgagtattatcaattttcgtgctcgctaaccacatctcagcgcccactgacgcagtataaaatgattcagcggcagaggccgataaaggcatgaccatcagtgcggtgactagcgccgccgatgcagttcggttcatgaactatgctccgttcgatttcaattcaatatttttgaggcgatgatggtaacacaaacctattctcgatatagggttttgtcatctcctaacgtgcagccttcgctttatcgcgcatcagccaaaccaccaccaacaccaccagtaaccaaggcagtaactttaatactatgcccaacatgccaaacagcgccatgatcaaaaacgccaacgccatcgcaccgaatacactcattaaagtgatgcctgtgaccaatagtgtagcggcaaagacaaaaataaagattaattcaaacatcatcagcactcctctgcgtcattcattgtgaatttgcagttttcacgccaactttacaaagaagccaaccatttgattaatatagaaaaaaataagccaagcgacgtcatctcacttggcttatcaaaaaacagtaagcattttcgctaatgtttggtgttttttacacacctaactcttggtaagggatcttggccaacgcctgttcaaccacttccaatcccgctccaggcttgtgcgcattctcactgatatggcgtcgccattggcgtgcacccggcatattttggaacagtcctaacatatggcgagtcatatgaccaagatgggtgccttgtgaaagttcacgctcaatataaggcatcatttcatggatgacttgtgagcgctttttcacaggcgtttctaagccaaaaatctgctgatccacttcagccagcaaatacggattttgatacgcctcacgcccaatcatcacaccatcaagatgttgcagatgaagtttcgcttcttccaagctcttcaccccaccgttaactgcaatggttaagtgcggaaaatcacgtttgatttggtacgctcgtgggtaatccagtggtggaatttcacggttttctttcgggctcagaccacttaaccaagctttacgcgcatggatagtaaattgctcacagccacctttttccgcaactgtggcgataaactgagttaaaaactcgtacgagtcttgatcatcaataccgatacgcgttttgaccgtcaccggaatgtcgacaaccgcacgcatggcggcgacgcactccgccaccaagtccggctcgcccatcagacaagcgccaaagcggccattctgtacccgatcggatggacagccgacgttgaggttaatttcatcatagcctcgctcttgagccagcttggcacaatgcgctaaatccttaggattggaaccaccaaactgtagcgctacgggatgctcttcttggttgtacgccagaaaatcgccacgaccatggatgatcgcgccagtcgtcaccatttcggtgtacagcagagtctgcgcagagagcagacggtggaaataacggcagtggcggtcggtccaatcgagcattggagcaactgagagtctgcatgagtgagtcataggtgaacgtccccatttcagtcaaaaacaaccaccgcacggtggcgaaaaaatcgaagtccggcattttaatcgcaacttagcgtgagcgccatgccttgttcagtaaatcgcttttacggtaaatgggcgcgaccagcaggcttcgtgagccgaacaagcttgatcctagtcggcttgccacgatttccttaccacaactaataagcttaacagtatcgtttttgagcaagataaggtaatttacgtctattcaacaggatgagttgacctcgcatctactttcatgtggattttattttgtcggtcaacgatattcatctcgacatagtatattattactaaagtccaacagtgatggtgatggttttggacaacaagctaaccaagcaaattgaagaaatatgtgcagcaagaggggttcgcctcacatcacagcgtaaaactgtgtttgagctgatctgtgccagtaaacgctcatcaagtgcgtatgaactgctggaagatctgaaaaaaagtgaaccgcaagctaaacctccaactgtatatcgagcactggattttttgctagaacaaggctttattcaccgagtagagtcgactaacagctttatctcttgctgttcatgtaacgctcataagcacttctcacatctgttgatttgtgaccagtgcggtaacgtgattgaatctcgggatgatagtctggtagccttgttagcaagtaacgcggagaaacacggttttacgataagcaaccatgtcatcgaatcacatggggtttgtcagacctgtctctcgaaagagaagaagcaacaatagaagaaggttatgcgcgctgaatttgtaaacccgtttttagcgtctttgatgaacgtgttgaaaaccatggcttcccttgagttgaagccacaaaaaccacggattaaaaaagacgaaatcgctcgcggcgatgtttctggtctgatcggcatgattggcccaacgacgcgcggttctatgtcgatcacttttgacgagagccttgctttggaaatcatgcaaaatatgctgggtgagcgtccgaatggtttaaatgaagaagtgactgatatggtcggcgagatcaccaatatggtcacaggtggagcgaagcgaattttggcagaaagcggctttgattttgatatggccacccccgttgtcgtctccggccgaggacacacaattcgtcataagtgtgaaggggcaatcatactgatgccgttttcttctccttggggcaatgcgtttatcgaaatctgtttcgagtaattcagcgctcacgttggcagccactgttagttcatcgctctcaatgatcttgattaaaccggacacttttgtccggttttgttttctctgctatccccgagcactgggggtgacatttacaccaccatcagcagcaataataaagaacacgctaagcccatttgccaatatcgagcaccactcatgggctcagtttctaaaccttgccaccaagcgtggcttgcgctgtggtttgccatggttaggctttctcctgccataggggttagcaaagtgatcgactgctcttggcaatgcttaaccagatcggcaatcggctcatcccattggtgggtaaacaactcataagtcgcccagtgaatcggcagcagttttttagcttgtaagtcgcgaaaggcttgaactgtgtgtttcgcctgcatgtgtccccaattttcaacgggataaccttggtgctgcttaacatcggcggccacttctagacaagccaaatcaatcggcccacagcgctcagcaatctttgcaaaatgtgtatcataggcactatcaccactgaaatagagtgtttcttgatggccttttatgacccatgaacaccacaaggtcgcattatgatcgagataataacgtcctgaattgtgattagctggagtacaaataaactcgacgccttctcgttttatctgctcccaccaatcgaattcgataattcgttcaggtgagactccccagcgaatcaaatgctgcccgacacccagcggaacatagaaggtgaccgaatgcgcggcataatagacaacactggcctgctctaaatggtcataatgatcgtgagagatcacaatcacatccggcagtggtaactgctcccgcacaccactattaggcaggtttctggcaaaccacgctttcgcaatccaaggcgaagcgtaatcaaacaccggatcggtcaatactcgtagcccatcgacttcaataaacaaactagagtggccaagccaagtgactcgaagtgccttgctgcgtgtttgcaacgcttgcaggttgagaggtgctacgggcaactgagcattaggcttgagctgagctctccccccaaagtaactccaagctgtctgccaccatgatggtgtagcggtaatatgaggcatagcgttgatcactttgccctctcgaaattgaggtgagtgggagatccggcgctctaactgcgagcgatagtgttgaacatggtggtgagcaaacaccttgcgttgacgtgcttgtgttttagtctgaatggccgtttctgacataccagcataagccctatcactctgacagtgcgtttagttaaaccctgctgcatgtctgttttatgaccaaatcggtaggaaaaatgaactttcaatggcaatacaaagaagggacttcgccacgtacagagaaactcaaagacaagaaaaaggccttactgcacaggtaagaccttgtctatcaattggttattcggcgtaattaggcgcgaaacgctttaaaggcgttgatcagaccgttggtcgagctgtcatgtgacgtcacggctgcgctatccgctaactcaggcaggatttggttcgccagttgcttacccagttccacgccccattgatcgaaactgaagatgttccaaatcacaccttgtacgaagattttgtgttcgtacatcgcaatcaagttacccagcgtgcgtggcgtaatctgcttaaccagaatcgagttggttgggcggttaccttcaaacactttgaacggcactaacgctgcaatttctgccgccgatttacccgctttttcgagttcagcttgcacggcttgcgcggattttccgaaggctaaggcttcggtttgcgcgaagaagttagacatcagcttttggtgatgatcgccaaccaaattatgactcaccgctggcgcgataaaatcacatgggatcagcttagtgccttggtggataagctgatagaaagcgtgctggccgttcgtaccgggttcaccccaaatgattgggcccgtttggtaagtgactgggttgccattacgatcaacatacttaccattagactccatattgccttgttggaagtaagccgcgaagcgatgcaggtactgatcgtaaggcaggatcgcttcagattcagcaccatggaagttgttataccaaatgccaatcagcgccagaatgaccggaatattactttcaaacggcgtgttcacgaaatgctgatccatttcatgcgcccccgccagcagctcaacaaagttgtcgtaaccgatagacagaatgatagaaagaccaatcgctgaccacagtgagtaacgaccgcctacccaatcccagaattcaaacatgttgtcggtgtcgataccaaactcagccaccgctttaccattggttgatagcgccgcaaagtgcttagcaacatgtgcttcatctcctgccgctttcaagaaccaatcacgagccgtgtgggcgttggtcatggtttcttgggtagtgaaagttttggaagccactaagaagagggtggtttcaggatcgacgtttttcagtgtctccgccatgtgtgtaccatcgacgtttgacacaaagtgcatggtcaaatggttcttataaggcaccagagcttctgtgaccatgtaaggaccgagatcggagccaccaatgccgatattaacgacatcagtaatcgccttgccggtgaaacctttccactcaccgccaatcacacgctcagagaaggctttcattttagccaacacagcgtttactgcaggcattacatcctcaccgttcaccaacacaggtgaattgctacgattacgcagcgcagtgtgcagtaccgcacgatcttccgtttggttgatcgcttcacctttaaacatcgcggtgatggcagattgcagatccgtttctttagccaacgcaaacaagtgttgcatcgtttccgcattcactaggtttttcgaataatcgaccagaatgtcctgaccaaagcgcgcagagtatttggcaaaacgctcgctgtcttgcgcaaaaagtgctttgaggtccatatcctgagcagattcaaaatgcgcggtcagcgctttccaagcttgggtttgcgttggattgatatttttcaacatggcatctatcccgatgttactgtggttttattccagtacgctaaaggcggagctttaacgttggaatccccgatttaagcaaaaagaataggttaaaaatgagtattccgcgccggaatcacatgtaattaattttcagtgcatcattatgagcgaactcattgacacccactttgcgataggtcacgtaaacaccgaccgtcactcatttttgtctggtaatttctgtcgctcaccttacccttaaaccttcactttgccaatacacttaaggagcgggctttatgtggcatcagcacaccatccagttacgcccacgagcacgtggttttcatctgatcactgatgaaattgaacaacaattgccgcaaatcaaaagactaaatgtcggtttattacatttatttgtacagcatacttcggccagtctcaccatcaatgagaatgccgatccgacggtgcgccaagatatggaagcccattttaaccacgctgcgcctgaaggggcgccttattatcggcacattgatgagggcgatgatgatatgcccgcgcatatcaagtcttcactacttggatgtagcgtcagtattcccattcaacaaggcaggttagcgctcggtacttggcaaggtatctatttgggggagcatcgcaatcacggcggaataagaagggtgatcgcgaccattcaaggcgagtaacgcccaaagagtgcaagagaagagagtgacatgcatggccacagcgataagcggtggtcatgcacggacaacacaaagcaggctaaacgcctgctccataataagacatttccactcgcgaggtgagtttcgtcactaactcataccctatcgtaccaatatgtgcggccacttcttctacgggcagctcattaccccacagcatggcttcatcaccgacgcgatcgcaagcatccggccctaaatctaccgtcaacatatccatagatacgcgcccagcaatcggcacccgacgcccattgacaaccactggcgtcccattcggcgcagtgcgtggatagccatcaccataaccaatcgcaatcacaccaattttggtatctcgctggctggtccaagtaccgccataaccgacactctcccccgctttcacttcgcggacagcgatcaagtgcgactttaaggtcatcactggctggtaacctaactgaaccgcgctcttttccacaaagggagaaacgccgtacataataattcccggccttacccattcaagctggctttgcggccaagctaataatccggcagaagcggccagcgaacgctcaccctgacagccttgcgtcagggataaaaacagttctgtttgctctaccgtcgtcgatttatctaactcatcggcacagccgaaatggctcatgtaacgcagtggtttagccacattctcacactggtgcaaacgagccacgaaatcttgatattgttcagggcgaacccctagccgatgcatcccgctgtcgactttcagccataccatgaccggagtctctagctgagcttgctccagcgcttgtaactgctcttcacaatgtacgacggtttggatgttgttggtaaccaatactggcaaatcaccgggagaataaaatccctcaagcaacaaaatgggtttcactacgccactggcgcgcagctgtaaagcctcttcaatgcgcgccacgccaaaggcatccgccccaagggcgtgacgtgcgatatggcgcagcccgtgtccataaccattggctttcaccaccgccatgattttactctctggcgcttgctgcttaacgcgctgcaagttgtgctgcaacgcctctaaattgatgtaggcggtggccgccttcatatagttcatcgaattactcatcgtcaaatgcaggtccagcatagttgtcgaaacgagaatagtgaccttggaaagtcaaacgcaccgaaccaatcgggccgttacgttgcttaccaataatgatttccgccgtgccttttagcggactatctgggtgatacacctcatctcgatagataaacatgatcaagtcagcatcctgctcaatcgaacccgattcacgcagatccgagttgactggacgcttatccgcacgctgctccaaagaacggttcaactgcgaaagcgcaaccacgggcacattcaattctttagctaacgctttgagtgagcgagaaatttcagcaatttccagtgtacggttatcggtcaatgccggtacacgcatcagctgtaaatagtcgaccatgatgagcgacaagcctccgtgttcacgagcaatgcgtcgggcacgcgagcgaacttcggtgggggttaggcctgagctatcatcgatgtacatgttcttcttctccatgagaatccccatggtggaagagatacgcgcccaatcttcatcatccagttgaccggtacgaattttggtttggtcgacacgtgataacgaggccagcatacgcatcatgatctgttcggcgggcatctccagcgagaagatcagcacaggtttatcttgctccatcgcggcgttttcacacaggttcatcgcaaaagtggttttacccatcgaaggacgcgctgcgacgatgatcagatccgagccttgcaaaccagccgtctttttattcaggtcggtaaagcccgtgttcactccagtgaccccatcctgcggcgttttgtagagcagctcaatccgctctagcgtgcgctctagaatgctatccacgtttttcgggccttcattttcactggtacgcgcttcggcaatcgcaaaaactttactttccgccagatccagcaaatcttcagcgttgcgcccttgtggatcgtatcccgcatcggcaatctcattggcaacaccaatcagattacgcaccaaagcccgttcggccacaatctccgcataggcattaatgttggcagcactgggcgtgtttttggccaaatcggccaaataggcaaagccaccgacatcttccaactgctcacgctgctcaagatattcggacaaggtaatgagatcgagcggtttacccgcctccaaaatcgattttaccccgtcaaaaatcaaacgatgcgggcggctgtagaagtcctgagtcatcacgtgttctgagaccgtatcccagcgctcattatccagcagcaagccaccaatgacggattgctcagcttctaatgaatgcggtgggactttaattgcatcgacttgtgcgtcgggaattttacggtttcgattatcagtacgtggatctgccatgacttcgctttaagtaacgtttgaatgtccgtcattataacgagaatccgtcatttgtaattaaagcaacgaaagtttgtgcgccgcctaaccagaattgacctagggttgacccaaactcagtaatgaatttttactatgccacctcaatattaatcaaagaggttgttgtgtccaccaaatggcttttaggcattagcttgatgctgtcaacagtagcgcaagccaatgaaaattctaatcaggatacggacatcagcattccctctccttggaaacatcaagtcgagtttggctatcaggcgcactccggtaataccgagtcagagtcactcaattcacgcttaaaatcggaatataccatgggtcgtcaccgtacttatggggagtggaagttttataaacttgataaaaacggcaaagaagataaacgccagtccaccttcgccttccaaagcgactataaactcggaccgaagacgtatttatacggcagcttttacggcaccaactcgcgttacaccgcttatttcaaagaccataccctatcaggagggctcggttatcaattcgcatataccgatgagatggttttagagctggagttagggcctggctttcgctaccaaaaacccaacctagacgaaattgatgatgacgatatcgtttttcccgatctcgttcaggaagcgatatttcgtagcaatcttaaagctgagtggcaagctttaaacaacctcagatttgaggcagaaatgaccatggtttcagggcgaagtaacaccagtcttgatagcaatatcagtttaaccaacgacatcactgaccacattgccttaaaaattcgccaatcacgccaataccataaccgaatgccggaaggattaagcaaagcagacagcgtgatttcggttaatctactgtttgagttttaaatgctacccataaaaaaacaccagccgaagctggtgttttcgtattcgtcagtaactgaaattactcagcaacaacttgtacttttgcagttgcgaacacttcagagtgaagttgaacgctaacttcgtaagcaccaacgttgcgcagagcaccttcaggtaggcgaacttcgctcttagatactttaacgccagctgcagtgattgcatcagcgatatcacgagtaccgatagaaccgaacagtttaccttcgtcacctgctttagaagcaataacaactgcttccagagcgttaacttggtcagcgcgagtttgagcggcagccagttgctcagcaacttttgcttccagctctgcacgacggctttcaaacattgcaacgttagctttagttgccattactgccttaccttgtgggataaggaagttacgagcgtaaccagatttaacgtttactgtatcgccaaggctgcctaggttaccgattttatcaagtagaataacttgcattgcttaatcctctttcttaataaacggtgccaattactgatgtttgtcagtgtatggcagtagagctaggtagcgagcgcgtttgattgcacgagctagctgacgctgatatttagcacttgtaccagtgatacggctaggaacgattttaccagcttcagtgatgtagttcttgagagttgctacgtctttgtaatcaatctcttgtacgccttctgcagtaaaacggcagaatttacgacgacggaagaaacgagccatgggctatctcctgatctatatttgagaaattttgtcggcatgcagcactaatttacctacgccatttcggctggtttggtaagccaaaaaaccacttaccaaaatgctactgccttgtactaagttttgagttaacgcttctgacctagccccactcaccaccacaggtaatcgacaaaaaacttgtcttgggaggtcagcttctaccatcgtagagcgatgctctagccaaaaatggcaatgtttaacacccgatggactttggcttcgaaccagagcctttgcgacaacgccgctcaactcgattcgattggtcatcaaaccattactcaacgtctgcgtcgaacttcatctcgtcacgctttacacgctcttcacgagctttcagcatgattgaaggttcagtaatagcagctttagtacgcatgatcatgttacgcagaactgcatcgttgaaacggaaagcagtttctagctcatcaaccactgcttggtcagcttcaacgttcatcagaacgtagtgagctttgtgcagtttgttgattgggtaagccagttgacggcgaccccaatcttctagacggtggattttaccgccagcttcagtgattgagccagtgtaacgttcgatcatgccagcaacttgctcgctttgatctgggtgcaccatgaatacgatttcgtaatgacgcattatttgctccttacggattattcagcttccagagttggcccggtcatccagaggaagcaaggaactaatgataattgaccgagaattaaggagcgggaatagtacagaaaggaagcagctttagcaaggaaattatcgagggagaaacaggaagcggttaggcagaaaaacgcgttttctgcctaggaatgatatgtgttagtacaggggattattcgtcatcaacaaactgagcttgcagataattttggatacccgtcatatcgatcagaccaagttgagtttctaaccaatcaacatgctcttcttcatcttctaagatctcttggaacagatcacgagaaacgtagtcacgtactttttcggcgtaagcgatcgcctctttgagatcaggaatcgcaatcaactcaagtttgagatcgcactccaacatctcttgcacatcttcaccaatcatcagtttgccaagatcttgtagattgggaatcccctctaaaaacaagattctttccacaatatggtcagcgtgtttcatctcatcaatagattcgtggtattccttatcggcaagatgcttcaagccccaatctttatacatgcgtgcatgtaagaagtattgattgatggcgataagctcattagccagtactttattgagatgttgaattatgactggatcacctttcatagcatagccctcctctttggctctattaactgtagaaccaattagaggagagtcaaaaagaagctgtgcttaacttgccagtttaaactgagcaatcagcgattcttcgatgatctctttagcttggcgtacacacttaccacactgagaacccagtgctgtacagcgcttgatgcccttgatatccgtaataccctgttcggcaaccaatctcctaatctttttgtctgagacaccatgacacaaacaaacgtacataacccaacctcatttcattcatgaacaaagaataaaagagaatcactcttatttctactgcgtttactattttgctcagatcggattgttataagaaaatggcgatgagacagagaaatgctcaactgaaagtgcagcgccaacgctctggtcatttggtcgaggctaatgtgttgttttgattatgagcgggataaaaccaaaagaagatataagcctaagatgacttataaccaaaaatgaaaaagggaagccgaagcttccctttttcgatgcagcattgcgcggcaagattaacgcgattaagcgatgatcttagctacaacaccagcacctacagtacggccaccttcacggatagcgaagcgtagaccttcgtccatcgcgattggtgcaatcaggtctacaaccatcttcacgttgtcgcctggcattaccatttctacgccttctggtagctcaatgctgcctgttacgtcagttgtacggaagtagaactgtggacggtaacctttgaagaatggagtatgacggccaccttcgtcttttgacagtacgtatacttctgattcgaacttagtgtgtggtgtgattgaacctggcttcgccagtacttgaccacgctctacttcttcacgcttagtaccacgtagcagtgcacctacgttctcacctgcacgaccttcgtcaagcagcttacggaacatctctacacctgtacaggtcgtttttactgtctctttgataccaacgatcgctacttcgtcacccactttcaggatgccgcgctcgatacggccagttactactgtaccacgaccttggattgagaatacgtcttcgattggcatcaggaatgccatgtctactgcacgctctggctctggaatgtatgtatccagtgcttctgctagctcaacaatcttcgcttcccactgtgcttcgccgtttagcgcgcctagtgctgaaccttggattactggcaggtcatcacctgggaaatcgtactcagacagcagctcacgaacttccatctctaccagctctagaagctcttcatcgtcaaccatgtcacacttgttcatgaatacgatgatgtaaggaatacctacttggcgacccagcaggatgtgctcacgagtttgtggcattggaccgtcagttgccgctacaactaggataccgccgtccatctgtgctgcaccggtgatcatgttcttaacataatccgcgtgtcctggacagtctacgtgtgcgtagtgacggtttggagtatcgtactctacgtgagaagtattgattgtaataccacgctcacgctcttctggtgcgttgtcgattgacgcgaagtcacgagctttaccgccgtatacttttgcaagtacagtacagatagctgcagttagagttgttttaccgtggtcaacgtggccgatagtaccaacgtttacgtgcggtttcgtacgttcaaatttttctttagacacgatcgtgttccttcctagttatgattcgctttgggtaagcagtacccaaggcgcgccagaaattgctattttatgcgccaactcacgtcagcgcaatagattcgttattaaccaaacaacggttaaccatgctctgcgataattgcgtcagcaatatttttcggcacatcagcgtactcagcaaactccatagagtaagaagcacggccttgtgtggcagaacgcaggtcagttgcataaccaaacatctcagacaatgggactttagcgtggatgattttcagtcccgcagggccttcatccataccttcgatgatgccacgacgacggtttaagtcacccacaacatcacccatccagtcttctggagtggttatttcaactttcattaacggctcaagaagaacaggttgagcttcaagcgcacctttcttgaatgccatagaaccagcgattttaaacgccatttcgctggagtcgacatcgtggaatgaaccatcaaacagggtagctttgacatccagcactggatagcccgctaacacaccgttgttcatttgctcctcgatacctttcgcaactgggttgataaattcttttggaatcacaccacccgcgattgcgtcaacgaagacaaaaccttgaccaggctcagcaggttcaattttcagccatacgtgaccgtattgaccacgaccacctgactgacgaacgaacttaccttccacttccgatttaccacgaatggtttcacggtaagccacctgaggtttacctacgttacaatcgacaccaaactcacgtttcatgcgatcgacgataatatctaggtgaagctcacccataccagaaatcagcgtttgacccgtctcagcgtcagtctcaacgcggaatgatgggtcttctgctgcgagtttacctaaagcaatacccattttttcctgatcagctttagagcgaggctctactgcgatctgaattactggttcagggaactccatacgctccagaatcacaacatgattcggatcacacaaagtatcgcccgtagtcacatctttcaggccgatagccgcagcgatgtcacccgcacgaatctctttgatttcatcacgcttgttagcatgcatctgtacgatacggccaaagcgctctttcttttgcttcactgagttataaaccgcatcacccgagttaaccactccagagtagacgcgaataaaggtcagcgagccaacaaaaggatcggtagcaatcttaaacgcgagtgaagaaaacggttcgttatcgtcagcatgacgctcaacactgttttctcgatcatcaatacctttgatcgcaggaacatcggttggtgatggtagaaactcaatcaccgcatccagaactgcttgcacgcctttgttcttaaatgcactaccacaagctgcgagaacaatttcgttattgatggtgcgctgacgcagagcttgtttgatctctacttcgctaagttcaccatcttcaaggtatttttccatcaactcttcactggcttcggctgcggcttccacaaggtggttacgccactcttgggcaagctcaagcatatccgcaggaatttcttcataagtgaagctcatgccttgatcggcttcattccagttgatggctttcatcttgataaggtcgatgacacctttgaactcttcttctgcaccaatgttgagttggataggaacagggttcgcaccaagacgatgtttaatttggcctactacgcgtaagaaatctgcaccggcacggtccattttgttgacgaataccatgcgtggaacgccgtatttgtcagcttgacgccaaacggtttcagactgaggttcaacacctgatgtgccacagaatacgaccactgcaccatcaagcacacgaagtgaacgctctacttcgatcgtaaagtcaacgtgtccaggggtatcaatgatgttgatgcgatgttcttggaattgcgcttccataccacgccagaaggtggtggtggccgcagaggtaatggtaataccacgctcttgctcttggaccatccagtccatagtcgcagcaccgtcgtgaacttcgccaattttgtgagagaggccagtgtagaacagaatacgctcagtagtggttgtttttcctgcatctacgtgagcacagataccgatgttacggtagcgctcaataggagttttacgagccacgattgtatcctcttactaaggtcaaccttagaaaatagaaatgtgctgcgagagaacctcgcagcacagaaggtattaccagcggtaatgagcgaacgctttgttcgcttctgccatacggtgaacgtcttcacgtttcttaacagcagaacctttgttttcagccgcatccagcatttcagcagctagacgagcagccatagatttttcaccacgcttacgcgcagcttcaaccaaccaacgcattgccagagcattacgacgtactggacgtacttcaactggcacttggtaagttgaaccaccaacacggcgagatttaacttctaccgctgggcgaacgttttcaagagcttcttcaaatacagctaagtgatctttaccagatttctcagccatggtgtctagtgcagtgtaaacgattttctctgcagtagattttttaccgtcaaccataaggatgttaacgaattttgccagcagttcagatttgaactttggatctggaaggatcttacgctgaccaatgacgcgacgacgtggcatggaatattctccgttgtcttcttcaggttatccaaaacttttcagttttttcaaaattaaaatttaattttagtgtttggccttacttaacgcttctctcataagaagaagggcattaagacttaggacgcttcacaccgtacttagaacgagcttgtttacggtcattcacgcctgcacagtcaagtgcaccacgaactgtgtggtagcgaacacctgggaggtctttaacacgaccaccacggatcagaacaacactgtgctcttgtaggttgtgaccttcaccaccgatgtatgaagtaacttcaaaaccgttagttaggcgtacacgacatactttacgaagtgctgagttaggttttctaggtgtagtagtgtaaacacgagtacatacaccacgtttttgtgggcacgcagctagtgctggcacgttgcttttaacaacttgcttagcacgtggcttacgaaccaactggttaatagttgccattaactagctcctgatttacttaaagtaagcttgtgaaaaatctatcccttccatgcaaacagtttgcacaaatagggacgcaaaattctatgcagcagtgggatgtgtgtcaagaaatatacagatcttttttagtgatcctgtgtgagcgttgttctgctcaggataattagaaaaatacaacctaccaggttattgatttatcatgagttactgtcaaatcaacaaagtcactcatggtgacaaccgaaatacgcggatcgcacttttctagccaaccacgcgcatgcagatcctcataaagcaccaaccataggttctgatcgttaatactcgcttgatatggtgaatgtactgccgccgcgtagacagcattctccgtcaatagaacaacatcaccatcgagtaaataagcactaagcaaagggagtttttctaagtgcttaacaatatgtagcataggggctccttagaaagtcagtaactgatcgtagtggtgcagtaactgcgccagagcttgagcatcaaccacttccacctcaatcagtaaatcttgttcactcagcccccagctaaccaaactctgttggcagacataacgcgcttcaatgtcgtagagatccaaaagcttgaatgctgaaatatagtcacgacttaaaatcgattcggggtgctgatgattgaccaactgcaacacaccttcgccaacaaaaaatagggcttgttcttcactgtaggccgacgttgcaagaatggcatctaagccttctcgccctgccgtgctaccatgaggcggcgtatgaaatacccatgcgactttattcaaaactgcaccaccctatcttgctccagtaatgcttgtgccaaactgcccagtcccgcttgagtgaaatgagccgcgaggttatggctcgctaagccgtgttgcgacgcttcttgctcactcacaacaccacggcgcagcgctgctgcaacacaagtttcaagttgtacttgatgggattgagcaagagattgccaaccttgtagcaggttaaactcatcattggctggtacatgcgttgacgagccattaagcacaccgtcttgataaaaaaacacgctttttaaaatatgccctttctcaatcagcgctttagcaaacagataggcgttgcgagccgattgcgtaccgtattgtggcccgttcacgactaaggtgtaagtgagtggtttcacttctcatcatcctcagttttacgctgacgaatatagagatacacagtatgtttagagatattcagccgatcggcgactcggttgatcgcatctttaatgtcgaaaatccccttatcgaacaacgccatcacgatttgacgatttttggtattgttcgagactgacttatcaccgttgatttcttcgatggtacgttcaacggtttgatccaccagctcttccacatcactggcaaagttaaccgaagaggccgcctcttgcgcttcttgagttggcataaacgatttcagtacttgtgagaaaggcgcatcgaggttgacgttgatacagagtagaccaatcactcgattctcaccgttacggatcgcaactgtgatcgatttcatcaatacgccacctttggcgcgcgtgaaataagagcgggagaagttacgctcagatccttctatatcacgcagcattttcaaggccatatcggtaattggcgatcccacttgacggcctgtgttttcaccattggcaatcttgatcgccgatgtattgagatcttcaagcgagtgcagaacgatttcacaaaatgggccaatcaggctcgcgataccatcaactaccgcctcgtaagagcgcagaatcactttatcgtgctccgtaaacggctttacgtgcaccgattccatctcaagcagtaaatcgacattcatggtttctgtcattgtcactgtgcttaaaccttagaatgaaaaatcaacaaattgctgtaagtttatcagaaaattttaaaccacgattcttgaatatcaccaacaagtgatttaggacaagttcttattagaatccgcgcatacaaaaaggcctgcacaacgtcaggccttcttctattcctctgctcgtttcaacatcgagcccgggattattgattactgagcagcgtctttgccgttttcaattttcaacaattccacttcaaacactaaggttgagttggcaggaatggttggcgtatcttgctcgccgtaagccagttcaggcggaataaccagtttaaacttagaaccgactgacatcagttgtacaccctcggtccagcctgggatcacacggtttagagggaaagtcgcaggctcgccacgttcataagagctgtcgaattgcgaaccgtcaatcaaggtacctttgtagtgaacttgcacagtatcggtatcttttggcttatcaccttctgctggtgtcatcacttgatacagcagacccgattgtgtttttacaacaccagactctttctcgaattgggcgcggaactcatcgcctttcttcttgttctctgctgctttttcagcggctttggcttgcatggtttcagccacacgcttatctaacgcttcaagcgcagcacgtgtctcttcttcgctcatttctgggttgccagcaaacacatgttcaatacctttcagtaccagatctttgttcagatcgatgccaatttcacttggcttctcaatactggttttaagatagtttgcaaacgatacgccaattgcgtacgccgctttatcatcttcagacttgaactcaaccgttttcgctgctgcggtttgtgcggcaggcgtggtttcggtttttggtgcttcttctttctgacaaccaaccgcgagcattaccgtcgcagccagcagtgacactttaaaaagtgatttcatcgggttctccaattatgaggtaatccttttggcgttgtgcacaaaaaccagcaaccaactggtgcacaacaaagagttgtaccaatatagcgatatgtttcatgattgtctttacacaacaaacggataattcgacttgatgcgaagaatttatcactcactctgcgctttgcttgtcatcttaatgttaagtggctgtttttttacccaccaagcagagcagcaatgggacttagcccctgaaggttcaaccgcctttggcttaagtcgtgacggccgatttgctcttatctattccaagcagcagcagttagtactatgggatctgttgcaagataagaaacttgccgatcttggcgcgcaagatccacaagctaaccctgtttccgtgatccgtatcgcggatagcgaacgtttcgcagtcaccgcaagccagaataactttgcagtttgggatctcgcttggacccaaggcaaaggactttggtcgattaccgatgggctgatccgcgatgttgatctctccagtgatggcgaacaggtactgctcggattgaccaatggcaaagcgatttacgttgacttagtcagcggccgccgcatggagttccttgctcaccgtgaaaaagtcaattctgtcgcgctctctgccaatggacgctatgcgctcaccggaggcaatgactatcacgcttatttatgggataccaagactgggcaaatcgttcgccaatttgaacatgagcagcgagtcaatcgggtcactttacaacgagaaggtaaactggcgtttacttcagatggtggcaatcaagcgctcatttgggatctcaccgcagacagcaaacctatccagttacagagttttcgacgccaactaattttttccaccgctcgcttttctgatgatggaaaaaagctgatcacgggaactccctctggattagtcgaagtatggaatacgcaagatggtaagaaaatcgccagcttcgaatctgaaaacaaaaaagatcacggtcctacccaagctgtcgtgtatgatgcggcttttgacgcccaacagcgcgccgtagcgggcagctctgcgggtatcgctcaagcttggcgaatggagaactgaaaatgcaagagatgtcgctaacccaacttcaagagcgcattgaagatttagagtgcaaattagcttttcaagagcaaaccatcgaaactcttaatgatgcattaacccagcagcaactgctgctcagtaagatgcaagatcagatgaaatacgtggtcggtaaagtcaaaaatatggacacttccactctagcggatcctgcgcacgaaacgccgcctccacactactgatggaatcattttccactggaagcctacgtaattcgcgatcttaacgagcgaaaacgtaggctatcaccgcaccagccaccaccaaacaaccgccgatgcgccgcaactgattatccggttgtaagctcaattgtgccaccatctgacgccatcctctcggcgcgaataagggtcctagcccttcaacgatcaacactaaacctagtgccacccaaagtgtctgcgacatattgactccaaataacaaaggccccttacggagccttgaattaataacgttaactcatgcttacttggcggctgcgcctttcgcattattcatgtattggaagaactcactgtttggatccaataccagaatatcatttttgctgttaaacgatttctcgtaggcgcgcagtgaacgcaggaagctgaagaactcaggatctttcttataagcatccgagtaaatcttcgcggcttctgcatctgcagtaccacgagtcacacgcgccgtcttatctgcttcagcaagaatggttgctacttcaagctcggcttgcgcacggatcacttccgctttttcacgaccttgtgaacggtgcttacgagctaccgattcacgttccgcacgcatacggcgatagatagattcgctgatctcatccggtagattgatcttcttcatacggaagtcgaccacatatacccctaagtctttcatcgcactttcacgagtatcgttcagtacttcagacatgatttgatcacgctgaccatcaatctccatcgcttcttttgccgcttccgtcgtcaattcagaagaatctgcattttcaggtaacacggcaacattgcgagggccagaaacgatctgcttgatttcacgcgcaccgatttcagaacgcaagacgtcagtcactttacgctccaatagggcttctgcggtcaacgcattaccaccaccggttgccaagtagtattggccgaaatcttcgatacgccacttaacgtaagtatcgatgatcacgtcttttttctcggacgtcacgaaacggtctgaacggccatccatggtttgaatacgtgcatctaaggtttttacacgatcaaacagtggcattttaaaatgcagacccggttcataaattctcgccagatcgttattgtctttcaacactcgaccaaaacggatcacgattccgcgctcgccctctgggatcacgaacatcgacatcaataaagcagcgatgatcagaacgatactagggattaataacttacgcattcttagtatctcccttgacgtgtggtgctacgcgactgagtgtcggtattcgtttctgtcgtttgtgattcaagctcaatttgatcgtaggctgatgaagacttatttggacgcggctgcgccgttttattgtcttgacccgctaacttatcaatcggcagataaagcagattaccgctcgattcagaatcaatcagtacttttgaagtattgctatacacctgctccatcgcatccaaatagagacggtcacgggttactttcggtgcagcttgatactcaggcaacagcttttcaaactgagcaacctgaccgagcgcttcattgatggtgcgctcgttgtaaccttgcgcttctttcttcagacgctcagcacggcctgtggctttaggcaaaatttcgttcttgtaagcttccgcttcgcgaatgaaacgctcttcatcctcacgggctgcaatcgcatcgtcaaaggcatcttttacttgctcaggtggacgagccgactggaagttcacatcaacaatcatcaagcccatatcatagctatcgatgacttggttgagtgtctgctgcgtgctttggcgaatttgctgacgaccactggttaggatgctatccatcagtgagtcaccgactacggcacgaagcgcagagtccgttgcttgacgcaagctgtcatccgcgttggtcacgcgatacaagtatttgtatggatcggcaatacgatattgcacatccatcgataccgttaccacgttttcatctttggtcagcatcaagccagaggcgcgcagagagcgaatcgcttgcacgttgactggtgtcacttcatcaataaagcgtggacgccagttcagacccggatcaacaatgcggtcgtatttgccaaggcgtagcacaacgccgcgctcagcttcaccgatggtataaaaaccagtaaagaaccaaaccgcaacagcgatagctgcaatgacaccaaagccaatcgcaccgccaccggaaaacgaagggcctttaccacctttgccaccaaacttgccccccagcttttgactcagtttattaaacacttcgtctaaatctggcggtccttgatctcggccacctttgttaccgcgattgttgttcccccatgggtcattatcgcggccattgttgccgttattattaccaggctcattccacgccattagaaaactccatcatttgatatgacgttatactctagcagtcctttaagtaactataaagtcacataaatctgcttgctctcgtttttctagtctagcccaatcgacctgttgcatccgcacagtgatcagtaaattgccttccggatcatactcttcctgttgaatacagttcatttggaaaaatgtgctacggatacgtccttgatgtcgcggcggaatacgtaagtgatgctccaccacttggctagccaaacgctcactcaatgcctcaaagagtagctcagtacccgcgccctgcatggcagagatccacactactctcggaacgccttcatcatcccgttctatacgtggagattgctcttcgagattatcgatcttattcatcaccaacaaagtggggacttcatgagcatcaatctcttgtaaaacagtctctaccgcttggatattctcacgaaagcgttcgtcactggcatcaacaacatgtaacaaaatgtcagcttcttgtgtctcttgtaacgtcgctttaaaagccgcaacaagatcatgcggaagatggcgaataaaacctactgtgtcggctaaaacggccggccctacatccaccagatcgattttacgcaaagtaggatcgagtgttgcgaacaattgatccgccgcatacacaccggcttcagtgattcggttaaacagggtagatttccctgcgttggtataacccaccaacgagatggttggaatttctgcacggctacgagcacggcgcccttgttcacgctgtttggccactttttctaagcggcgcaaaatcgctttaatccgttcacgcagtaaacgtcggtctgtttcaagctgggtttcacccggcccacgtaaaccaatcccgcctttttgtctttctaagtgcgtccagccacgaattaagcgagtagagatatggcgcaactgagccaactcgacttgtagcttgccttcatgggtacgagcacgttgagcgaagatatcaaggataagacctgtacgatcaatgactcgacattggcacagtctttcgaggttacgttcttgggcaggagaaagagcgtggttaaaaatcaccacattagcaacatgcatttgcacggcttcggcgatttcttgggctttgccctcaccaacgaaatatttagggtgaggggtctgacgactgcctgttaccacatgcagtgttgtcacccctgcggaagaaatgagcattttacattcgctcagatcttcccactcaccccgttgcgtgaagttgacatgaacaagtacggctcgctcaccggcttcataacggtcaaacaagcgatcaactccttaaataattgtgcaaagaattactcttcagacttctctgctggacgatccgatgctgggcggtcgccgctgtggtggctaactggacgagcaggaaccacagtagaaatcgcatgcttgtaaaccatttggtttactgtgttcttcagcaagatcacaaattgatcaaatgattcgatctgaccttgcagtttaatgccgttcacaaggtagatagaaacagggatacgttcacgacgtagtgcattcagaaatgggtcttgtagagattgccccttagccattttgtttttccttattttgtcttttctagtaattatttagctagcggtgcagcagaattatatgcagccttgcatctgagctaaacgaatcaaaatccccgttgctaccgatgctcaacagagtaccaatagcggatcctttccggggtacatcacgcaaaagcgatcacattatacacagcttatttcgttggaagctatcgcattcgagagcgtttcaacggcttgatcaacgttttcgctatctaaccaagttaaatcatcccagctgcgtaaccaggtgatctgtcgcttggccaattgacgggtggcacagatgccgcgataaatcgcttcatctaaggttccatgaccgtctaagtaatcccacatctgtcggtaaccgacgcagcgaatcgaaggaagatccggatgaagatcgtctctggcatataatgctttgacctcttcttcaaaccctgattcgaccatcttctcaaagcgaagttcaatccgacgatggagttctgccctttccttgggagcaattgcaaactgcagcacccgataaggaattgcttcccctttggtttgtgtcagttcagtaagagttttacctgaaattcgataaacttccaatgcccgcgacaatctttgtggatcattgggatgaattcgctgtgctgagacgggatcaatctgttgtaactgatcgtgtaacgcctgccagccaagcttttcagcttccagttcgatctgctggcgaatcacgggatccgcggcaggtagtggtgataacccttcgagtaaggctttaaagtagagcattgtgcctcccaccaacagtgggattttgccctgagcgacgatatccgccatctcttttaatgcatcacgacgaaaatcggcagccgaatacgcttcactcggatcgagaatatcgatcaaacggtgcggtgcgagtgctagctcttgagcatccggttttgcggtgcctatgtccatccctcgataaatcagtgccgagtcgacgctgatgatctccaccggatatttctgacgtaagcgaatggctaaatccgttttgccagaggccgttgggcccattaagaagagggcgagaggtaacttttgagtcatgagtgtaatgctgtaattgaggcggaaaaatccaccaaagtaataaaatgcgggtcttgcaaaggcaagttgccttgccagagctgctccagctctgcgatcaagccgatcgcctcggctaaagtgtagtctcttttttctacaacgatgcgttgagttaaccaatccgccaacgcttgatggctcaaggcttggctttccgaacaactcgccgcgtaagataacagatccggcagcaattgctgtaaattttgctggcgcagcggctgcggaaccgccatcaccataatgctgtgattggtgcgcgatttcagctcaatacccagttgcaacagggccgatgaatgacgctgcgccacttgccattcagattcattcagttttagcgcgagtggcaccagcagtggctgcgctttcagcgcaccatgctgagcattgagtaatccacgcagtttgagttgctgagcttggtatagcgagataagcacacagccttgtgggctactcatcaacaggtactgtcccgcgaccacttggatcgctttacccagtttttcgatagcaatattagccttgacggcttcaattgatgagacgatggtactggcagtactcggttcttcatccgataaatcgggagtttgcatcaaggtttgataaaccgcggcctcttttttgctgacggatgccgaaccatatctttctttgccagtacttgcagtcttgggtgaagccacccaaggattactgaccgctcgctctctaacctgcggattatcgctctcatccctatcgttatcacgtggagctttgcgcggataatctggcgtattttgcaccgcttgccacactctttcttgttgcgtggtatcgatcatcggcacaaccggaggattcacctcttccgcgcggtgaggtaaatgaaacgccccttcattaatggtcggagccatcacctgcgcaccttgtactagcgcactgcttaaggcttgatagatgaaatcatgaacgaggcgagcttgatggaagcgcacttcatgcttggctggatgcacgttgacatccacttgatgaggatcgagttcaataaacagcacataggtagcaaattgatcgacacgtaagctggtttcgtagctttggcgaatcgcatgattgatcagcttatcacgcatcatccggccgtttacgtaacagtattgcagatcgctctgctggcgcgctccttcgggtgtggtgatccagccatgcagtttaagcccttggtgctctaactcaatgcgtaacatatgttgcacaaacgggttgccacacaccgcagctaaacgtttttcctgctgcggtaaagtcgttgcagcgcgatactgacgcacgatttttccgttatggcgcagagtaaagctgacatcaaaacggctcagagcaattcgtttgagcagctcatcaatatgggtaaattcggttttttcggtgcgcagaaatttacgccgtgccggggtattgaaaaagagatccagcacttccacagtcgtacccacggggtgagccgcgggctgtaacttgaccgccatatcacggccttcactgtaggcagaccacgcttcttcttgagctaccgtgcgcgaagtaagggttaagcgtgagactgagctaatactggctaaggcctcgccacgaaaaccaaggctcatgatcgcttccagatcatcgagggtgtgaattttagaggtcgcgtgacgactcagcgcaagccctagttcgtccttatcaatacccgaaccattatcgcgaatacgaatgagcttagcgccccccttctcgagatcaatatcaattcgagtggctccagcatctaaactgttttccaccaactccttgactactgaagccggtctttctacaacttcacccgctgcaatttggttggctaaacgggcgggtaggattcgaatcgtcatgagcgcttatttattcgggataatcagttgctgcccaaccaacaattggtcagtgcgtagctggttggcttggcgaatgctatcaacgctaacattgtattgatcagcgattttgctcaggaattcaccgcgctgcaccttgtgcttacgcagcggcttatcttttaaactcaccgtgattttcagcttctgcccgagcactagagtatccgatttcagattgttctctttttttatcgaagccactgaaaccttataggtggtggcaagtttaccgagaaaatcgcccgtttttaccacatgggtaatagtttccgtttctacaggatttgccatcacaggaacaggtactgggtttggtgctgaagaagctggaatagtcagcagttgcccaaccgaaatcgtcgaagacttgaggttgttggcttttttcaaagcatcgacactgaccccatactggttagcaatcagaccaattgattctccacgctgcactttgtgtttctgagctttacctcggttggcaaacagtgtgccctctggcggattatcttcaaagtactgcacaatcgccgtggctaaagcgcgagctaacttatcttgatgactgcgctgaatcagcaatttttcttctgatgggttagagataaagcctgtttccaccagtaccgatgggatgtctggtgacttcaataccgccaaacttgcattaacgggttcggttttatgcagatgcgccaccttgcccatttcacgcaaaatattcgtcgcgactttatagccctctttttgcgaatggctaaactgcagatccagtagggtctgactcacgttacgatcgttattggttttcgaaagtacttcgccagcaccgcccagcaattcagattgttgctcgtgattttccacccaacgggcaatttcggtattggcacggcgggtattcagcacaaacaccgatcccccgcgcggctgtggagtatgaaacgcatccgcatgcaccgaaaccaacaagtgcgccttgctacgacgcgcaatttccgtacgtttattcagatttacaaaatagtcaccacggcgagtcagtaccgctttcattcccggcactgcattgagttgatccgccaactttttagacacgctcaaggtgatgtctttttcatatttgcgtgtaggaccaatggaaccaggatcttcaccgccatgtcccgcgtcaatcgccaccacaatatcgtcattccctaagagttgagaggcatctttactgacttgagcgggtgaactcggcgtgctggcggaagagctctcactcactttgccatgtggcatatcaatgactaaacgatggccatattgaccaccgggtgtcggagccaatttaaataaagttggcgttgttttttgtttgagctcaaacaccaaacgaaatgtacttttttcagggggagatgaagcgcgaactttcgataaaatgccactttcagtgacattaaccggtaacttagcgcgagaggtgctctgtttgaggtcaaccaccaagcgctcaggagagctgagggtaaagtagctgtaatccacctcggatttgacatctaataccactcgtgtctcatcaggagaaggccacacgcgcacgccttccaaaacgttcgcccaagtttgaggagcgatcgcgagtaaaacgaatccaaagagtaagaatacaaaacggctaacgttcaacataactccaactgactcaaaaggtcgcatccataatggttattggctgtcagcgtagcaactcgctgatcgccgtcgtaacgcaaatcgatatcaagatccgcatttggcaatagtccatgccctttttctggccactcgactaaacaaatggcatctgcactaaagtaatcgcgaatccccataaattcgagttcttcaggatccgctaaacgataaagatcaaaatgatagacctgccacataccgagttgatatggctcaaccagtgtgtaggttgggcttttgacgttaccttgatgtcccaaggcacgaataaaacctcggctgaaagtcgtttttcccgcgccaagatcgccatgcagataaagcgttgtctgttgtgagcatatcagcgctagcgcacgacctaattcaatcgtagcttgctcatcttttagggaaaaaatcttgctgttcattacgcttttctcgacagggtctttgttgactataaagaaatcaaaagaactggaatagtaaactgggttggaattgagagacaagatctgttctgttaacaaagcgaaaaatatcgtagatcctgcaagctctcacaaggattaacgctagaagagggcaaaaagatccgttaagatcctcgccccttatcctgagtacccgacatggactaccaacaactggcaaatcagatcaaacaatgggcgatcgaactcggctttgaaaaagtcgggatttgcgacgttgatttaagtgaacatgaaccagcattgcaggcttggctagacgcaggttaccacggtgaaatggattggatggcgaggcacggcatgatgcgcgcacgccctgcagaactcttacccggaacgcttagggtgatcagtgctcgcatcaactatctcccaccacaagcgcagtttgcttccaacttaagcgatcccaaccaagcttatatcagccgttacgctttaggacgtgattaccataagcttgttcgaaaccagctcaaaaaactgggggaaaaaatcgaacaagaagtgggaaaactgggttaccgtccttttgtcgactccgccccgattcttgaacgccctctggcacaaaaagcgggattaggttggacaggaaaacattcactgattttagataaagaaaacgggtcttggttcttcttgggggaattactggttgatattcccttacccgttgatgaaccaagcgaaaatcaatgcggcaagtgtacagcgtgtataacaagctgcccaaccaatgccatcgttgccgaaggcgtagtggatgcacgacgctgtgtttcttacctcaccattgagtattcaggggttatccccttggagtttcgacgcgcaatgggcaaccgaatttacggttgtgatgactgccaactcgtctgtccttggaatcgctttgcccctttaactcagcaaagtgactttcatcgccgacaaagtctcaacaatgcggatttagtagtgttatttgaatgggatgaggcgactttcctgaaaaatatggaaggctcagccattcggcgaattggtcatcaacagtggcggcgcaatttgatcattgctatgggcaacgctccttattctccgcggattattgatacactccaacgtcatctggggcaaagtgaattacttgatgagcatattcattgggctttggaggagcaaacccaaaagaccgccacacctcgccagcatgctcgcctgattcgcattattgaaaaggggctgccaagggatgcatgaatagagcaacttgcataattaaggaaatgattgtttgatgcccatcccaatttgcgctatgtggacaacatttttaatcagacgctgttttctatcgctaaaaaaagttaatcacaacctaggtaaatgactaggatcaagtttttagactgcaatgatcttagtgctctattttttgcttagagataaaaataacaagttaataaaaaacaataacttaagaaaaaactctcattaagccaagccttagaagcaagcaaagatcctcagataagtcaactcgaaaagctaagatacagagtttatcaactgttttatccacagattttttttgtggataactctgttaatgaagacgccaaagtaagcgaaatccgtagtcagcgggtacgctttcggctgcttgaaaagagaatatttgatacatgggagcgatattattgagctgacgcgcaatgaatgactcactgagatgatgcttcacagcattatagaaagagctttagcaaaatgctaaacaccctaaaaaagaaaaatctgcgcatgagcacagtctctctttaaagaattggttgcgggggctggatttgaaccaacgaccttcgggttatgagcccgacgagctaccaagctgctccaccccgcgtccgtattgtgtcactgttaagcacagtgagagctttgaaattggttgcggggccggattgaaccgacgaccttcggttatgagccgacgagctaccagctgctccaccccgcgtccgtattgtgtcactgttaagcacagtgaaagctttgaaattggttgcggggagctggatttgaaccaacgaccttcgggttatgagcccgacgagctaccaagctgctccatcccgcgtccatatatagcgctaaacgcaataaatcttttcttcagttttctgtagtaggcaagaaactggagcaacacacgaggttcccttctttaaaacaaaaaggcgtgacctcaaccttggcaaggttttactcatcaaatgagcaagtgtggcgcacttcatcgttaagtacgatgaaactattaatttggagcgacacacgaggttcgaactcgtgacctcaaccttggcaaggttgcgctctaccaactgagctagtgtcgcatttgtcgtgatgctactgcatctacgaaagatttggttgcgggggccggatttgaaccgacgaccttcgggttatgagcccgacgagctaccaagctgctccaccccgcgtccgtgtgttatcgttaagcacgataagggctatgaaactggagcgacacacgaggttcgaactcgtgacctcaaccttggcaaggttgcgctctaccaactgagctagtgtcgcacttcatcgttaagtacggtgacaactttaatgtggtgcgacacacgaggttcccttctttaaaacaaaaaggcgtgaccttaaccttagctaggtttgctcatcaactgagctagtgtcgcatctcatcgttcagtacgatgacaactatcaatttggagcgacacacgaggttcgaactcgtgacctcaaccttggcaaggttgcgctctaccaactgagctagtgtcgcatttcatcgttcagtacgatgacaactatcaatctggagcgacacacgaggttcgaactcgtgacctcaaccttggcaaggttgcgctctaccaactgagctagtgtcgcatcaacaacgttttccgtcgtttagggctgcgaattataagagcattttcttgtgatgcaagagcttctcgtgaaaaaaactcttttttttttcgcttgccgaaaaagcatgcaagatgtcgaacaattgctctttttatagcattgaatacccgatattagatcttgaataccgccttacgatagaactgaagctcagcaattgactctcgaatatcatccaaagcaagatggctacctgttttactgaactcttttagcacttcaggctgccagcggcgagtcagctctttgatggtgctgacatcaatataacgataatggaagtacgcttccaaacgcggcatgtgtttgtaaaggaaacgtctgtcttgaccaatactgttgccacaaatcggagatttgccttccggcacccactgctttaaaaacgcgagcgtttgatctatggcttcttcttcactcacttggctttgacgtacacgcgccaccaagccacttgcggtgtgcgttgtggtacaccattcatccattttcgcgagttcggattcgggttgatgaatcgcaatcactgggccttcagctaaaatgtttagctcactgtcagtaacaatggtcgccatctcaatgattttgtgcatttcaggatcaagtcccgtcatctctaaatcaatccaaatcagattctggtcgctgaaagacataatggtgcgcctataggggtttattcacaaaagaggtactatacccaaattcagatcgacaggatacgtatcaaattgagatttgatacgccttatatctagcagagagtaagtagaacactgtgacaaaaaagaaaaagcttacacacggtcaagtacgccgggttagaaataaccaacataaaaaactcaaacaagaagagtctatcgtttgggatgaggccttgctcggcagtgcgcaaccgggattagtgattacccgctttggtcaacatgccgatattgaagatccagtgacgggggaaattcatcgctgtaacctgcgtcgcggcatcgaaagtttagtatccggcgataacgtcctgtggcgccctggggccgagactctcgcaggcatttccggtgtggtagaagcggtggaagctcgcagctctgtattagtgcgcccagattattacgatggcctcaaacccgttgcggcaaacgtggatcaaatggtgatcgtgtcgtcggtattacccgagctctctctgaatattattgatcgctacttgattgcttctgaaaccttagggattgcaccactcatcgtactgaacaagattgacctactcagcccagagcttcgagagcaatacagcacatggttaaatgattaccgtgccattggctatgacgtactctacgtcagtaagaaaaccggtgaagggattgcggatcttgaagtgaaactgcgcgatcgcaccaacgtgtttgtgggtcaatcgggtgttggcaaatccagtttggtcaatgcattacttccagaattggaagaagatgtggaagaaggggcgatttctgaaacgtctggcttaggccaacacaccactaccgccgcacggctttatcacattccaagtggaggtgatttgattgactcacccggggtacgtgaatttggtttgtggcacttagaaaccgatgatgtcaccaaagcttatgtcgaatttcgcccttacttaggcggctgtaaatttcgtgattgcaaacatggggatgacccgggttgcttgttgcgtgaggccgtaagcaagggagaaatcagcgcactgcgttttgataattatcatcgaattgtgcaaagcatgacggaaaacaaagccaatcggcagtattcgcgcagcaaaaaagccgatctgtaagagcaaattgttagcaagtttagagcatctactgacagaaggcgcgattttcagtaacatctcgcgcccatcaccactctattggaatgtaaaccatggataagattaaagttggactgcaatattggattccacaacatgccctgacccgcttggttggcaagttggcgtctgcgcgtgcaggcagcctgaccacggccatcatccgctggttcatcaagcaatataacgtcaacatggacgaggctctgcactctgatccgactcacttcaagacgtttaatgaattttttgtgcgtgagctaaaagctggcgtgcgccctatcgctgaaggcgaaaaggtgatcacccatcctgccgatgcgtgcgtgagtcagtttggtgcgattgaatacggtaaacttatccaagccaaaggccacacttactcagcccaagagctgctcggtggtgatgccaagctcgcggaagaattccgtgatggtgattttgcgactctgtatctctcgccacgtgattatcaccgcgtacatatgccttgtgatggcactttgcgccaaatgatctacgtaccgggcgatctgttctcggtaaaccctctgacagcggaaaatgtaccgaacttgtttgcccgcaacgagcgtgtggtgtgtattttcgatacagaatttggcccaatggcacaagtgctggttggcgccaccattgtcggcagtattgaactggtttgggcgggcaccgtgactccgccgcgtggcaacaccgtttatcgttgggactacccagccaacggtaaccaagcagtggttctcaaaaaaggcgaagagatgggtcgctttaaactgggctccaccgtgatcaacctgtttgccaaacaagctattcgctttgatgacagcatggcactgggcgcaccaacccgcatgggcgagccctacgcacaccaagcttaatatacgacttagagttgcagccaacaccaacgctgcttcaagtcggaagactcaacatcccagcttcggctgggatgttgtcttttgaagctcgccacacatctgcactgtcactgatagcaaaacccaaaaatttaaccgccctctaagacccatagatttcagtcgcttactctaagctttcacttgagccaagagggaaagcccatgccgcaactggaacgaggtctactcgtcaaactcctgatctgtttcttactgccgttgggcgtactattgatgccgattgatgcaatcccgattcaagatctcaccttggttcaacaccgtttactggccattttccttcttgctgcactgctgtgggtgttggagcctgttcctgtgtttgccacgtcgatcctgatcattgcccttgaactcgtcatgatttccgataaaggcttgcatggctttcgagtgcccgatccgcatcatccgctcggtgaactccttaaatacaccgatattttcagtgccttctcctctcccattatcattttgtttatgggcggttttgctttagccatcgccgcatctaaatacgaattggataacaacttagcacgagtgctactcaaaccttttggccaccagcctaagtacatcatgctcgggttaatgctgatcacctcagttttctcgatgtttatgtccaacacagcgaccacagtgatgatgttggcgctgcttggccctattgttgcgtctgcccccaaaggggatttaggcatcaaagctctggtgctatgcattccgattgcggccaacacagggggcatcgcaaccccgatcggcacgccacctaacgctatcgcactgcagtatctaacgggcgaaaacagcattgattttctgtcatggatgatgatgggattgccgttcgtactggtacaactgaccatcgcttggttcttactgcaaaagcttttcccctcctcacaagccacaatgaccttgaaactcaaaggcgaatttcaacgcggctggcgtgccatgctggtctacatcacgtttgctttaaccatagtgctgtggatgaccacctcatggcatggtatgaacacttatgtggtggcgattattccactggccgtgttcaccctcactggcatcatgggcaaagaagagctgaaacagatcaactgggatgtgctgtggttagttgccggtgggatcgcgattggtatcggccttgaacagacgggactcgcccaagcgttagcgcactccatcgactatcaatctctctcacctatgctgattgtgattgctctttcgttggtgtgctggctaatggccaactttatgtctaacacggcgactgccaacttgatcatgccgattgccgctgcgattggtacttcgatgagtagccttgagcaagtcggcggcttacaagcgctgttagtcgtggtcgctttttccgcgtcactggggatgattttgcccgtttcgacaccgcccaactcgcttgcttactcaacggggcttatcgaaagcaaagatatggcaaaaacgggtttagtcattggggggattgggcttggcatcgtttatctgatggtgttcctactcggataaactccctcttcctcccctctttcacagcttgtcatcactctcgagatagcaagctgtgaaccttctaatcgcactgaaattgcttttgttttcctgattgcttaatggcatattgagtgccctcatcactcccaaccgcaaggatgacgcaatgggttacgaatggctggcacttgccgcagcctgtctttgggctatcgccagtttactttctatcactcccgcgaaacacctcggctcttttgcttatagccgctggcgtatggggtgtacctccgtcatcttaaccaccattgccctcttcagcggaggttggtcaaccgtacacagcagtgcgattccagccatgatgttgtcggggtttattggaattttcatcggtgataccgcgctttttgcttgcctgaatcgcatggggccaaggcagtccggcttactcttctcctgtcatgcggtgttttctgccgtgctcggttatttcctgtttagtgaaagcatgaccaagcaagagctattcggctctactttagtgtttagcggcgttctgatggcgattttctttggtcgccgtgggcaaactgggcctagtttggatagcatcaatggcagtgtgtgggttggaattggactcggcttaaccgccgccttatgccaagccctcgggggcattattgccaaacccgtgatgcaaacagagatcgatccgattgctgcctctgcgatgcggatgatcaccgcctttgcggctcactctttactgcgtttaaccggcgcacgcattgctcgtcctacacaaatcatcacgctcaatatctttttggtcacggcactcaacggctttattgccatggcggttggtatgacgctgatcctctacgctctgcgtgaggggaatgtcggcatggtcgcactgctctcttccaccacacccatcatgctactaccactgctttggatctacactaaacagtgtccaaaccgctatgcttggttaggggctatccttgccgttgggggcaccagcttgttggtgtcttaaacgcgattttgatcaataggctacatttacttgcattgatagagagaatcattgatcttaaccggatgcaaaacgtctagattgtagtaaaattacgctaattttacgtttcagttattttgattttgacgaggttagaactatgtcagctaagaagccaatggctctggtgatcctagatggttggggttaccgcgaagacaacgcaaataacgcgatcaataatgcgcgtacacctgtgatggatagcctaatggccaacaaccctcacactctgatttctgcttctggtatggacgtaggtctacctgatggtcaaatgggtaactcagaagtgggtcataccaacatcggtgctggccgtattgtttaccaagacctaactcgcatcaccaaagcgatcatggatggtgaattccaacacaacaaagttctggtggcagccattgataaagcagttgctgcgggcaaagcggttcacctgatgggtctgatgtctccaggtggcgtacactcacacgaagaccacatctacgcagcagtagaaatggcggccgcacgtggcgcagaaaaaatctacctgcactgcttccttgacggtcgtgacacaccaccacgtagcgcagaagcgtcactgaaacgcttccaagatctgtttgccaaactgggtaaaggccgtatcgcttctatcgtgggtcgttactacgccatggatcgtgacaacaactgggatcgcgttgaaaaagcctatgacctgctgactctggcgcaaggtgagtttacttatgactcagcggttgaagcactgcaagcggcttacgctcgtgaagaaaacgatgagtttgtgaaagcaaccgaaatccgcgcagcgggtcaagaatctgccgcgatgcaagatggcgatgccctgctgttcatgaactaccgtgctgaccgcgcgcgtcaaatcacccgtactttcgtgcctgatttcgcaggctttagccgcaaagccttcccagcgctggattttgtgatgctgactcaatacgcagcagatatcccactccagtgtgcgtttggtccagcgtcactggaaaacacttacggtgagtggctatcaaaagcgggtaaaactcagctacgtatttctgaaaccgagaaatacgcgcacgtaaccttcttcttcaacggcggcgttgaaaatgaattcccaggcgaagagcgtcaactggtggcttcaccaaaagtagccacctacgacctacaaccagaaatgagctctaaagagctgactgacaagctagttgcagcgatcaaatcaggcaaatacgatgcgatcatctgtaactatccaaacggcgacatggtcggtcacactggcgtttacgaagctgcagtgaaagcgtgtgaagccgtagacgagtgtattggtcgtgtggttgaagccatcaaagaagtggatggtcaactgctgatcaccgctgaccacggcaacgcggaaatgatgattgacccagaaacgggcggcgtacacacagcgcacactagcctacctgtaccacttatctatgtcggcaacaaagcgatcagcctaaaagaaggcggaaagctatcggatctagctccaaccatgttggcgctgtcggatctggatattccagcagacatgtcaggccaagtgctgtacagctaagctgactcgatgatgatgaaagccctgaatactcagggcttttttatacgcatttcccaccgagtgcgatgagaattgcaaacttttgacatcacaggctcgcctgatgccaagctttgggtatactgaagcacccgttttttattcactaacactagaccaaactcaatgacagcaacggatccgcacgcgattttcagtgactttctaggaaaaaccttgacccgacgtctgctggtctgcctgttatttatggtttcgccgtcgctctttgcggctacgcaacaggagttaacgggggtaaaaagtgaaatatctcgccaacaacaatcactggccgaacaacaaaaatcgctcgaccaactacaacaagcccttaaacaacaagagcttggcatcaacagtatcgaaaatcagatcacgaaaaccaaaaacgatctggagaatgccaatcgcaacattgctcagctcaatagtaatattcaggcgctggaaactcagaaacagcaacaagccgataaactcgaacgcctactgcagacctactatctcactaaacgctcactgacgaatggtcaattttttcatcgcagtgccgatgaagaccgcatcagccagtactatcaacatttggcaaaaagccgcgcgcaagctatcgaagctttagaaaaaacccaagccgatctcaatgccagtcaacagcagagacaagctgagcgtgaacagattgagaaattactggcagagcagacccaacagcgagacaaactggctaaaacgcaaagtgagcgtaagcaaaccgtaaagaaaattgagagcagcatttccggcgacaaagtctaccttgccgaattgcagcgcaacgaaacgcgcctcaaagctgaaatagccaaagccgccaaacgcaatgcagtattgatgaatggcattgcgagccaacgcggtaagctaccgtggccactgaaagggcgtgtgctacataacttcggtgaacgccaaactgggcagattgattggaaaggtttggtcattgatgccaattacggccaagaggtcaaagcggtttatccgggcacgatcgtgtttgccgagtatctgcgaggttatggcttggttgtgctcctcgaccacggcaaaggtgatatgacactgtatggcttcaaccaaactctgctcaagaaagagggcgacaaagttatcgcaggtgaaaccattgctcttgcgggtgatactggtggtcaatcacgccctgccctctactttgaaatccgtcgtaatagccgcgcggaaaacccttcgcagtggttacagcgctaagaggcgtaaaacgcctcaacaaccgcaatcacgttatcgagcagcgcataggggagttgattgattcccccggccgattctcgccccccaccagaaggaaactgggcacacaaagctcccgcgcctcgtttatcgctcaagggagcacgtaaagagagcgtgtaatgctgctcatccgcatacgtcacaatcaaatgcgcacgttgcatatcctgattagcaagatgattggcaaatgcgccgctcacgcgctgcgctgctgcacaatcgggtaagatcaccacggtgacacttgagctccgataataagccggttgcgcaagggcaaaagcaaaatcttgctgataagcgctgcgtaattggtaaaaaggcgagttgagatcagccagcacagcccacggtgtttgataagcgagtaaagtttgatacaacgtatcaggcgcgaaatgcagttcagatacggtgcggccatagccattgtagttaatcagcgttcctaattcacaaagggcatcggtttgtgcggcatcgaatcccgcttcctccgccagagtgtgtgccacacggtgtaagttatcgccaaacgctgctgttatcgcccagtcacgaaaacgccctttcagtagccgatcaatgatcaatgccgtacagagattggcatcggtatcaatatgcgcttgcagtgcagaatgggcaggaatatcgccgggctgatgatggtcggcataaaatacatgggctcccgcttgcaaagctcgctgcaagccaagctgatttttagccatggagatatccaataccaccagctcatcaccagccgttaccgtcagtcgctcgagtaaggcaatatcgcgcttaacgcccgtgactagctgagtcgatttaggatgcactagacgccattgcacaagagaaagaatgccatcagcatccccattaaatacatcgtaatccacgtaaagcttcctttctggctggaaatgttcaggaagttagcaacgaatcggctccatgcccaagacagattggttataactcatgctcaggcatgcatagctcgcacaccttcttcaagcagttgaagctgttcacgccccgccttagtggcacaaggtttaacgaccgagatcatctgcaacatgccttgatgaatcacctcttccgtgatctgagttttgtgtgacatcgccgattgataaccaagccagctagacgcaatcagatgcagagtccgcaccagtttcggcatctcatcctcattcaactccagcagttgcagattgacaaaattacgcacgatatcaatcaaattggtctgtaatcgttcttgaacccgaatgtagtcagcatgcaactcttcatcgcgctgcaagatttccggcaaattggcatagaaaaaacggtatttccacatcagagtgaaaatcgaatccaaatagtgcttgagtagagaaaggctctcatactgaccttgtagcggagtaaaacgctcaatcagctccgccgagtagagcgcaaaaatatcacgcactatctcctgcttattgcgaaagtggtaatacaaattacctgggctgatctcaatatgagcagcgatatggttagtcgtgatgttacgttcaccttgctgattaaacagctcaagtgccgcatgcactatgcgatccttagttttcatcatgattcgcttcgtctttctgtctggattaccgaagtataaaacagtcgggctcaagatgtgaaaagcgtctgacctgcagacgcttttcacgtttactatggatggtacggcttcgaaagctcatgcaccgcttcaacaaacacaccggcattttcaggcggcacgtccaaatgaataccatgccccaagttgaacacgtggcctgtgccaccttggccaaatccagccaaaatactcgccacctcttcacgaattcgtggggcaggagcatacagaatagaaggatccatattgccttgcagtgccactttatctcccacacgcgctttagcgtcggcgatattgatcgtccaatctaaacccacagcatcacaacctgtagccgcgatctgctccagccacatgccaccatttttggtaaacagcgtgactggtacacggcggccttcgttttcacgaatcaagccatcgacaatcttgtgcatgtattgcaaagagaactgttgataatcacgcggtgttaacacgccgccccaagtatcaaataccatcaccgcttgtgcgccggctttaatctgagcattcaggtagctgatcacactgtcagctaatttatctaacagcgcatgcagcacggtaggctcgctgtacatcatctttttgattttggtgaaggcttttgaactgccaccttcaaccatataagtggcgagcgtccaaggactgccagagaaaccaatcagcggcacttcaccttgcagatctttgcgaatttgacgcaccgcgttcatcacatactgcaattccccttcaggatcgggaataccaatcttatcgacatcggctttgcaggtgatgggacgctcaaagaccggtccttcgcccgccgcaaaacgcagcccaagtcccatcgcatcaggaatcgtcaaaatatcagaaaacaggatcgcagcatcaagcggaaaacgtcgcagcggctgtaaagtcacttctgaagccaactctgcattcttgcacagcgccataaaatcacccgcttgagcacgagtggcacggtattcagggagataacgccccgcttggcgcatcatccatacaggagtgtaatcgactggctgcttgagcaaagcacgcaggtagcgatcattttttaattcagtcatggtgattcccactttttcggcttctttactttggcgcgtattctaacatcgtttgtcccacaaaagcggttggctttgcaagcgggatcaagttattaacttttaaatcaatgcttaaattgcgtccaacccttaacggtgttaaaaatttgttcgctagcgaaaactataatcataaactgagtcctcgactcagcatctcataacgacatcttacttaccccctccttaaccggagggtttttttttgccttttaagcctgatcttgggcaatatcggccaacgtctgctcaatcaaagcgcgggcaatcgtccctcgcggtgcaacaggaggaaggttttcgataccaaaccaattggcatcactcaattcactgtaatcgggtttaagctcaccagtgtcataatcggctaaaaacgccatcatcatactcgacggaaatgcccaaggttggctgccaaagtagcgaatattggtcacgacgataccggtctcttccaacacttcacgcgcaacacactgttcaagcgtctcgcctacctcaacaaagccggcaatcacggtgtacataccattgcgatggcgtgggtgctgcgccagcaaaatttgctgctgtttacgtacggcaacaataatgcagggaaaaatacgcggatagtgcagggttcggcaatcgtggcactgcattgccagttgctgatgattgagatagttacgccccccacattgcggacaaaatcgtatggtttggctcatatggccatattgcaccgctttgcttgcagcaagaaacagcgcctcatccacacccaataactcacgtaatgaagtgagcggacgatcctgctcaatatctgcagcattcagccagtagacaggggagttttggtaacgatccaccaagatcgccttctcttgtggcagatcccactgctctgcgctgccataaggaatttggccatccaccagccaaagatcgctgcctgaaacaacacaccaataagcgttcttgccgtcactcttttccactctgcttctcctgattgcttgcagtcggatcattttactggcaatctaaattcacaccacaatttgtcagcacaagaattattgactataactttttgtgagggcagtagtgatatcttattgatattactaaaaaggcaaaggaacgatcgtcagtgacgatccgatcatgaggacatggtcatgctaagaaaattcaaaaacgtccaagaacaatggggtggttcgagcgatatcattgaccattggctggataaacgacagcatgtgatcgttgaatattgtaagctggcggcactgcaaccttgtacaaccaaagctgcggtttctgaactcccttctccacaggctctgctgtatttttgccaagaattagtggattacatctctgaaggccatttcaaaatctatgacatggtcatggataagtggcacgccaccggttttaaagcgaccgatgagatcaatcaagtctacggtaaaatcgtcgctaccaccgaacccctgctcaattttaatgatcagtacgcaacggtgactgaatacgatgaactgctcgatctagatcgtgacttatcaaaagttggcgaagtgcttgagctacgcttttctcttgaagatcaattgatccagttaattgcggatagccttgctgtacctccgggtgcttagcagaacactcgttttcaatcggtgatttccgctgcgaagatgaatgtaaaaaatagaccaataaaaaaggcaccttaaggtgccttttttcatagcttgatgactatgacttactcgtcgtcagaagagaaacctgcattcaacagtgcagcgaggttgtcagtggcttgttcagccgatggaccttgctgttcttgtgcacgtttggcttgacgatcttggtggtacgcaaaacctgtaccagccgggatcagacggccaacgatcacgttctctttcagaccgcgcagatcgtcacgcttaccagataccgctgcttccgttagaacgcgagtggtttcttggaacgatgctgctgagatgaaagactcagtcgccagagatgctttggtaatacccaacaactcacgctcgaaacgagctggctctttgccttcttcaaccagtttacggttcgcgatcttcacttgtgagtactcaactgtctcgccaggcaagaactctgagtcacccgcgaaggtgatcgtacacttacgcagcatttgacgaacgatagtctcgatgtgcttatcgttaatcttaacgccttgtagacggtaaacttcctgaacctcgttcgcgatgtaagtggtcactgcatggatcccacgcagacgcaggatgtcatgtggcgactctgggccgtccgcaatcacatcaccacgctcaatgcgctcaccttcaaacacgttcaattgacgatgtttagggatcatctcttcgtaagtgtcaccgctgtcacgagtgatgatcaaacgacgcttacctttagtctctttaccgaacgatacggtacctgagtgctcagccagaatcgcaggctcttttggcttacgcgcttcaaacaggtcagcaacgcgtggtagaccaccggtgatgtccttgttaccgccagacttctgaggaatacgagccagtgtatcacccacattcacttcagcaccgtcgtccaagttcacaatcgctttacctggcaggaagtattgagctggcatgtcagtacctgggatcaggacatctttaccatttgcgtcaaccagtttaatggctggacgcatatctttacctgctgcaggacgcgctgcggcttcagtcacttcacttgaagacagaccagtcagatcgtccgtttgacgagaaacggttacgccatcgatcatatccacaaactgtacgcgacctgccacttcagtgatgattggcatggtatgcgcttcccagttcgctacggtttcgcccgcagccactgcatcaccatcggctttgctcagcatagagccgtatggcagtttgtgtttctctttggtacgaccaaattcgtcaatgatggtcagctcagaagcacgagaggtgataacgagcttgccatctttattggttacgaacttcgcattgtgcagtttcacagaaccgttgttcttagcttggatgctgttttctgctgctgctgttgatgccgcaccaccgatgtggaacgtacgcatcgtcagctgtgtacctggctcaccgattgactgtgccgctataacaccgaccgcttcaccttggttcaccaagtgaccacgtgctaggtcacgaccgtaacactgcgcacaacaaccgaagtcagaatcacaagttaccactgaacgtactttgatttggtcaacagagttatcgttgatcaccttacaccacttttcatccagcagtgtattacgagggatcaacacttcatctgtacctggcttgaggatatcttctgataccacacggcccagtgccagttcagtcagtgcgactttaacgtcaccaccttcgatgtgcggtgtcatcaccacgccttctagggtgccacagtcatgttcagtcaccacaacgtcttgcgctacgtctaccagacgacgagtcaggtaaccggagttcgctgttttcagtgccgtatccgccagacccttacgagcaccgtgcgttgagataaagtactgaagaacgtttagaccttctttaaagtttgccgtgattggcgtttcgatgatcgagccatctggacgcgccatcagaccacgcatacccgccaactgacggatctgagcagcagaaccacgagcacctgagtcggccatcatatagatgctgttgaacgactcttgtttttcttgttcgccttgacggttaatcacctgctcagaagagaggttttccatcatcgctttcgctacgcgatcgttggttgatgcccaaatgtcgatcactttgttgtagcgttcgccagcggtcaccagaccagactggaactgctcttgaatttcgcgtacttcttcttccgcttcagcaatttccgtgtacttagccgctggaactaccatatcgtcgataccaaccgatacaccagacagtgccgcgtaagcgaaaccggtgtacatgatttggtcagcgaagataacggtgtctttcagacccagcttacggtatgcctcgttgagcaggttagaaatttgcttcttacctaacttctggttcaccaagctgtatggcagacctttcggtacgatttgccacaacatggcacggccaacggtcgtgtcaatcatcttggtttcagtggtcagcttaccgttttcatgcttgatggtttcggtaatacgtactttaacgcgagcgtgcagctcagcagtcttagtacggtacgccttctcagcctcagcaggaccagtcaggtacataccttcgcctttcgcattgatcttttcacgggtcatgtagtacagacccagtaccacgtcctgagacggtacgatgattggatcacctgacgctggcgacagaatgttgttggttgacatcatcagggtacgagcttccaactgcgcttcaagcgtcagaggaacgtgtaccgccatttggtcaccgtcgaagtccgcgttatacgccgcacacactagtgggtgcagttggatcgctttaccttcgatcaggaccggttcaaacgcttggatacccaaacggtgaagtgttggtgcacggttcagcagcactgggtgttcgcggatcacttcatccaagatatcccatacgaccgcttcttcgcgctcaaccattttcttagcggctttgatcgtcgttgctaggccacgagtttccagcttgctgtagatgaatggtttgaacagctcaagagccattttcttcggtagaccacactggtgcagacgcaggtatggacctacggtgataaccgaacggcctgagtagtcaacacgtttacccagcaggttctgacggaaacgaccttgcttacctttgatcatgtcagccagagacttcagcggacgcttgttcgagcccgtgatcgcacgaccacgacggccgttatccagcagcgcatccacagactcttgcagcatacgtttttcgttacgtacgatgatgtctggtgccgccagttcaagcagacgcttcaaacggttgttacggttgatgacgcgacggtacagatcgttcagatccgacgttgcgaaacgaccgccatccagtggaaccaatggacgtagatcaggcggcagaactggtagtacagtcaggatcatccattcaggtttgttacctgatgcgacgaacgcttcaaccagcttcagacgcttagtcagtttcttacgtttggtttcagagttagtggtatccagctcttcgcgcatctgctctgcttctgcaggcagatccatcgatgccagcagatctttgatcgcttcagcacccattttcgcggtgaactcatcgccccactcttccaaacggtcgaggtactcttcctcagtcagcatttgaccacgttcaaggtcagtcatgcctggctcagtcactacgtacatttcaaagtaaagtacgcgttcgatgtcacgcagaggcatgtccatcagtagaccgatacgagatggcagagacttcaggaaccagatgtgcgcaactggagaagccagttcgatgtggcccatacggtcacgacgaactttagtttgggtgacttcaacgccacacttctcacaaatcacaccacggtgtttcagacgcttatatttgccacaaagacattcgtagtcttttaccgggccaaaaatacgcgcacagaacagaccatcacgctcaggcttgaacgtacgatagttgatggtttcaggttttttcacttcaccaaaagaccatgaacggatcatgtctggtgaagccagaccgattttgatcgcatcaaattcttcggtcttatgctgtgcttttagaaagtttaataagtctttcacattcagctcctgtaaggagttaaaaggaactcgctgcgattggcaacgagcaccttcctaccgaaaccggtaggcttccccttgcggggaaaccttagggtttattattcgtcttctagctcgatgttgatacccagcgagcgaatctctttcaacagtacgttgaacgattctggcataccaggttccatcgcgtgattgccatctacgatgttcttatacatcttagtacggccgttcacgtcgtccgatttaacggtcaacatctcttgcagggtatacgcagcaccgtatgcttccagtgcccacacttccatctcaccgaagcgctgaccaccgaactgagctttaccacccagaggttgctgagtaaccagactgtaagagcctgtagaacgagcgtgcatcttgtcgtcaaccaagtggttcagtttcagcatgtacatgtaacccacggtaacagggcgctcaaatgcgtcacccgtgcggccatcgaacagagtcaactgacctgaagctggcagatccgccagttccaacatagctttgatagacgattcaggagcaccatcgaagactggcgttgcgaccggtagaccagcacgcaggttatgcgccagtgtacgaacatcttcatcactgagttctgagatatcaacgcgttgacgagtatcgcctagatcataaaccttctgcaggaactcacgcagcttcgccagctcttgttgttccttgatcatttggttgatcttgtcaccgatacctttcgccgccagacccaagtgaacttctaggatctgaccgatgttcatacgtgatggtacgcccagtgggttcagtacgatgtcaaccggctgaccgttttcatcgtatggcatgtcttcaacagggttgatcttagagataacacccttgttaccgtgacgacccgccatcttatcacccggctggatgcgacgtttcactgctaggtaaaccttaacaatcttcagtacgccaggagccagatcatcaccttgggtgatcttacgacgcttcgcttcaaacttcttatcgaagtctgctttcagttcgtcgtactgttctgccagttgctctagctggttttgcagctcttcattttcaagcgtctgctctaaccatttcttacgttcgattgaacccagtttcgcttcagtgtaaccacccgccagcagtacagaacgaacacgcgccagaagaccgccttccagaatttggaactcttcagtcaggtctttcttcgcttctttcagctgcatctgttcgatttcaagcgcacgcttgtctttttctacgccatcgcgagtaaagacttgtacgtcgataaccgtacctgctactgagttcggtacacgcagagacgtatctttcacgtctgaggctttctcaccgaagatcgcacgcagcagtttctcttctggagtcagttgagtttcaccttttggtgtcactttaccaaccagaatgtcgccgcctttcacttctgcaccgatgtacacgatgccagattcgtcaagcttagacagagccgcttcacccacgttagggatgtcagccgtgatctcttctgcgcccagcttagtatcacgcgccacacaagaaagctcttggatgtggatagtagtaaagcggtcgtcttgaactacgcgctcagacactaagatcgagtcttcgaagttgtaaccgttccaaggcatgaatgcgatacgcatgttttggccaagagccagttcgccaaggtcagttgaaggaccgtctgccagtacatcgccacgagctacaggttcacccggcatcacacatggacgctggttgatacaagtattctggttcgaacgggtgtacttagtcaggttgtagatgtcgatacccgcttcgccagggatcaactcttcttcgttcactttgactacgatacgagaagcatcaactgactggataacaccgccacgtttcgccaccgctgttacaccagagtcaaccgctacgttacgctcgatacccgtaccaaccagtggtttctctgaacgcagagttggaaccgcctgacgttgcatgttcgcacccatcaaagcacggttcgcatcgtcgtgttctaggaacgggatcaaggatgccgcgatcgatacaacttggtttgtcgcaacgtccatgtagtcaacgtgttcacgtgggtgaagacctgactcgcctttttgacgtgcggtaaccagttcatcagcaaaaccgccttcttctgtcagcttagcgttcgcctgagcgataacgaattgaccttcttcaatcgcagagaggtaatccacttcgtcagtcacaacaccgttgactacgcgacggtaaggggtttctaggaaaccgtactcgttgcagcgtgcaaacgcagacagcgagttgatcaaaccgatgtttggaccttcaggtgtttcgataggacatagacgaccgtagtgcgttacgtgtacgtcacgtacttcgaagccagcacgctcacgagtcagaccgccagggcccaatgcagaaatacgacgcttatgcgtcacttctgacaacgggttgttctgatccataaactgagacagctgagaagaaccaaagaattcttttacagcagcagaaattggtttcgcgttgatcaggtcttgtggcatcacgttgtccagatcgcccaagcttaggcgttctttcactgcgcgttcaacacgtaccagaccaacacggaattggttctctgccatttcgccgacactacggatacgacggttgccaaggtggtcgatatcgtccacttcgcctttaccgttacgaatcgagatcagctttttcatcacttcgatgatgtcaacttcgtccagcgtgccttgctcttccgcatcttcacgaccgattgagctgttgaacttcatacggccaacagtcgacagatcgtaacgctctgcagagaagaatagactttcaaacagcgattccgcggcttctttcgttggtggctcgccagggcgcatcatgcggtagatttctaccagtgcagagatgcgatctgtcgtgctatcaacacgcagggtttctgacatgaacggaccgtggtccagatcattggtaaatagaacttctagctttttgtaaccggcttgagacaggttcgctagcgcttccaggctgatttcctggttcgcggtaatgatcagttcgccagtcgcttcattcacgtaatctttcgcagatactttacctacgatgtactcaaccggaacttcaataaagttcacgccatctttttcaagttgacggatgtgacgtgcagtcacacgacggcctttctctacgtaaaccttgccatccgcttcgatatcgaaggtcgcagtttcaccacgcagacgctctggaaccaactccatcattagagtttgatctttcacttcgaaattcactttttcgaagaagatgtccaggatctcggcgctagttttacctagtgcacgcaggatgatcgatgcaggcagcttacgacgacggtcaatacgtacgtacaggttgtcttttggatcgaactcaaaatcgagccatgaaccacggtacggaatgatacgtgcgttatacagaactttacctgaagagtgggtcttacccttatcgctgtcgaagaacacgcctgggcttcggtgcagctgggatacgataaccctctcagtaccattgattacgaaggtaccattttctgtcatgagcggaatttcgcccatgtagacttcttgttctttaatatctttgacagtacctgctggcgcgtctttatcaaagatcactaagcgtaatttcacgcgtagcggttttgaataagttacaccacggatttgacattctttaacgtcaaaaactggctcaccaagacggtagctaacgtattgcagctctgaattgccgttatagctctgaattggaaatacagaacgaaaagcggcttcaagaccgtattgtccttcaggatcctgttcgatgaacttttcgaacgaatcgagctggatcgatagcaggtatggaatgtccaacacttgtggacgagtaccaaagtccttacggatgcgctttttctcggtataagagtaaaccatggggttcctcagctcgctgataagtgacccaaactgtccacctttcaggttaaaaagggtgaggacagtgactaatcgctgtttactgtagtgtgaattcattgcgttgaaatgaactcatttgcatgaatatggaacgcttaaacagcgggaaaattcgtccataccctacagcgcaaaaaggccggtggttattaaaccaccagccattagcctttcggctaagaaattaagtaggaattacttaacttcaacagttgcaccagcttcttcaagctctttcttcagtgcttctgcttcttctttagatacagcttctttaacagatgctggagcgccgtctacaagagctttagcttctttcagacctaggccagttgcgccacgtactgctttgataacagcaactttgttcgcgccagcagcagccagaattacgttgaattcagtttgctcttcaactgcagcagcagcagctggaccagaaacaactgcagcagcagcagaaacaccgaacttctcttccatagcagagatcagttcaacaacttgcattacagacatttctgcaatagcgtctaggatttgctcgttagtaatagacataacaattctcttttaagtcaacaataagtttatttagcaaccagtaaaaagcaaaagcgattttgcttatgcagcttctttttgatcgcggacagcagcgattgtacgaaccagcttgccagcagaagcttctttcatgcacatcatcaggcgtgcaatcgcttcgtcgtaagttggtagtgtcgctagtacttcagggtcagtcagtacaccttcaaatgcagctgctttgatctcgaatgctttgttctctttagcgaagtctttgaaaagacgcgctgcagcacctgggtgctcgttagagaagccgatcaaagtagggcctacgaatacgtctttcagacattcgtaagctgtgccttctactgcgcgacgtgccagtgtgttacgaacaactttcaggtaaacgcccgcttcacgagcttgtttacgcagattagtcatcgcagcaacttgaacaccacgagagtcagcaacaactgcagaaagtgcaccactggccgcttcgttgacttcagcaacaattgcttttttgtcttgaagatttaaagccatcttggattaactcctggttgtcgttacaccgctcactattatcaacaacagtgagagcttttttggtgcagtcccagaagaaaggtaacttaaaaagtagatctttctgtcagttcgggcaccatctacgtaggttttattaagttatccgaggataacgcctacggtcttggacggagactgggttttcaccacgaggtaaaagttcagccccaaccacaaatattaggcgcagaattatacacaaattctgcgcctaagcaaatgcattaaacttgtgcgctcagagtattctgatcgacagcaacgccagcacccatagtagtagagatgcttaccttcttcacgaaaacgcctttcgcagaagatggttttgctttcttcagagcaaccagcagagcttctaagttctctttcagttggtctgcttcgaacgtcaccttaccgatagtggtatggatgataccgttcttgtcgttacggtaacgaacctgacctgctttcgcgttcttaaccgcttcagcaacgttaggagttacagtaccaactttcgggtttggcatcagaccacgtgggcctaggatagtacctagttgaccaacaacgcgcattgcatctggagatgcgataactacgtcgaagttcatttcgccttttttcacgagatcagccagatcttccataccaaccagttctgcaccagctgctttagctgcttcagcgttagcaccttgagtgaataccgctacgcggatgtcacggccagtaccgtgtggcagtacagtagcgccacgaacgttttggtcagatttacgagcatcgatacccaggttaacagcaacgtcaactgattcaacgaacttcgcagttgccagctctttcagcagagcaacagcttcgttgatgtcgtactctttagttacatccacttttgcgcggatagtacgcatacgcttagttagttttgccattgtattaaccctcaaccactaggcccattgagcgagcagtacctgcgatagaacgcttcatcgcttcgatatcagcaccagtcatgtcagctgctttagtcgcagcgatttcttggatttgagcgtcagtgattgtgcccactttagcagtgttaggacgtgcagaaccagacttgatgccagctgctttcttcagaagaacagatgctggtggagtcttagtttcgaacgtgaaagaacggtcgctgtacacagtaataactactgggattggtagacctttctctagagattctgtacgtgcgttgaacgctttacagaattccatgatgttaacaccgcgttgacctagagcaggaccaactggtggacttgggtttgccatgccagctgcaacttgcagctttacataagcttcaactttcttagccatgatatttcctagattatgggtgcaaacgctaatcgattgatcagctccccggttttcataaagaacctgtaaaaaggcgcgaaattatagtcataatccacgccccagacaagcctaaagagatgcttttttaatcaagcttttccacttgaccaaattcgagttcaacaggtgttgcacgaccaaagatcgaaaccgacactttcaagcggcttttctcgtaatccacctcttcaacggtaccgttgaagtcagcaaatggaccgtcgttaacacgcacgacttcacctgcttcaaacatggttttaggacgtggtgcttcgctggctttctcaagacgattcagaatcgcatccgcttccttatctgtgataggagctgggcgatctgatgtaccaccgatgaatcccatcacgcgaggtacgctacgtaccaagtgccaagattcatcattcatgatcatctgcactagcacataacctgggaagaatttacgttcacttttgcggcgttggccagcgcgcatttctaccacttcttctgttggtactaacacttcaccaaacagctcttccataccgtgcattttgatatgttcacgaagtgactgagcaacacgtccttcaaatcccgagaaggcttgaactacataccagcgttttttgggagcttcactcatgtattaaaccctctactatactccggtcgcaaaggccactagacgaaccataatgccgtcaataccccaaagcgccagagccattacaatacttactgctaaaacgatcagcgtggtttgcatagtttcttggcgtgttggccaaactactttgcgaacttccatgcgagattcgcgagcaaaaacgatcgcttctttgccttttgttgttgtcgcagcaacaccaagtgctgcagcaatcaacacaattacacctgcggcgcgagccaccacagacagttcaccatacaggtaattacccacaacagcggcaaccagcagaacaaaagtggctacccactttagagtgtctgctgcatttgagctatcaggagcttcagcgttgtttgctttcataaaccaacctgtcacatatctgacttctagacgacaacgaccccgctgttgcagggcaaatccattcggtcaacgcaatgcgctgattccatactaaagagcgagaaaatactctctcaatcccaaattttggctgcgtttgatcaagaaatcgacacattattgcgcagcgcagaaaaagggcatcaaatgatgccctttttagtagtgcttagtcaaataattaagcgatgatcttagctacaacaccagcacctacagtacggccaccttcacggatagcgaagcgtagaccttcgtccatcgcgattggtgcaatcaggtctacaaccatcttcacgttgtcgcctggcattaccatttctacgccctctggtagctcgatgctgcctgttacgtcagttgtacggaagtagaactgtggacggtaacctttgaagaatggagtatgacggccaccttcatcttttgacagtacgtatacttctgattcgaacttagtgtgtggtgtgattgaacctggcttcgccagtacttgaccacgctctacttcttcacgcttagtaccacgtagtagtgcacctacgttctcacctgcacgaccttcgtcaagcagcttacggaacatctctacacctgtacaggtcgtttttactgtctctttgataccaacgatcgctacttcgtcacccactttcaggatgccgcgctcgatacggccagttactactgtaccacgaccttggattgagaatacgtcttcgattggcatcaggaatgccatgtctactgcacgctctggctctggaatataagtatccagtgcttctgctagctcaacaatcttcgcttcccactgtgcttcgccgtttagcgcgcctagtgctgaaccttggattactggcaggtcatcacctgggaaatcgtactcagacagcagctcacgaacttccatctctaccagctctagaagctcttcatcgtcaaccatgtcacacttgttcatgaatacgatgatgtaaggaatacctacttggcgacccagcaggatgtgctcacgagtttgtggcattggaccgtcagttgccgctacaactaggataccgccgtccatctgtgctgcaccggtgatcatgttcttaacataatccgcgtgtcctggacagtctacgtgtgcgtagtgacggtttggagtatcgtactctacgtgagaagtattgattgtaataccacgctcacgctcttctggtgcgttgtcgattgacgcgaagtcacgagctttaccgccgtatacttttgcaagtacagtacagatagctgcagttagagttgttttaccgtggtcaacgtggccgatagtaccaacgtttacgtgcggtttcgtacgttcaaatttctctttagacatgagttgtccctctaggtacggatttaggtggcttttgagatgaccacgcaaccaaaaaatatcggtagtaaagtatatatcaaaaggaaaactttgcttagaggcttagagctggtgctgataggcagaatcgaactgccgacctcatccttaccaaggatgcgctctaccatctgagctatatcagcactctaaaatgagtggagcgggcagcgggaatcgaacccgcatcatcagcttggaaggctgaggtaatagccattatacgatgcccgcaacacgtaactctgagagctatttccttaagaatatggtggagggggacggattcgaaccatcgaaggcggagccggcagatttacagtctgctccctttggccactcgggaacccctccaaatttttgaccattttcactgctagtggagaaaatggtgccgactaccggaatcgaactggtgacctactgattacaagtcagttgctctacctactgagctaagtcggcataagtggtgcgcattctagtgaatgatcttgggggttgcaacccttatcttgaaaaaaaactcaattttcaaaggattttgcttgttcgttgttttttcagtcaaattagagcgcaatcgctaattctcgcatctttctattttgttttatcttgtgcttattgtattttcgctttccttattctcaaccgcatgattgaaccgattatgagcccttatttaacctttgatcgccaacactgggcccaattgcgcaattcagtacctatgacgctctctgaaagcgatctaaaagagttacagggcatcaatgaccatttatcgatgaccgaagcggttgaaatctatcttcccctcgctcgtctactgaatttgtatgtggctgcgcgtcaaagtcgtaatggtgtgttgcatcagtttttgggtaataccgaatcagcacccccttttgtgattggcatagcgggcagcgttgccgtcggtaaaagtacaacggctcgcttactgaaagctctcttatcacgttgggagaatcatccgaaggtcgaactgatcaccacagacggctttttataccccaataaggtactgactgaacgtggcattatgcataagaagggctttcctgaatcttatgatattcgccgtttggtggaatttgtttctgaggttaaagctggccagcccaatgtaaccgcccccgtttattcacatctcacttatgatattaccgatgaaatgaaagtggtcgaccgcccggatgtgctgatcattgaaggcttaaatgtactgcaaagtggtatggactaccctcatgacccacaccgcgtatttatctctgatttcctggatttttcgatttatgtcgatgccgatagtcaactgatagaaaagtggtatatcgagcgctttatgaaatttcgccagggtgcatttaaaaagcccggctcctatttcagccactacactgcactcactgaagcccaagctgaacagaaagcgcgttccatttgggaaaccatcaacggtaaaaatctggttgagaatatcttgccgaccaaaggtcgtgcacatttgattttacgcaaagggcttaaccatacggtagaagaagtcctgctccgtaaatagtgctcaagaaaaagaggctgacgcctctttatttggctttaattctgctctagtcgtttttacgtagggatatctcaccgccaataaaacttttcaacccctcttcggtttctaataatacgccgccgtgttcatcaatcccgcgctcaataccgcgcacctcattcgcccccatcagcagtttaactggacgaccgatgaagttatcccaacgattccaacgctcaacaaagttttgcatacctgaaatttcatactggcgtaaggtgcgatctagcgcagcaatcagattaatcgctaaagcattacgatcaatccggctttggccagtcacttctgcaagacttatccaaggctgatcgatattgccctcgttatcgcgcatagcaaggttgatccccatgccgatcactaaatgtgctgccgcaccagcttgaccagacatttcgactaaaatgcccgccaactttttatcttgataatagagatcgtttggccattttagtttaacgccatccactcccatggcttccagcgcttcaacaatggccacacccacgactaaactcagccccatcgcggctgccataccggcatctaaacgccaatagatcgagagataaagattagcgccaaatggagaaacccaatgccgaccacgccgaccacgaccactggcttgatattctgctaaacagaccgttcccgataccagcgtctcgacatgatcgagcagatattgattggtcgagccaataatcggatgcagctcgacaggattattcacttgcgattggattaccgattgatcgagcaacgtcatcgcttgagcaagttgataccctttaccctgtacacgaaacacatccacaccccagtcgcggatgccctgaatatgcttactgatggctgctcgcgagatccccagctgagcacccaacacttcaccagagtgaaaatcgccatcggctaattgtttgagtatggctagtttagcgctgtgctctttcatgcttgttcactcatccattgctttaaattggtttcttcactttcgccaataaatcgcacttcatgttcaagttcaatgccatagcagttgaacacgcgctgctgaatatcagccgccagcatgagtacatcttgcgcactcgcatcacccgtattaacgatcaccagagcttgtttagggtgaactttcgctcctccgatttggtgacctttcaaacccgcttgatcaatcaaccatccggccgctaccttgaccccttgttcagctggatatgccaccacatcgggatgctcaatttgcagtcgagcaaaggcttgctgactgatcacagggtttttaaagaaactgcccgcattccccatcacagcaggatcaggcagtttttccattcgcgtagcgcaaactctctgatacacatcatgaatagcacagtccgaggacaaatcttttagtgggccgtattggataatcggctgccaagctttagcgaattttaaccctaccgcagtcacaactgctttttgataaagctgatgtttgaaaatggagtcacggtacccaaattggcactcttccatcgtcaaacgcttcactgtgccagtctctaggcataagtactcgacgtaatcacaaacatctttaaactcaacgccatacgcgccaatattttggattggtgcagagccagcacagccagggatcaaagcaagattctctaaaccgccgatcccctgctccacacaccaacttacgagtgaaggccaatcttcaccaccggccacatgcagccgatggtaatcatcatcttgttgatgctctataccattgaggcggttaaccactatcatacctgtatagtgacaagtaaaaagcatattactgcctttgcctataataagcttaggtaggctagcccattcagctgagcaatagagcgccttaagatcgtcaatcgattccgccacgaccaattgagcagctaactgttcaataccaaaggtgtggtagggtttgaggttcgcaccgagttgaatttgcatggtcgtctttggataacttaaactggccatattctacctcagatggccgacaagcacgaaagaccaatgttagagtttcagcaatttgcccccattaagctcccgcttatcaaacgtttttataaaaaccactatccagggagcaaacccaaaagtgatgaacaggtgattgttgctctcaaggatcgtgagatcgtgggcgtggtacgttttcgtatgattggtcaatatcgcctactgactggcatggcagtggaagcccagagccgtcaacaagggattggtaagcaactgctcgactactgccaaaagcaatggctcaatccagcaaccttttgttttgcttatacccatctcgaacatttctatcagcaaggccattttattcaaattgcacctcatgctttacccgccgagctccatctactctttgagcgttactcgagatctggtaaggatctcattccgatgcaatatcaagcgaagtaatgtcaagaatggtcgccatttctagccttttcttaaccagttttggtaatatccactgctcgcaattttgcacacaacaaggtaatgcatcccaatgattgctcgaagaaacccaatcgaacaactaccagcgattgcgcaagatcctgacaaatttggcgtactgctctcggctgcagaatttcgaactcatttggttgaatcgattcgtcaggcacgcaaacgtatctacctcgttgcactttatttagaaaatgacgatgctggccgtgaaattcttactgaactctatgccgccaagcagcgtaacccaggactcgaaatacatatttgtgttgactggcaccgtgctcagcgtggcttgatcggtgcagcagaatccgaaggcaatgcagccatgtatcgtgactttgctcagcaacatgagcactgtattcctgtttatggcataccggttagagggcgggaagtctttggcgttctgcatctaaaaggcttcattattgatgatcaagtcatctacagcggtgcgagcctcaataatgtctatctccagtttcatggccgctatcgttttgatcgctaccataccttagaaaatgctgaacttgccgacagcatggtgcattttatccaacaagaaatgctggctcacccggctgtcaataacctcgcttgtggtagcaaacccaccacaaaagagattaagtctgatatccgccaattccgagcttcacttgctcaagccaattaccaatttgctaaacagaaagtgaatgaaggtcaagtcgctgtcacacccttggttggactcggtcgacgcagaaatcggttgaaccaaagcattatccaattgttagcctctgctaaagatgaagtgtttatctgcacgccatactttaatttcccgccgagtatcgctaaagaggtgaaaaaagcactgcgacgtggcgtgaaagtccatattgtgattggcgataaaaccgcgaatgacttctacattgcaccagaagagccattcaagactatcggtggcttaccttacttgtatgaacttaatctgcgccgctttgcgaaagccaatgaagctcatattgcaagccgcaagctctcaatccacctctggaagcatgaaaatcacagctttcatctcaagggaatttgggtggataaacgttatatgctcatcacaggtaataacctcaatccacgcgcttggaagctcgacctcgaaaatgcaattttaattcgtgatgattaccatcaccttactaccaaatttgaagctgaaattgacaatattctgcagcatactcagttaatctgtacttataagcaaattgaaaaacccgagcactacccagaaaaggtacaacgcttagtacgccgaatcatgcgtctaaaagccgatcgtgtcctcaaacaaatcttataatcaacgcttacactaccagccgatgcattcgcatcggcttttttattgctcaatatagccatccgaaacgactatgcactgacagaagctttattgaaaaattccgatggataaacgcaaaaagacaaagacaaaaagagcagtaagaagagttggacagtttgggatgattgaacatcatagaggatgagcactgggataggcgataagcagtaattacctctggctttcaatgatttccagaaagcaaaaaacccagtcctaagactgggtttcgtaataagtggcggagcggacgggactcgaacccgcgacccccggcgtgacaggccggtattctaaccgactgaactaccgctccgctgtctggttagaccaaattaaaagcctggcgatgttctactctcacatggggagaccccacactaccatcgacgctgtttcgtttcacttctgagttcgggatggaatcaggtgggtccaaaacgctatggtcgccaagcaaattctgtttttgatttcactttttcttaaaaagtgataaccaacaattctggaaagctgtcttcgttctcacacacattcttatgcgcttagctttgagtccactacaaaaccccttgggtgttgtatggttaagcctcacgggcaattagtacaggttagctcaacgcctcacaacgcttacacaccctgcctatcaacgttctagtctcgaacaaccctttaggacagttaaactgtcagggaagactcatctcagggctcgcttcgcgcttagatgctttcagcgcttatcaattccgaacttagctaccgggcaatgcgtctggcgacacaacccgaacaccagaggttcgtccactccggtcctctcgtactaggagcagcccccttcaatcttccaacgcccacggcagatagggaccgaactgtctcacgacgttctaaacccagctcgcgtaccactttaaatggcgaacagccatacccttgggaccgacttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactatgacctgctttcgcacctgctcgaaccgtcattctcgcagttaagcgggcttatgccattgcactaacctcacgatgtccaaccgtgattagcccaccttcgtgctcctccgttactctttgggaggagaccgccccagtcaaactacccaccaggcactgtcctcaacccagataatgggtctaagttagaacatcaaacatacaagggtggtatttcaaggacggctccaacgcaactggcgtcacgtcttcatagcctcccacctatcctacacatgtaggttcaatgttcagtgccaagctgtagtaaaggttcacggggtctttccgtctagccgcgggtacactgcatcttcacagcgatttcaatttcactgagtctcgggtggagacagcgtggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtcatcttgcgattttgcacagtgctgtgtttttaataaacagttgcagccacctggtatctgcgactctcgtcagctccatccgcgagggacttcaccatcaagagcgtaccttctcccgaagttacggtaccattttgcctagttccttcacccgagttctctcaagcgccttggtattctctacccgaccacctgtgtcggtttggggtacgattcctgactatctgaagcttagaggcttttcctggaagcatggcatcaatgacttcactaccgtagtagctcgacgtcgtgtctcagccttagagagagccggatttacctaactctcaagcctacgcacttgaaccaggacaaccgtcgcctggcccacctagccttctccgtccccccatcgcaatagtcagaagtacgggaatattaacccgtttcccatcgattacgcctttcggcctcaccttaggggtcgactcaccctgccccgattaacgttggacaggaacccttggtcttccggcgaggaggtttttcaccccctttgtcgttactcatgtcagcattcgcacttctgatacctccagcaaaccttacgattcaccttcaacggcttacagaacgctcccctacccaatgtctaaaagacattgccgcagcttcggtgtattgcttagccccgttacatcttccgcgcaggccgactcgactagtgagctattacgctttctttaaatgatggctgcttctaagccaacatcctagctgtctgagccttcccacatcgtttcccacttagcaatactttgggaccttagctggcggtctgggttgtttccctctccacgacggacgttagcacccgccgtgtgtctcccggatagtacttactggtattcggagtttgcaaagggttggtaagtcgggatgaccccctagccttaacagtgctctacccccagtagtattcgtccgaggcgctacctaaatagctttcggggagaaccagctatctccgagtttgattggcctttcacccctagccacaagtcatccgctaatttttcaacattagtcggttcggtcctccagttgatgttactcaaccttcaacctgcccatggctagatcacccggtttcgggtctatatccagagactgagcgcccagttaagactcgctttcgctacggctcccctatacggttaaccttgccactgaatataagtcgctgacccattatacaaaaggtacgcagtcacaccacgaaggtgctcctactgcttgtacgtacacggtttcaggttctatttcactcccctcacaggggttcttttcgcctttccctcacggtactggttcactatcggtcagtcaggagtatttagccttggaggatggtcccccatattcagacaggatatcacgtgtcccgccctactcgatttcacgctcgatgaagcgtcggttacggggctatcaccctgtatcgccaagctttccagcttgttcacctacttcaccgagtgcttaagggctaatccaggttcgctcgccgctactaccggaatctcggttgatttcttctcctcggggtacttagatgtttcagttcccccggtttgctctgttaacctatgtattcagttaacagtaactgcttatgcagttgggtttccccattcggaaatcgcagactcaaacggctcttactgccttatctgcgcttatcgcaagttagtacgtccttcatcgcctctgactgcccaggcatccaccgtgtacgcttagtcacttaaccatacaacccgaaggagtttcgggttgtgtttaaacaacctaagttgtctcgcgtttaatttacatgagtgcgagacagattttgccggactcaaatttgaacaagaccgaagtcttattcgataccaagcacacttgaatgtgttgttggtgtttatctttcgataaacattgagaactttacaaacaacaataaattgttgttttgtcagctttccaaattgttaaagagcaagattttctgatgaaaaccatttttaaacattctcagcgaaaacgcttaaagatggtggagttatgcgggatcgaaccgcagacctcctgcgtgcaaggcaggcgctctcccagctgagctataaccccatcgttagtggtgggtctgagtggactcgaaccaccgaccttacgcttatcaggcgtacgctctaaccacctgagctacagacccacttgatgctcaaatctaaaccgaatcaatctgtgtggacactcatcacgataatcatcgtgtaaggaggtgatccagcgccaggttcccctagcgctaccttgttacgacttcaccccagtcatgaaccacaaagtggcaagcgtcctcccgaaggttaaactacctgcttcttttgcagcccactcccatggtgtgacgggcggtgtgtacaaggcccgggaacgtattcaccgcaacattctgatttgcgattactagcgattccgacttcatggagtcgagttgcagactccaatccggactacgacgtactttgtgagattcgctccacctcgcggtatcgctgccctctgtatacgccattgtagcacgtgtgtagccctactcgtaagggccatgatgacttgacgtcgtccccaccttcctccggtttatcaccggcagtctccctggagttcccaccattacgtgctggcaaacaaggataagggttgcgctcgttgcgggacttaacccaacatttcacaacacgagctgacgacagccatgcagcacctgtctcagagctcccgaaggcactccagcgtctccgctagattctctggatgtcaagagtaggtaaggttcttcgcgttgcatcgaattaaaccacatgctccaccgcttgtgcgggcccccgtcaattcatttgagttttaatcttgcgaccgtactccccaggcggtctacttaacgcgttagctccgaaagccacacctctagggcacaacctccaagtagacatcgtttacggcgtggactaccagggtatctaatcctgtttgctccccacgctttcgcatctgagtgtcagtatctgtccagggggccgccttcgccaccggtattccttcagatctctacgcatttcaccgctacacctgaaattctacccccctctacagtactctagcttgtcagtttcaaatgcgattcctaggttgagcccagggctttcacatctgacttaacaaaccacctgcatgcgctttacgcccagtaattccgattaacgcttgcaccctccgtattaccgcggctgctggcacggagttagccggtgcttcttctgtaggtaacgtcaaatgattaaggtattagcttaaccaccttcctccctactgaaagtactttacaacccgaaggccttcttcatacacgcggcatggctgcatcaggcttgcgcccattgtgcaatattccccactgctgcctcccgtaggagtctggaccgtgtctcagttccagtgtggctgatcatcctctcagaccagctagggatcgtcgccttggtgagcccttacctcaccaactagctaatcccacctgggcatatccggtagcgcaaggcccgaaggtcccctgctttgctcttgcgaggttatgcggtattagccatcgtttccaatggttatccccctctaccgggcaatttcccaggcattactcacccgtccgccgctcgccacccaaggaacaagttcctctgtgctgccgctcgacttgcatgtgttaggcctgccgccagcgttcaatctgagccatgatcaaactcttcaattaaaagttttttgaagctttcgcttcggctcaatgaatactgattacattctttgcttaataaaaagcgaagtaatgttgaattgactgtgctgaatgattgctcattcaaatggtcactcagttcattgataaatcttttttgattatcatcaacgagtgcccacacagattgattggtttatattgttaaagagcgctcttcttggcgatctgcttcagaagaggcggccattttagcgagaatcgatttcgtgtcaaacacttttttcaattttcttttctggcctgttgaggcatcgatttggctgtgagcccttgctgcgtcaacgagggcgcattatagagatccgcttcacactggcaagtgttttttgagaagatttatagaaatagcgcttaatcgctgcatttgcgcgcaagggcttatttatcccactttactcagagtttgatgacaacttatccacagagttattctttttaagcttttgctctagtctatctataaagagaaagtcataaaaaagcccaacgatttagcgttgggctttgtcttgtatcttgtttatagctgcgcgttaaataaaggcgtaagcatcggcaaacattcgatcgcgtcgagcttgtttgttttgagtaaattgctcacgtgcggctccagccatctcaaagcgacctgctatatagatgtcaaatgcttctaaacttgcaaagtcgttgttaatcgcttgcagtacattgccaacttttccagcccagtcatcttgtgcttgctcgaccactggaacaacctgcaaatgagcatgttgcttggcaagctcttgcaactcattcagtgcgtacagctgagctgcatcacgcgcgccccaatacaggtagataggctgagttttaccttgcgagaggcaatgatctaagatggaacgcacatagctaaagccggtcccgccagcgattaagagtagaggtcgctcactctcttgtaatgcggcattgccatgtggcacatctacttcaacccatgtctgattaagatgggcttgctgaaatttttccacgacttggtgggcaaaggcgctgtgatccgccgcaccaatatgcagttcgagctcgccattgctacggcaaggactactggcaagtgaaaatggtcgcttatctttttcgcccatcaccaccattaaatactgcccggcttggtaagccaccgcgtgctcgggttgtaataggatttggtaagtatgcgtcgccagcggctgcacagacttaacttggcattgaattatcattgaacttcctctggcttactcttcaaaagtcagcactaaatcagtaattgcgcaggcttggcaggcaaatatccaccctgtcgctttttcttgttcggtcaataacggttcgagttcatactccacctcaccttcaaccaacttacataagcaagcggcacaggcgccgattcggcagcggtggggaaaggctatttgctggttgagcgcagcatcaagcaccgtttcacctgagtgaattataaattgtctatcattaggcacgatgcggacggtataggtcatacaatgcctaactcatcccataacgaatcgattttcgcgactagcttaggatcttttcggatcggagtaccccattcacgttcgacttcgtcaggcagtttattggttgcatcaaagcagatcaaatcttggccaacgattcgtaagctatcacgtgccggatccatgcgtgtggtcattgcccagatcacatcattccagtcatggatattcacgtcatcatcgcacaagatcacaaacttaagcggcgagtcaccattgagtttatcgactacacgctgtaacagttgctgtgcctgccctgcttcctgcttattaataagtagaagaaccaacttatcattcgccgcctccggtaatgcaacatccaacacatccgcttcatcactcaagcaggcttttagcgcttccagtgaaagttccgttgtcttgtcactctggtcagaattagaaaccgccagctctgcaggccatttggcggtggcatccaaaccgatttttgagcctaaacccaccactggtgaagcaaaatccagcgagtcaatcggcgtatgctcaataaatagagtatcgcgcagaggcgacatgtgattgaccatagcggcaatcacttgtggccaatcgcgcgcattcacttgttcatcacacacaatcacaaacttggtgtacataaattgacgtaggaatgaccacacacccagcatcacccgcttagcgtgtcccggatactgtttcttaagtgtcactatcgccatgcgatacgagcagccttctggcggcagataaaaatcggcaatttcaggaaactgcttttgcaagataggtacgaagacttcgttaagcgccacaccaagcacggcgggttcatcgggcggacgccctgtataggtgctgtgataaatcggcttattacgcatggtcacatgagtgacagtgaacacatgatggcgctcaacctcgttgtaataacccgtgtggtcaccataaggaccttcatctgcaaattcgttaggatcgatatagccttcgagcacgatttcagcacttgcgggcacttccagatcgttactgatcgacttgaccacttcagtacgactgccacgcaacagtccagcaaacgcgtattcagataaggtatctgggacgggtgttactgcaccgagaatggtcgccggatcggcaccaaacgccacgctgacaggaaaaggctctccgggatgtttttccatccaatcccgcaagtctaatgcccctccgcgatgggctaaccaacgcatgatgactttattacgggcgattttttgctgacgatagatcccaaggttttggcgctttttatgtgggccacgcgtaatggttaaaccccaagttaaaagtggtgcaacatcgtccggccagcagctcatcacagggattttatcgagatcaaccgcatcaccctgccacacgatttcttggcaaggagcacgacgcaagcgcttaactggcatattgagcacttgtttaaaaacgggcagcttttcaatcagctcttttaaaccacgaggcggttctggctctttaagataagccaaccactgaccgacatcacgcagctcttgaacctgctgtcgccccatgcccatagcaacgcgttctggcgtaccaaacaaattggttagcactggaaagtcgtaacctagcggattttcaaacaacaacgctgggcctttagcacgtaacgtccggtcgctgatctcggtcatttcataatgcggatcaatcggatgggtaatacgttttagctcaccacgttgctctaaatagtcaagaaaatcccgtaagtccttaaaattcataggtctactactcgttgacagcgatagcggcagtataacaaacctcaagattgttctgcgccattttcttacatttgttggttatggattcagtaccgctaaaatcgcttgctgtttcaccgctcgattcgagctgactaactcatgcaaccatccttgataacccgattgagcaagcatactcgcaacctgagaggcattttcactttgtcctagtttctcaattaagaattgctcaacctccatcgacatagggcgtatttcaatcaatgcttgcagtgcctcttgcttaaggctgggattttcgacagcaagcattaattgctgtttagcaaaaccatcggcttgcgcccctaaacgagcaacctcttgcctaatttcatcattagccttcattaaccaaagcctttgatacaaggcatggctttgactacgccgcgcaaattgcaccatcaccgttgccgagggcagccaactcgtcacctgctcagtagtaatttgggcaatcaaacgctccatggcttgcggtgataaacgatgcaactctgtgagtaataagcgctgacgaacatctactgattgagccgaagaaccagaaatccactcacgcagattgagttcgccattttctgcttgtaacacaaacatcatgatatcttgttgctgctgtgcttgttttaacagtcgatgggcgatagcggcataatcaaaagcggggacagagaactcataaccgtcgccccgttcagcaatcaaataattgggtgtctgtgatttttgagcagcaatgaatacggcaagctcctccgttaagatcaactggccttgttcaaatttttgcaatagaagaaaacgcacgacttcttgtgcgggataactgatacgctgcaaattgaactgtaagcgatctacttcattgtgcagtgcgagcagataaagctcttcggctttctgttgggtctgtggctccgcaagccaaagctcacgctctgttgccgtgatatcaccaccaagcgcgtaaggcggcaaacctaacaaaaagagaagaacgaggcacaaccatccttgttgcatatactcctccttgttcgttctacatcagtgtggacaccactggtctagaacgcaaacaaaaacaccaccgcaagggtggtgtttgagataacgttcaattactgtcgacgcatcgcgtcaaagaactcatcgttggttttggtcatggctaacttatcaatcaggaattccatcgcatcggtttcgcccattgggtgaacgatcttgcgtagaatccacatcttttgtagctcatcggtcttagtcagtaactcttcacgacgcgtacctgaacggttgaagtcgatagctgggaaaacacgtttttcagcaatcttacggttcaagtgcagttccatgttacctgtacctttgaactcttcataaatcacttcatccatcttagaaccggtatcaaccagtgcagtagcgatgatggtcaagctaccaccttcttctacattacgtgccgcaccaaagaaacgcttaggacgatgcaatgcgttcgcatccacaccaccggtcagtactttacctgatgcaggaaccacagtgttgtaggcacgcgctagacgagtaattgaatccagtaggatcaccacgtctttcttgtgttcaaccagacgtttggctttttcaatcaccatttctgccacttgtacgtggcgcgatgctggctcatcaaaggttgaagcaaccacttcaccttttactaggcgctgcatctcagtcacttcttctggacgctcgtcaatcagcagtaccatcagcacacactcagggtgattgctggcgatgctttgagcgatgttttgtagcagcatggttttacccgcttttggcggagcaacgatcaaaccacgttgacctttaccaatcggtgctgccaaatcgagaacacgcgccgtgatgtcttctgtggagccattgccacgttccatcaccatacgttcattggcgtgtagaggagttaagttctcgaaaaggattttgttgcgggcgttgtctggacggtcatcgtttacagtgttcactttgagcaatgcaaagtaacgttcaccctctttcggcggacgaattttcccggcaattgagtcgcctgtacgtaggttaaagcgacgaatttggctaggtgacacatagatgtcgtcagggccagcaaggtatgaactgtctgcactacgtaagaaaccaaaaccgtcttgaagaatttccagaaccccatcgccaaaaatgtcttcaccactttttgcgtgtgctttgaggattgcgaaaataatgtcttgtttgcgtaggcgtgccaggttttcaaggcccagactttcgccaagcttaaccagatcagacacaggggtgttcttcagttctgttagattcattgtggtggatacttagttagtcaaaaaggatcgttgttaagttaagatggatatggtctcaggattgaccaagaagtgaacaactgtttaattaacgtgcgataaactagcactaaatattagcctagtctagaaattgttttttgccaaaaacaaaaccgtacatattgctatgtacggcttggcggtctgactcattacaggttcgcgtctaggaactctttcagttgagtctttgatagcgcaccaactttagtcgctaccacactgccatctttaaacagcagcagtgttgggatgccgcggataccaaacttaggtggtgttcccgcgttatggtcaatattcagtttaccgatagtgagtttgcctgcgtattcgtcagccacttcatctaggatcggggcaatcatcttacaaggaccacaccactccgcccaaaagtcaactagaaccgggcctgcagctttgattacatcgttctcgaaaccgtcatcggtcagctgcaaaattttgtcactcatctttcactccaatgtgattttctgcactggtgataactcaaccagtaaatagatgctctattggaatgtatttacttccgtattgcaagcgtaagctgatattctatagccatgaaaaagacgcatatcacagagcataagttcgccgactttggtttacagccacaagttattgatggactggaaaaaaaggggtttgtttactgcacccctatccaagcattggcgttgccggtactgctctccggccaagacatcgcaggccaggcccaaacagggactggtaaaacgctcgcgtttcttactgctaccttcaaccatttattgaccacaccagccgctgaaggccgagcagaaactcagccacgcgccattattatggccccgactcgcgaactggcaattcagatctttaatgatgccgagcctttgttggcctccactggtctgaaagcagctttggcttatggtggcgaaagctatgataagcaactcgcaaaattgcaaagtggcgtcgatattctgatcgggaccaccggccgcattatcgatttctacaaacagcgtgtattcaacctcaatcacattcaagcagtggtactggatgaagcagatcgcatgtttgatctcggctttattaaagacattcgtttcttgttccgccgtatgcctgagcccaaagatcgtctcaacatgctgttctctgccaccctctcttaccgcgtgcaagagctggcttttgaacacatgaacaatcctgaacatgtggtggtagaacctgagcaaaaaaccggtcatcgcattcaggaagagctgttctacccatcgaacgaacacaagatggcgctgctacagactcttatcgaagaagagtggccagatcgcgcaatcatttttgctaacactaagcaccgctgtgaacagatttgggcacatttggcggccgataaccaccgtgttggcctactgactggtgatgtaccgcagaaaaaacgtgagcgtattttagagcagttcacccaaggtgatgtggacattctggttgcgaccgacgttgcggcgcgcggcttgcacattcctcaagtgacccacgtgtttaactacgatttgcctgacgattgtgaagactatgtacaccgtattggccgtacgggtcgtgcgggcgcaagtggccactcgataagctttgcgtgtgaagagtacgcgattaatttgccggcgatcgaaagctacattgagcatgcgattccaacctcagactacgatccttcagctctgctgacggacttacctgcgcctctgagcctacgttcgtcgccacaacagcgccgcaccaataccgcaggttctcgcaatagcaataatggtggcaatcgcaaacctcagcaacgccgcccacgcgcaccacgcccgaaaaaggaagcctgatttcgctatgagccaagccgtttcttcacccttgtatgctgccattgatttaggttccaacagttttcacatgttggtcgtgcgtcatatcgatggcagtgtgcagacaatggcaaaaatcaaacgtaaggtgcgtctggcagccggtctagatgaacacaacgccttgagcttagatgcgatgcaaagagggtgggattgtctcagcctttttgccgagcgactgcaagatattcccgcagagaatatccgaattgtagggaccgcaaccctgcgtaccgccaccaatgccggtgaatttatcgctaaagcgaaccagattttaggccatccgatcgacgttatttccggtgaagaagaagcggccactatctataaaggagtcgcgcacacttcgggaggtttagggcgtcgcttagtagtggatattggtggtgcgagtaccgagctgattatcggtgaaggttttgaagccaaagccctcaccagcttgaaaatgggttgtgtgacttggttagagcgccatttcaaagatcgtcagctgacggccaccaactttaataacgccattttagccgccaaacagatgctggatccgatcctcactcaatacactgagcttggctggaatgtgtgtgttggagccagtggtacggtacaagcactgcaagagatcatgctggcgcaaggcatggatgaagtcattacgctgaccaaactcaagcgtttacaaaagcaagccatgctggccgatcatctcgaagagctggatatcgaagggttaacgctggaacgtgctctggttttcccaagtggcctatcgattctgattgcgatttttgaatcactgaacatcgaagcgatgacgctagcgggcggtgctctgcgtgaaggtctcgtctatgagatggttcaagacctacgccaagaagatattcgagcgcgcaccattcgctgtgtacaaacccgttatcagatcgatagcgcttatggtgatcaagtcgccactctcgccagtaaactgctcgcgcaatgtggcggtgaagcgtggatcaatgaaccacaagcagagatgttgctgcgtacggcagctaagttgcatgaaattggtctcaccatcgatttcaaaaaagggggggagcacagcgcttacctactccaacatcttgatctgcccggttatacccgcgcccaaaaacattatttaggtgaaatcgtacgtcgctatcgcgaacagttaacttcgttacctgaacaatatgcactgtcaggcaccagtggtaaacgcgtactgcgtttgctgcgccttgctgtcctcttaagccatcgacgcagcccggcgttagagccgatggtagaattgagcgcacaagaggacaagctgacgctcacgcttgacggtgaatggctggcaaaaaatccactgactcgtacagagttagagttagaagccaaccgtcaaaccgatattggctggcctctgtcgattgaatgccactaagcactcataagtattaagccctcatctgagggcttaatacttactgtaccttcaatattcctaaacgacttgaagttgcaagtaggcagcgtatagacggttgttttgaacagaccatcggctcaagacagactattcagtaaggctctcagtttgaggggcttaatgggtttagccataaagcgaaaaccgcttgattcaatcccatccaagatatcgggattgcgatcggcactgatgatcacgccagcgaaacaatcccccaaacgcaagcggcactgctgcagcacttcaagccctgtccgtccgttatccaagcggtaatcagacaaaatcacatcggggatccattgcccttccaaggctttgaggctgccatgaatatcggtcgcggttttgacttcacacccccaacgctccagcaaatcacgcatcccaaccaaaatatctggctcgttatcgacacacagcacacgcagatgttgcagctctgaacctttctcattgaccatcgcaaccgtctgagtgagtgacgacggcatgggttgagcgcgatctaaagtaatcgagaaaacactgccctgccccggccaagagcgcatcgaaatgtgatgacccagtacatgggcaatccctttcgaaatcgccagcccaagccctagaccttggtcggagcgtacctgcccaccgcggttaaactcctcaaaaatttcctgctgcttatcttgctcaataccaatcccattatcccacacatcaatacgcacttgcccggtggcgactctgcgcaccccgagaatcactttgccgttcgggttataacgaaacgcattagtcaggaaattttggattactcggcgcagcaatttgggatctgaatgcacccaaagtaatgatggcactaggctaaattgcacaccttgtttagcggcgagggcactgaactcggcattgagattcgacaatacatccataatcgcaaaactgtgcggatgcagatcgattttgccggactccaaacgcgaaatatccagcaaatcgctgatcaaatcctccgccgcgcccaaagcactttcaatatggtgggcaagtttctgcacctccgcctctttagccacttcagataaagatgaggcaaacaggcgtgcggcattcaatggctgcatcaaatcatggctgaccgccgccaaaaagcgcgatttggattgcgactcgcgctccgaacgctgggtcgcggtgactaactgtttattgagcttttctagctccaaggtacgctgcagtacacgctcttctagcgtttcgttggccattttcaggctttgttccgcttctctaaacaccgtaatgtcagtaaagctcatcacaaatccaccgccgggcatcgggttcccctgcacctcaatcactcgcccatccgcccgcactcgcgaggaggtatgacttgtcccttgctctaagtggtagacccgtcgccgtacgtgatcttctggatcgcccggcccacataaaccttgctgcgcgttatggcggatcacatccgcaatcggccgtcccacttgaatcaatcccggcggaaactcaaacagctcaagatagcgctggttccatgccactaaacgtaactgtttatccaccacggcaataccttggccgatgtgttcaatcgccccttgcaacaagccgcggctgaaatcgtacagctcggacgcctcatcgactatggtcgccacttcctcaagctgcattttacgtccttgcagcgccgaggtgagcaccaacttagcggacgaagcaccaaataccccagccagtacgcgttcggtatggcggatcaaggcggaagaggcttgctgattcggtagcaaggtttcacgctgctgactccagtattgagcaaaggcgttgcgtacccgagtccgccccacaaaacgtgaggccaacatttcaagctcacccacagtcacgcgactttggtaaaggctcatgttttcgttttcgggcagcggagtaccgacaaacgccgcggcttgcaaacgctcacttaagctggcgcgcgtcaccaaagacacaccgatatagcacaaggtattaagggtcacgctcagtagcatgccccaatccgcactttttaaccctagagccaccaaccaatctggtggagtgatcacccacagcaagacgttattgctggcatcgcccgccagcatatcggtggcactcatcaaggtgataagccacagggtaaaaccgaccgctaaaccaacataaacccctttacgattgccttctcgccagtacataccgccaaaaatcgcaggggcaaactgggtaatcgctgaaaacgatagaaacccaatcgccgataacgaaggaatgctgtcgagtaccagataaaaaccccatgcaccgaacagcaaaagtaggattaaggtgcggcggatcaccaccaacaaaccggaaaaatgtcgatgagtgcgctgcgacaagcgcatccggcgtagtagtaaaggcatcactaaatcattggataccatgatcgcaagggcaatggtcgagacaatcaccatccccgaagctgccgatgttccgcccaaaaaagccaacaatgctatatcgtgagccccagcaaacacaggtaggctaatcacaaacgtatcgggtgaggtgtttggcagtaaaccttgtcccgtccaagcaatcggcaacacaaacaggctcattaagagaagataaacgggaaagagccagcgcgcggtgtgcagatcttgcgggcgctcgttttcaacgaccatggtatgaaactggcgcggcagacacacaatcgcaatcatggtcagcaaggtatgaatcaataaggtcggccagtttggggcttggtaagtgctggccgcaattgttgaaagctctaatccatcggtacgccacgccagatacgcgataaataccccaacgcagagaaaggccaccaatttgacgatcgattcaaacgcaatcgccatcatcattccgcggtgatgctcggtattatcaatatgccgagtgccaaacagcatggtaaacagagccagcgccaataccacaaaccaagatacatgcgattcttggtagccgtacactgtcattaaatcgggagcgacaatgttcaatcccatcgtaatgccgcgcagttgtagcgcgatatacggcaaaatacccaagaccgcgatcaccgtcaccgccacggccaaaccctgcgatttaccataacgggcggcaataaaatcggcgagcgaagtaatgtgctcacgtttagcaatcaaaatcagccgcgctaaaactcgccaaccaaacacaaacatcaagatcggggcgatatagataggcagaaacgaccaaggattgacactcgcctgcccgactgtgccgtaaaacgtccacgaggtacagtaaaccgcaatcgacaagctatagatccacggccgccaattggcgagccaacgagtttgcctgtcaccataccacgcaatcaaaaacagcacgccgagatacgcgagcgaaacgggaattaccaaccaaccttgcatcagacatccttgctgttgcgaaatgaaaaaagcctctcgattgagaggcttctattaaaacgaggttgttttttgaactcaatcagcacgacttaattctgtgcttcaggctccgctttcagtgcattgccatcttgtaccgttgaaggcggagtatcaacgcggatcaataatgccaatccgcccattgcggccatcgcccagaatacggctgcgccccaatgctcatagccccaaccactgagagtggtcaccgccgcaatcaccgcgccgagtggaatcgcgttatacagagcttgcagtgccaccattttattttgcggcgcatgctggatgtactgaatcgcggcgatgtgcgcgatagcaaacgtgaccccatgcagcagttgaatcgccactaaggccagaatggtggtcgtggaggcggttaaaccccaacgtgcaataacccccaacgacgctacgaagaatagtgtgcgcaaactccagcccgcgaaccagcgcttactgaaagcaaacaccaagacttccgcgaccacacctaagctccataagtaaccgatgatatcttctgagtgacccgcttgtttccaataaatcgagccgaaactgtaatacgccgcatgactgccttggattaaggccaccagcagcagaaatttcaccacaggccactcggtaagaagctccttcagcttcgggcgcaccgcatgagcctcgtgctcagtgactggcatcggtgtaatttggcgcaaactcaacagccaagagacggcgacccccaccagcgccgtgtacaaaatcatcaagctgccccacttggcgaccaagaatccgaccacagtcgatccggcaataaacgcgatcgacccccacaaacgagtacggccatagtcgagcattttcagcttggcgtagtagttggccatggcatcagaaatcggcaccacagggccacagcataagttaaacagcacagtggccagcgccatcagccaaaaactgccgcccgtaaaaaagtgaaaaccgacaaacagcattgccgcgaaactgagccaacgcagcgcgggcatcagttgctcaacacggtgtaaacgcggcgtcagcaccaaattcgctacacagcgcgtcgcaaagcctatcccaaccaagacacctatgtcggtcgctgaaacgccttggtcttcaaaccagagtgaccaaaatggcaaatacacgccgtaagcaaagaaaaaaccgatgaaatattgcgaaatccaaccatagggagtgggggtaaacatgatcgttcctaatcaaaaagggaggtataaagcgcgcacattatgcatgtggattcgcgtctaaaaaagggaagattacgcaactcatcgtttcccgattgcttatatcaacagattcaccgtcaagttaccggtgccaatcggcggatcatcgcagcgtagaaaagcctttgttgcctgcattagaccaaagtcgtctggaggggcaggggaaatttgtcacacttagtgaacctgtcccgatgatgagtgccacctcatgcctgataaattcaatatgcagtcaccaccgtttaatcgactgacggctgagcagcaacatcaattgcgcagtgctttggatgtcgcctatttccgccaacgcgatgtgttgattgatgcgcagcaccctgtgactcatctgcatattctgatcaaaggcacggtagaggaacgcagccccgacggcaaagaggtgtttgcacactacgccaatgatgatctgtttgatgtacgcgccatgtttgaagaactgagcaaacatcaatatatggcgctcgaagacaccctctcctacttgctgcccaaatcgatttttttgcagctgtacgagcaaaatggcgagttcgccgcctatttcgataataacctcgccaaacggcaagagttgattgaagccgcggctcagcagaaaaacattgccgaattcattctgaccaaagtcgaccgttccatttatcacccgccttttattctgtcgccggagcagccgatccacagcgtcacacaacaactcaaagagcgcgggattgatgcggctttagtcgaactccatcccagcgacccaagattggcgcacaaccacgctcacccttatgcgattgtaacgcgaaccaatatgctgcatgcagtgatgcttgaaggccgccctttggatacgcccgtcggcgagattgccacttttccggtattgcacgtggatgagggtgacttcttgttcaatgccatggtgatgatgacgcgccaacgcatcaagcgagtcatggtgtgcctgggcaatcaagccgtgggtttactgtcgctgattcaaatactgagcgccttctctactcactctcatgttttgacactggcgattgcgcgtgcagcctcgattgatgaactggcacttgccgccaacaaacagcgcgaactggtcgaaagcctgatgtcacgaggggttcgcacccgttttgtgatggaactgattgccgcagtcaatgagcagatcatcgagaaagcctttgagttagtggttcctccagcgttgcacgatcagtgctgcctagtagtgctcggctcggaaggacgtggcgagcagatcctcaaaaccgatcaagacaacgcgctcatcattcaagatggtttggaatggcaccagtgccagcccatcatggagacgctcacccataccctgctgcagctcggctatcccctgtgtcccggcaaagtgatggtcaataacccgaaatgggtgcgcagccagagcgattggaaacgcactctgactgattgggtaaaagccgctcgccccgaacaagtgatggatattgccatttttgctgacgcgcatgcggtggcaggaaatcgtgcgctgcttgcgcctgtgaaagcgcatttgcagcacttgatggccggtcaagagctcatcttggcggaatttactcgcccagcactcaatttttccgtaccgctgaccctgtttggtaacgtaaaaagcagcaagcaagggattgatataaagcaaggcgggattttccctatcgtacacggcgtgcgcgctttaagtttggagcacgcgattgatgccaataacacctttgatcggattgaagctttagtcaaaaaacgagttttagaacaagagactggcgataacttaagtgaagcctttaagctgtttttaaaactgcgccttgcccagcagcttggcaatcagcacagcaccaaccaactcgacttcaaacaactcgaccgcactgaacgcgatttattgcgccatagcctgcatgtggtgaaaaaatttaagcagtggctcggttatcactatcaaattcgcgattgaggtggctgatgaactggttattacgccgttattggcacgcgaaactcaaaggttctccctatcaacggctgtttgaaaccgcgcgccatcacgagtacgtctcgctcgactgtgaaaccaccagcttagatcctaaacgcgctgagttagtgaccatcgccgcaaccaagatcgttgataaccgcattatcaccagtcaaccctttgaggtgcgcctgtgcgcgccacaatcgctcgactcgggttcagtgcggattcaccgtatccgccaccaagatctgcacgatggtctgagcgaaaaagaggcgcttctccaactgattgagtttattggcaatcgtcccttggtcggctaccacattcgttacgataagacgattttggatatcgcctgtcgtaaacatctcgggtttccactccccaaccgactgattgaggtgagccagatctatcacgataaactggaaaaacacctgcccaatgcctatttcgatctcagtttagaggcgatctgccgccatctggatctgccactgcaagacaaacatgatgcgctgcaagatgcgattgccgccgctttggtgtttgtgcgtttaaccaaaggcgatctgccacaatttattgcaccgggtgtgtaacgccgaaagtcggcggcgagatctctcccgcttgtttgccgcttattcgccttgcacacatatcccatcaggctttcatcctaaagtctaattgtagaaatccctgctctgactgagagttataaacgaaacgaatttcctcctctcgtgtttgaaacgcgccctttcaggaaatttgccgaattcacaaggagaacccgtaatgagtgaagcccatatttatccggtcaaacagaacatcaaagcgcatacgcatgccgataacgacacctatctggcgatgtatcaacagtccatcaaagatccggaaggcttttggagcgaacacggcaaaatcgtcgactggattaaacctttcaccaaggtgaaacacacctcttttgacccagggcacatcgatatccgctggtttgaagatggcacgttaaacgtttctgccaactgtattgatcgccatttggcgacccgtggcgaccaagtcgcgatcatttgggaaggcgacgacccgactcaagacaaaactctgacgtataagcaactgcaccaagaagtgtgccgttttgccaatgcgctgaaagagcaaggcgtacgcaagggtgatgttgtctgtatctacatgcctatggtgccagaagcggcggttgctatgttggcttgtacccgtattggcgcagtgcacactatcgtctttggtggcttctcgccagaagcactggctggacgcattatcgactcgaacgccaaattagtgatcactgccgacgaaggtgttcgcggcggccgcgccgtccccctaaagaaaaacgtcgatgaagcactgtgcaatccagaagtcaaaaacatcagtaaagtgatggttcttaagcgtactggcggcaatgtcgcttggcatgaacaccgtgacatttggtggcatgaagcaaccgcaaaagcctccgataattgtccaccagaagagatgaaagccgaagatccgctgtttatcctctacacctctggctcaaccggtaaaccgaaaggcgtattgcacaccactggcggttatttggtttatgcgactatgaccttcaaatatgtattcgactatcagcccaatgaagtgttctggtgtaccgctgatgtgggttggataacgggtcactcctatctggtgtatggcccattggcgaatggcgcaaaaaccattctgtttgaaggcgtgccaaactaccccaccaccgcacgcatgagcgaggtggtagacaagcataaggtcaatatcctttacactgcgccaacggcgatccgtgcgctgatggccaaaggtgatgaagcgattaaaggcactagccgtgacagcttgcgcattatgggctctgtgggtgaaccgattaacccagaagcgtgggagtggtactaccgcacgatcggtaacgaaaaatcaccgattgtggatacttggtggcaaaccgaaaccggcggtatcttgatcacgccactgccgggggcaacggcgttgaaaccaggttcggccacacgcccgttctttggtgtgcagccagcgttagtcgataacatgggcgaaattgtggaaggcgcaactgaaggcaacttggtactgctcgattcatggccgggtcaaatgcgcactgtgtatggcgatcacgaccgctttgaacaaacctacttctctacctttaaaggcatgtactttaccggtgacggcgcgcgtcgcgatgaagacggttactactggatcacaggccgtgtcgatgacgtactcaacgtttcgggtcaccgtatgggaacggcagaaattgaatccgcactggtggcattcaataagattgcagaagccgccgtggtcggtgttccacacgatatcaaaggccaagcgatttacgcttacatcacactcaatgatggggtgtatccgagcgctgaactgcataaagaagtgaaagattgggtacgcaaagagattggcgctatcgcgacaccggatgtcctacactggaccgatgcgctaccgaaaacccgttcaggtaaaattatgcgccgtattttgcgtaaaattgccaccggcgataccagtaacttgggggatacctcaacgctggccgatccaagcgtggttgaccgcctgattgcggaaaaagcccaacttaaataacaaaccctgtggcttgacgttgtagcctcaagtcacaagggaatacacctttgcttgcgatttcaaactccggcgcacctcatggccggagtttttgttttctctcgtctatcttctgggaacatgcgctgaactttcctgttcaagccgattagacgatggcaaatccctctagccccctatttggctcacttccttacccatttcacgcccgaaactaggtgattagaccagtaaattgctgccatttgttatgaattggctataatcgtgggcaatttaataaaatccgcgaacttttgacaaaaactttatgtcgaataagtaaatttgtgggaaactgcttattcaccacacaataaaggaagatgactacacaatgactgcaaaatctcgcattcttgttcttaacggaccaaacctcaatttattaggtttgcgtgaacctacccactacggctcacaaaccttagaacagatcgtagcaatattgcgcgatcaagcgcaaaaagcagacattgagttagaacatctgcaatctaaccgcgaatatgagttgattgaagccattcaccaagccttcggcaaagtggatttcatcattatcaatccggcggcctttactcataccagtgtggcgttacgcgatgcactgcttggggtggcgattccttttattgaagtgcatttgtccaacgttcatgcacgcgaacccttccgtcatcactcatacttgtctgataaagcacaaggggtgatttgcggtttaggtgcccaaggttacgaattcgctttgtctgctgcaatccgagcattgcaggccaagcaataaagacactctgcggcccattcgggctgtcttattcacaagataaaagagaaagaaacatggatatccgcaaaatcaagaagcttatcgagttagttgaagagtctggcatcgcagaactggaaatttctgaaggtgaagagtcagtacgcatcagtcgttatggccaaccagctccagcacctcaagtgcactacgcagccgcaccagcaccagtggctgcaccagcaccggtagctcaagcagccgcggtagcagaagcaccagcagccgcgaaagtgccagcaggccataaagtgctttctccaatggtaggcactttctaccgttcaccaagcccagatgccaaagcgtttatcgaagtgggtcaaagcgtttctgttggcgataccctatgtatcgttgaagcgatgaaaatgatgaaccagatcgaagccgacaaatctggcgttgtgaccgcgattcttgttgaagatggtcagaccgttgaattcgaccaaccgcttgttgttatcgaataatcgaggccacctttatgttagataaagttgtcatcgcgaaccgaggcgaaattgcgcttcgtattcttcgcgcttgtaaagaattaggcattaaaacggttgccgtgcactccacggctgaccgcgacttaaaacacgtactgctggcggatgagtctatctgtatcggtcctgccaaaagcatcgacagttacctgaacattccacgcattatctctgcggcggaagtcacgggcgcagtagctatccacccgggttacggctttttgtctgaaaacgcagactttgctgagcaagtggagcgcagcggcttcatttttgtcggccctcgcgccgaaaccatccgcttgatgggtgacaaagtctccgccatcaacgcgatgaaaaaagcgggcgtaccttgtgtaccgggttcagacggcccactggataacgacgaagcgaaaaacaaagcgcacgccaaacgcatcggctacccagttattatcaaagcctctggcggcggcggtggtcgcggtatgcgtgtcgtacgtaacgaagccgaattgaccaaatctatccagatgacgcgtgcggaagcgaaagccgccttcaacaacgacatggtgtacatggagaaattcctagaaaacccacgtcacgttgaagtgcaagtgatcgctgacggtcaaggcaatgcaattcacctcgctgagcgtgactgttcaatgcagcgccgtcaccagaaagtggtggaagaagcacccgcaccgggtatcactgaagaaatgcgtaagttcatcggtgaacgttgtacccgtgcgtgtatcgaaatcggctaccgcggcgctggtacctttgaattcctgtacgaaaacggtgagttctacttcattgagatgaacacgcgtattcaggttgagcacccagtaacagaaatgattactggcgttgacctaatcaaagagcagctgcgtatcgccgcgggtcaaccgctgtctttcaaacaagaagacatcaaaattcgcggccatgccgttgagtgtcgtattaacgcggaagatccagagcgcttcctaccttgcccaggcaagattgaacgcttccatgcacctggcggcatgggtgtgcgttgggaatcacacatttactctggctacaccgtacccgcgcattacgactcgatgatcggcaaactcatcacttacggtgagaaccgcgatgtggcgattgctcgtatgcgtaacgcactcaatgagatgattgtggaagggatcaaaaccaatatcccactacaacaagctatcatggcagatgagaacttccagaaaggcggtaccaacatccactatctggagaaaaaactcggcatcaagtaagccgccgtttttactctcatcgcgcataacccaatcaatcatacccaaactacttggattggctgattgcactaggaatacgataaagcccactccggtgggctttttgttttgctttttgttttaaatccgcccactttctggcctgaacatcagtggcaaatctgctacactctgcgccaatctaaacccgatgagatcttaagccatgccttggattcaaattaaactcaatgcgaccaacgacaatgcagaagcaattggcgatatgctgatggaagaaactggcgctgtgtcagtcactttcctcgatgccaaagatacccctgtatttgaacctctaccgggcgaaacccgcctatggggcgataccgatgtcgtcgcactgtacgaagcggatatggatacctcgctgatcctgcagcaaatcaaagccagcaacatgctcgcggaaggttttgcgcacaaagtcgagcaagtggaagacaaggactgggaacgcgaatggatggataacttccacccaatgcaatttggccgtcgcctctggatctgcccaagctggcgtgaagtgccagacccacaagcggtgaacgtgatgctcgacccaggcttagcttttggtactggtactcaccctacgaccgcactgtgcctagagtggctggataacctcgacctaagcggtaaaaccgtgatcgattttggttgtggctcgggcattctggcgattgccgccatcaaacttggtgccgcgaaagtgatcgggattgatatcgatccacaagcactactggcgtccaaagacaacgctgcgcgtaacggcgtggaagatcaaatcgaagtttacctgccaaaagatcaacccgaaggtttggtggccgatgtggtggtcgcgaacattctggccggcccactgcgtgaactttctccgatcatcaaaggactcctgaagcccggcggccaactggccatgtctggcattctggatacgcaagccgaaagcgtggcggaattttaccgtgacgatctggagcttgaccccatcgcagaaaagagcgaatggtgtcgcatttctggccgcaagctaggctagataagactttgcggcctaattgactgataaatcgactatttggcaaaacaatttgccaatgctcaaatattagtcttttcaggcatcaaaaaaatgcgtaaaatgcgcgcccttgctggtacgaagctgtgaagacgttttgaaaattggaaactatcaacttaagaacaatctgatcgtcgccccaatggcgggtgtcaccgacagaccctttcgagagttgtgtttacgctacggggcaggaatggcggtcagtgaaatgatgtcgtgcaatcctgcgttgtggaaaacggccaaatcgcaaaaccgcatggtacatgaaggcgaatcgggcattcgctcagtacaaattgcgggcagcgatccacagctgatggccgaagccgcgcagttcagcgttgaaaacggtgcgcaaatcatcgatatcaacatgggctgcccagccaaaaaagtaaataaaaagctcgcgggttctgcactgctgcgctatccggatgtgattgaagacatcttgaaagcggtagtgaatgcagtgaatgtgccagtcacactcaaaacccgaacgggttgggatacagacaataaaaactgtctctcgattgctcaattagccgaagactgcggcatacaagcactggctctccatggacgaactcgtgcctgcatgtacaaaggtgaggcggaatacgacagcattaaagcggtcaaagcggctgtgagcattccggttatcgctaacggtgatatcgatagcccggagaaagcacgctacgtactggagtacaccggtgcagacgctttaatgattggccgtcctgcccaaggacgaccatggatttttcaggaaatccaacactttttggaacacggcaccacaatgccagaacttccaatttcggaagtgaaagacatcatgcttggtcatgtaaccgcactccatcagttttatggagagtacttaggcccacgaattgcgcgcaaacacgtgagttggtacctgcaagagcatgaacaagcgagtgcgtttcgccgtaccttcaacgccattgagactgctgaccagcaactcgatgcgctcgaagggtattttgataacgttgcatcataattaagagaagagctagaccgaatatgttcgaacaaaatctgacttcagaagctttaaccgttactaccgtaacttcacaagaccaaatcacgcaaaagccactgcgtgactctgttaaagcgtctcttaaaaactacttggctcaactgaatggccaagaagtgactgaactgtatgaattagttctagctgaagttgaacaaccacttctggacaccatcatgcaatacactcgcggtaaccaaactcgcgcagcaactatgatgggtatcaaccgcggcactcttcgtaagaaactgaaaaaatacggcatgaactaatcttcaccgacgttttttaagccctgactttgtcagggcttttttattaccttttattcaccacacacaatggttgtacccataccgtcacttcttcataatgttactcataacattttataaaagactcaataacctatgacaaaaaaacagcgcgcgacattgcaagatgtggcggatcaagttggcgtaacaaaaatgactgtgtcgcgttatctgagaagcccggattcagtggctgcggccacgcgggagaagatagcgctcgccgttgaggctttgggatacattgaaaatcgcgcccctgcgatgctttctaaatcatccagtaaggcgattggtattttacttccttccttgtcgaaccaaatttttgcctcttttgtgcaagggattgaagcggtgaccaaagccaatggctatgaaaccctactcgcccactttggttacgatgaggaggaagaagagcgcaaaattgcttcgctgctcgcgtatcaagtcgatggtcttattctcaccgaaagtcatcacactcagcgcactttgcaaatgattgccagctctggagtgcccgtggtcgaaaccatggagcttcccgccaacccaattgacatggcagtaggcatggatcacgttgaagcctcatatcaagcggtgaaaaaaattatcgcggcgggtaaacgttcgattgcctatttcggtacacggcttgatacccgcaccaaactgcgtatgcagggctatgaccaagcgatgcaagaagccgggctgcctatcaagcacgtgctgactggctcacactccagtttctctctcgccgctcagttgcttgatgaagccttcgcgcgttaccccgatctggatggtgtgttctgcaccaacgatgacatcgcgattggtactctactggtggcgcagcagcgtggtattcgggtgccagaacagctttcagtgattggctataacgcgctggacatcggccgcaccatcacgccaaagctgactagcgttgattcgccacgttatgcgattggagaaaaaagcgctgagctactgattgccgcactcaaaggtgaacgtgccgagcagcaagtcgtcgatatgggctatcgatttactgccggtgagagtgtgtaacaccagcactccacaaaggataaagctgaaaaaggcggtacacaccgccttttttgatgcttcaacttacccaaggttaaacaataaagctcgccccttgttcggcggaagagaccgcttggcgcatcactttaaacaattcgcgtccccacatttgctgatcgcgctcggtatctaaagcgagagcttggcgatggctcatgtcggttaagttctcaagcgtgcctgttgtgcaatccaagcgcagcaaatccccatcacgcactaaaccaatcgcaccaccgcgtaccgcttctggtgacacgtgaatcgccgatggaattttacctgacgcgcccgacaaacgaccatcggtcaccagcgcgactttgaatccggctttttgcacgttgcccaaaatcggcatcaatttgtgcagctcaggcatgccattcgccgcggggccattgtgggtcaccaccacaatgcagtctttattcagttcaccacgctggtaagccgcttccacttggtgctgacactggaaaactaccgctggcgcttcaatgatgcgttgctcttctttcactgccgagactttgatcactgcgcggcctaagttcccgttcagcattttagtgccgccagtggtttggaagcactcgccactcgccgcgatcacctgagcatcacgcgtgccttcgcacgccttccaacatagctccccgtccaccaactcaggcagcgtcagttgatccctaaactcaccaaatactggtgtaacatccgagtgcagcaatttagattcatgcaaacgcttcattaaggctggcacgccgcccgcttgttggaaggcattcatatccgcagggccattcgggtaaaccttcgccagcaacggaaccacatccgacagatcactgatgtcctgccaggtcagcaaaatccccgcggcacgtgccaccgccaacatatgaatggtgtggttcgtactgccaccagaagccagcagagcgacaatcccattgagcagacttttctcggttacgacttgatagagcggacgatactgcgctgaaccttgggtcatgctggcaatttttaccgtcgcgtcatcgttcaatgcttggcgcagcgccgaatgaggatgcacgaacgccgagcccggcaacatcagccccatggcttcaaacaccaattggttggtgttggcggtgccgtagaaagtacacgtacccggcgcgtggtaagcctgacactccatattgagcagcgcgtctttacccacttcacccgccgcatacttttggcgaatatccactttctcttcgttactgatgccggttgccattaaacccgcaggcataaacgcggtcggcagatgggcgtaagaaagcgcgcccatcaattgccccggcgcgattttgtcacaaataccgagcagtaaagtggcatcaaacacattgtgactgagagaaagtgcggtcgcctgcgcaatcaaatcacgggaaaacagcgacatatccatccccggctgaccttgggtcacgccatcgcacatggcgggtacgccaccggcgacctgcgcggtatggccgtactcggctaacaccatcttgatgcggtctggatagtgctgataaggctgatgcgcactgagcatatcgttataggaagtcacaatcgccacattactgcgcgtgaaatcgaggatcgcttttttctctgtgctgcaagaggccgccaccgcatgggctaaattaccgcaagagagtgaggtgcgacctttgccggctttttcttgtgcttgactgcgtgcaatgaaggccgcacgtgcttcacggctacgctctgtcaggttttgagtgaccttggctaaaataggatgaatcatagaccctcctgctcttgcagcgcttgaatcgcacagctcaccacttcctgtactgaacaatcaatagggatgatcagggtttgcggctcaccatcagggcgctctaaggtttcaaactgactgttgaccatgttctctttcatgaaatggccttgacgagcgcgcatgcgctccatgatcagttctttcgagccatccaagaacaagaaggtcacgttttggttgccttcgcggatctggtcgcggtactgctttttgagtgctgagcagacaatcaccccatgttcgtttttgctttcgaggctgtaagcggcatcgcgaatgcgctctaaccaaggtttacgatcttcatcattgagcggctggccggaggccattttctgaatattggcacgcggatgaagatcatcgccatcaatgaattttcgcccagtctgctttgccaataactcaccaatggtgcttttaccgcaagcacaaacccccatcacaatgatgctactaccggccataacgactccttaaaaccaaacttgcgcgtgatcgcatttttaaaattcacttcgaaatatgggtttatcttattcatgttatgggtaacatgttaccggtaacttcactaaatgtgagctataacacaaactataaatctggacggtgaactcatggaccccttactacaaacctctgatcctacgtatctattaaccgtggcggcggtcgccattattgcgctactgctgctgattattcgttttaaaatccacgcttttgcttcactgaccttagtcagtttaggcaccgccattgccactggcgtggcgtctgacaaagtggtgtcgaccatgatgacaggctttggtggcacgctggcttcggtcgcgctgctggtcggccttggcgctatgattggtaaaatattggaagtgacgggcggtgcgaaagtgctggcagacacgctgatcggccgctttggcgagcagcgcgcaccgtttgcactcggcgtggcatcgctgctgtttggcttccccatcttctttgatgcgggcctgattgtgatgatgccgatcatcttcagcgtcgcgaaacgctttggtggctcaccccttaaatacgcgctgccatcagcaggtgcgtttgcggtcatgcacgcctttgtgccaccgcatccggggccggttgccgcggcagaactgctcggcgcaaacatcggcttgctgctgattgttggtttgcttgtggccatcccgacttggtacttgggcgcttacctatttggtctgtatgccggtaagaaattcgatattcctttgtcgaaagccttcttcaataccgatgcgatcattgacgaagctaaactgcccaaatttgctacggtcatgaccattctggtactgccagtgctgctgatttttatggataccggtttgaacacccttgcggtcgcgggcatgattgatggtaaagctcccgcagtcgaattcctgcgtatgctgggtaaaacaccgattgctctgctgatcactctgctcgtctgtatcgcagcgttcgccaaagattacggcatggcacgcctagaaaaactgtgtggtgattcgcttgcccccatctgcgcggtgattttagtcaccggtgcgggcggcatgttcggtggcgtactgcgcgcgagcggcattggtagcgcactggctggcgtgctgtcggataccggtatgcccgttgtggtcgccgcatttgtgattgcgacctgtttacgcgtcgcgcaaggttcggctacggtcgctctgaccacgacggccgccctgattgcaccgacggtggcggcgaccacaggcctgtctgatcttgacctgtgctttatcgtgatttcgattgccggcggtgctactgtgctttcacactttaacgattctggtttctggctggtgtcgcgtttgatggagatggatgagaaaaccactctaaaaacgtggactgtgatggaaacccttttgggcggtatcgccttcctgattgtggcaacactcagctttattctgtagaggtatggactcatgaccattgaacaacgcttacgagcgatcaaaattgtccctgttattgcgattaatgatgtcgcccacgcactgccactggccaaagtgctggttgaaaacggtttgccttgtgcagaagtcactttccgcaccgctgcggccgcggaatcgattcgcatcatgcgtaaggcgtatccagacctgctgattggcgcaggcactgtactcacgacagcgcaagtggatgaagcgattgcggcgggagctgatttcattgtgagcccgggtctgaacccgaccacagtgaaatattgtcagcagcgcaatatcgcgatcattccgggcgtcaacaacccaagtttggttgagcaagcgatggaaatgggtctgcgtaccctgaagttcttcccggccgagccatctggcggcattgcgatgctgaaagcgctgagcgcggtgtacccagtcagctttatgccaaccggcggtatcaatccaaacaatgcgcaagagtatctggcgctcaaatcggttgtcgcgtgtggcggcacttggatggtaccgaccgacctgatggacaaaggcgactgggacaccctcgccgagctcgtacgcaacgtataagccttttcggctcgttcccccaccaaagaccaaacgctccgtttggtctttttttatattgcgcgttaactcgttgagcagaatgagatatcacctacaaggatgaaatgcacaaataacacttgaatcaataatgaaaattactatcatttgtgattcatttttgtggcgaatgtttgccactgacattattcgtcaataataaatagagttaatccttcatgtctcattttactcgctcaagaacctgggtcagtctggccgttttcgccgcttgtgcccccgcctatgccgaacaagaaaccttggtcatcaccagtcaacaaagccaactgccggaagtcgccaccgcaacccgcaccgccactccggctaaactggtgccgcaaaccattgattcactttctgcggaagagttgaccgcgtttggcgctcccagcctaagcgaagctttagctggggtaccgggggtcaacgccaacggcgatacccgttttgacggcatcaatattcgtggattttccgccagcaacgatttttatctcgatggttttcgtgatgatatgcagtacacccgcgatctcggcaacatcgagcgtatcgaagttctcaaaggcccagcggcggtgttgtatggccgtggtagtacaggggggatcgtcaaccgcgtcagcaaagtgccacacgcaggtgatgccgcgagcgtttctgcacgcattggcagccatgattaccaacgccttgccgcggatctcaatggtgaggtcaatcagcaagtacaagttcgcctcaatattgctcaagaagattacggcagtttccgccatggcgtggaaggcaaacgcactttgcttgctccgtctctgaactgggacatcaatgatgatgtgagctggcttatccagtatgagcaacactcccataatcgcgtgccagatcgtggtattccggcggtgaacggctctcctgctgaggttcctgcgagcagtgtttacagcgataccagccgtgactttattgatgatgatgtggccaccacgcgctcacgcattacttgggcattccacccagaatggcaactgcgccaacaactgagctacaccaagctcgatagtcagtttgataacacttacgtagctcgcgtcagtggcgaccaagtcacgcgtcaacgcttccaacaagatctgcaagccaacaacctgatcagcaataccgaaaccgaaggcaccttcaatacgggcccgattgctcaccgaattctgataggtctagagcaaggctggcaagagcgctcgccgaaactgtatcgcaacgccaacagcatcccgagtggtaacctgtaccaacctgagtcactgccgacctacaacggacctatgtcagtatttagtgatgccactcataaagtgcggagctacggtatttatgtccaagatcaactgcaatggggagattggattgtgttggcaggtctgcgtcacgatgatttcaccgtcaccactcatcgccacgataccaataaagaagagaccatctcatccaacagcttaagcccacgtttaggtgtggtatggacccctgtgcaagagcatgcgttgtacgcttcctactcacaaacctattctccggttggtggtggcgttattggcattacgccgggagacaaacataaccacctcgatcctgagcactcacgcctgtattaaactggcgtcaaaagcgattggctagagggacgcatctcaaccactttatccgtctatcgcttagaaatgtataaccgccgtatgcgtgatccgaatgatcaggagcgtattattctcaccggattacaacgtaccgatggtattgagctgagcagccgtgcacttctcaccgatgaattttctctgcgtggcggcattggcctgcaagatgcaaaatacgtcgaagctgatgccagtgagcaaggtaaacgcccaaccaacgtatcgcgcctcaatggtgagctgtttgtcgcttatcaatcggcaagcgatggctggtttggtgagaccggttttgtggcggtcggcgatcgctatgccgatcgtactaacaccaccaaactgcccggttatgcccgtttcgatgcacgtctcggctaccaatggcaagcttggcgcactcaactgagcgtagaaaacctgctcgataaggattactacctgagtgccaccagcagcacacaaattcagccgggtgcaccgcgtgagttctacctcacagcgtcttaccagttctaaacgattgatccccatttggcatgcagcggcaagtcaaaggggataaccacaggagagctggcctaacggccagcttgattatgcaacgtcgacgcctgcctctacacaacaataaatggatccgccgccttcatgcgtggtgcggcttctttaccctactcttaatgctgttgtatggcctcactggcctttggttatctcaccgcgctgtctggccactgcccgggccacacaccagcaaaagtgaatggcaactctcgctgactgaacccatcgattcagtcagcacttttcaagcgcagctcaataccgaatatggcgaacatgagtggacgatacgcgaaatcgccgcgcagcagttgcccacgccacaacagccgttattgatcccagcccgctgggaagcgcgcgccaccagcgtgaccgatacctttagcgcccaatacgtacccggcaccttagtcattcaagctcagcatcaaaaagccaactgggccgctgtgcttaaccgcttgcatcgcggaatgggaacgggtcttggctggcagttgttttccgaccttgcggcggttgctatgctcctgcttgctctgaccagtttactgatgtggaccaaactccacggctccccgaaacgagcaggatggctattgataggtggcagtgtcgcgaccacactgttcgccatctttggttaattgactccccacggcgacctcgtcgcacccgacaatctaaccacacaggttgcagcccacgtcgctgcaacctttggtgacgctggcgctcactgattgcgcgctttcacatttctgctgaggatttgaagcgaaattcgacatcgtgcacaacttcaccactttgcctctttagtcgcatttaccgctctgaaaacaatctgttacagtcttgcgtaccatgaaatattcatcatgcgtgtcatatctcaaggagtgatgtttatgacttccgttagcctgcgccacctctcaatccgtaatcgcttatttctgctcactgtggtgattctggtactgctggcaataccgtttgccattatggtcaaagattatcgacacgacctgatgctagaaaaacaagttcaaactcagcatttagtcgaaagtgcttacacactacttgagcactatgctcagcaagctacccaaggcacactcacgaccgaacaagcgcaaaacacggcaaaacaagcgatagctcaattgcgttatggcgcgaacgactacttctggattaatgatgcgcagcctgccatggtgatgcatccgatgaaaccggatttgaatggcaaagatctgcgcagctttaaagacccgaacggcaaagctttattcgtcgaaatggtcaatgtcacccaaagaaatcagcaaggtgtagtcgagtatcagtggcctaaaccgggtgccgaacaacccgtcgataaagtctcttacgtcaaactgtttaaaccttggggctggattatcggcacaggcatctacgtcgatgatgtgaatgcgctggtgatgcagcgcctgagctcaatactggtttgggttgtgggcacgctgctggtattgattgtgcttgccagcttgattgggcgcagcatcactcaaccttgcgaagagacactcgcaacgctgaaaaatatcgcccaaggtgaaggggatcttactcgccaattaaccgtgacgggaaaagatgaactggcacaaatcgcgcaagcctttaacctgttcaccaataaaattcgacatattattcaagaaattactccaatcaccgagagcgtgacgggctctgccgatgaactgactcaagtagcgcaaagtgcatccagcaaagcgtatgaccagcaccaagcggtggataccgtcgcttccgccatgaatcagttgcatgcgtccaatcaagaagtcgcgcaatctgcccatcaggctgaacaagcggcgcacagtgccaatcaagcggccagccaagggcgcgaaatgatcacactcacctcgactcaaatgcagagcttgcgcgatcaattgacccgtaccgaacaagaaactcaagttctggccagtgaaacgcaatcggtcagtgcagtcttggaagtgatccgtggtgtggccgagcagaccaacttactggcactgaatgcggcgattgaagcggcgcgtgctggtgagcaaggccgcggctttgccgtggtcgccgatgaagtgcgcaccctcgccactcgcacccaagccagcaccaatgagattgagcaaatcattgctcagttacagaaaaaagcgcagagcgtcagccaatccatgacgcaaacccagcagcaatcacgggtgacgcaacagcaagccgagcaagcgcagcagatgctcaatgagattgaagcgcagatcaaaaccatcttgtccttcaaccaacatatcgcaggcgcgagcgcccagcaatcagaggctaccgacgagattacccgtaacctcacccagattgccgagcacagcacccaagcctcagctcaagctaaccaagtggcagccgccagtgaacagttgatggaaaatggccagcatctggctcgcagcttagcggtgtttaaaatctgatcccgcgacgacgcttttcacctaaattgcaccatgaaaaaagagagagccgtgaggctctctctgtgtatcagcgtccattggggagttacgctgtctttatggggtaaagctggcttagtccttcagcacttttacggtgtaagagccatctttttggcgatacaaaccatgaatgtcggtctcaaaacctgggtaatgcgcgccgatttcgcacagcatttccaagaaatccaacacagggcgagagctgtctgtcaccatttcacctggcagtaccaatggcacgcctggaggataaggcaggatcatattggcgctcacgcgacccaccatctcgttaagcaggatctcttcagtttgaccgcgcagctcttgttgccatgccacgtgtggcgtcactttcatctctggcagcacatcgaacgctttgtacatcagctctggcaattggtatttacgagttaagtcgtgaatgccttgcgccaactcttgaatacgcatgccttcgtagaaaactgggtcttcacggtacagtgaaggcagcatggtacgaatggtcaggttcagatcgtaaccgcgtttgaactccgtcaagccgcgcagcaactgcatcgcttttgacttatcaataccgatagagaacaggaacagcaggttgtaagggccagttttctcaaccacgataccgtgttcatcaaggtatttagagaccagtgatgccggaataccgctctgctccaattcgccatctttgctcattcccggagtcagcagagtgattttgatggggtcaaggtacatgtggttgtcatcaagattcttgaagccgtgccaatcttggtttggatcgagtttccagcactcggtggtctcaatgttctcgggttgccacacatcgaagaaccagccttcgctctcgcctttcagacgtttgatctctttacggaagcgaatcgcacgatcaatcgaatcctgcataagcttacggccggtgttgccacgcatcattgcagcggcagtttccgtcgatgccacaatgccgtactgcggtgaggttgaggtgtgcatcataaaggcttcgttgaacgactcgcggtcaaactcacctttgacatgaatcatcgaggcttgcgagaacgccgccagcagtttgtgcgtggactgggtttcgtagaacactttacccggcatcgcttcgccactcatgccgcacttgccttcataaatacggttgaagttagtgtaaggcacccatgcactgtcgaagtggatgtgtttgcaatccagcgactctttaatgaactgagtgttgtacagcaggccatcgtaagtcgagttggtgatcaccgcgtagcttggtgcgctcgcccccggggtgtttgccactttctctgcaatcacttcacggctgaattcgttctgtggaataccaccaagaatgccgtaagcgttacgggttggacggaagtaaattggcgttacatccgtcatcatcattaagtgagtcaatgatttatggcagttacgatccaccagcactgtgctacccgcaggcgcggagaacataccgacgatcttgttcgaggtcgatgtaccgttggtcacgatgtaagaagcatcggcattgaacgtgcgcgcgatgtactcttccgcttctttgtgtggaccggagtgatcgagcagtgagcccagttctggcatcgaaatcgatacgtccgctttgaaggtatttggaccgtagaaatcgtagaaaatgctgccaacagggcttttctggaacgcagtaccgcccatatggcccggagtacagaaggtgtatttaccctcttctacatatttgaacagcgccttagtaaacggaggcatgatcgcgtctttgtactcttgagtcgcttgattgatcttgatggcgatatcgtcggccatgcccagagcgtattcgaagaaatgcacgttgaggcgcagatcggttagcgaaatatctaacgtcgattgctcgttagcaaaggcgtgcacaggcagtttttcattgactttactgatgcgctcacacagctctagcgagtatttatcccagtcgaacagcacgccgcaaatgcgtgggttcatctcaatcatcttgatcagatctttgtcatccaccggataaaccacgtcgtaaccggctttttctaatgctgcatgcagttggcgaacaggctcttctttaaagaacacacccatgtggttcaagatagcgaaaatattcatttggacatctccaaggcgaaaaaaggcgctctctgtgcactgcacagtgagtaagacgagcgccatagtgaattcagaaagctggcgtggcagacgccagcaaggtcaatcagaactgagccgaagcttgttgtggatgagtctcgaggtatttatccagacccgcttttttgctgtagaacatcaaaataatcagcgacatgatgaaggttgcagtcagggttgaaccctctgcaccagccagcgccaccatacagaacaggctggcaataccggagaacagcatcacaaacgtattgcgagtggtcatgccttcgaagcggatcaggttaatgctggagtagaaataaggcagcatggtcagcagaaccgcatcggtagtcagttggttaaacagatcggaagcgtgcgcagtttctgagctgaagaacatcagcaccagcatcagcaatgtcatcatgctggaagcaatcagcagaccttttttcggtacaccgttgcgatcggtttcaccgaatactttcgggaagttgccatcgttagcggcacgtttgcccgcttcgccgaccagcatcatccaagagccaagtgacgtgaaacacgctagtgcagtaaaggcagacacgaatggcgcagtccagctaccaaacagtgctgtggtcgccagtgcaaaaggtgcacccgatgccgccacttcagaggcagggaacataccgctgatcatttgagttgatagcacatagataaggcccgcaagaccagtacctaacatggttgccagtggcaccgtgcgttttgggttttcgaccataccggaagaaaccgctgccgattcaacacccacgaaagaccacagacagatcagcactgcagtgatcaccgcatggccatcgctaccggcagacacgttccagttttggctgtagagcgcgctgtcaaagtgcgtccaaccaaacagagccgtaccgactacagggatcaaaatcagcaccaaaccaatggtacataaacggcttacccagctaccaccaagcaagttgactaaggtaaatagccaaaccgaagcaatggtcgctaaaccagcagggatcgggttattcagcaccgggaagaacaccgaaaggtaagaaacaccggtaatcgcaatcgccaaattaccaatccagttagcgtggtagtaaagcacgcccgtttggaaaccaaacaccggtgacacttcccctgcataagcaatcgggccaccctcttgcgggtttttggttgccaaacgagcaaacacaaacgccaaactgagtgcgccaacaatgcagatcagccagctataaatggaaattgaacctacgctcgcaagcgtagaaggaagcagcgcaataccactgcccatcatgttgccagccaccacacccgtacaggcgatcaggccgattttttttgcatttgatgacataacatctccaaatcgattctacttaagttacaaaactcaaactgaatgggttagcgagatgtcatgagtgcaatcacctgcgctacctcgctaaatttcgaagtgcagagtacgcccaaaaaaacgaaaaaaataaacttccgcttatcaataaaatgatgagccaagcatgactttcttgatatcaacctgataaacaccaccaataaacctctttattttcatatcattaataaaaaacctaaaaatatcaggagagacaactaaaaatatcaaggtgaaaacatcacgctaaatactgctctgcggaggtatcaggagggaggtttatcgccaaaaaacggttggtcttgccataagatttgtcactccactggcaagccgctcgatgaagcgacatccatcggcacagaatgccaatgaggctcactgaatttgacttggggaataggctcaaacgaatggccattaatggcgagtagaagttaaacgactagtgagtacatagacatagttcgatgtcattagcgggcgtttttcagtcagaaggattccgagagataaagcggcgcgccctcccctctaaaccgtgctaaagccagttcggagaaagaaggcacaagtccgctctatccccttcttaccagtcattccaagtcatttggggatagagagatgaaattgaccgtagacgagcgttacagtaaacgaaccaccgaaggatgcaccgagcggtacatggcgtaatcaatggattttaagttagagtggaacaccaagttttcgcacagcagataagtttccagcgatgtgtccatataaaacgcttcactgtaggcatcgcttgcgccatccagatcgcctttgagttcagcatgcttgccttgcagcacatatgaaagcaccgattcccgcaaaccctgagcttgcgccaaatagtgcgtggcggtttccacttggttttcgactgttgcttgcagtgctaacgcttcataaatgcgtggctgcaccaccgcttgaggggagtaactcacctgctgcaactgctcactcaacaccagcatccgatcttgattgagcgcctgatctgggctgatcgcttgctgcacatggtacgcaatcagtaattcggcttggacataatggttatccggctctaatttcagcacttgctccaataagtaaatgcctttttggaactgcggacgatcggcaacattcaagtaatgattggcgcgcacatacagccctaacgccgcgggttgacgcggaaaatccaccaataaacgctgtgcttgctgctctgcattcgggattttcaacgcttgcatcacatcccactcggcacttttcagcacagaggccagatgctggctatcgagcggatattggcgactaaacagcaccgcatcggaagagttgttcttaagctcaagatctaaaaactcatggccatcttggtcattgactcgcaccatgatcgacttaccgggcaaaatgcctgagctgtaagccgttttaccgagaatgacccgataatcactcacttgggtcagatcggccatcagcttttgtgcgataccatcggcaagctcatgcgtgagcgcctgagcatgaaaaccgtcttggaatttaaattcaatcagatgggtatccaccacttgggtgatgcgcacttgcgactgctgcacagtaaaaaagcccatcgctacaatcactaagccaatccagatcgcattgagcaggtttaagcgccaacggctcacattcggcttgcttgatttcttcggttgctgactttggcacacggcgcgcgttaacgggccggcaggaaatacaatctcgggaacggcgtcttccacgtcgtcgatatcgtccgccaaacagacatcactggctgtcgactcttcttggcgagaaacatagggattgccatcgagacgctgcacattcgcgactaacttatagccacgcttaggcaccgtcaccacatagctgaggttttcttcgcgtccatcgcgcaatagcttacgcaactcaaaaatggattgagtgaccacttggtcggtgacaatcgccccgtcccagacatgttgaatgagttcctcacggccgaatacctctccggcatgctccgcaagaaaatgcagcaagttaataagacgcggctcggccgagacctccctatcttggcgatacagcttattctcatcaatgcacagaacccagtcattgatttgaaaacagattccaatcatagaatagctctttgtatcaggaagatagcatcggtaagaggcagaatatgctcgagcaccacacaccgatgaagagcgaaattataagtgcaccaatctatttcacctactattgataaggctaaaaattgcaaacttaggttgtttaaccatcagacaacgtcattcctagtggtaaaaactaaattacccttatcaatcagaatataaattaggcgttatttctctactctaacgcggctaaaatcgagcagtggctggcattatcttcgacatgtccacagcaggcatcattgatttttttcagcgcgctgcgaatacgggtcagctcttcaatcttttggtcgatcaccgccagcttagcgctggtgatcgctttcacctcggcgcagctgtgttcggtcgcttccaaacgaatttccagcagctctttaatctcttcgaggctcagccctaactctttggcttttaaaataaacgtgacttgttgctggctcttttcatcgtacagtcgatagcccgactcggtgcgcgttgccggagcaatcagctcatttttttcatagaaacgcagtgtatcggtggaaacgccgcagcgtttggctaactctccaatctgaaacatcactcctcctcctccctgactacttggagtagtttggggaaatttaagctttcgttaaaatttgtgcttgaaaaaccgttttttagcgattatttttcccatgccaaacgattgcgcgagatcttttgtaataaattggttagaatacgcgccattcaaatcgcggcggataaggtatttccccaaatagctctgttgttttttgcgcggtgaggctttgcagcgagcttccccaacaccgcacagcagatcactttcggcaaatatcttttaaaggaaaatggaagcatgaacaacgctcgtcctattcaccgtgcgcttctcagcgtatcagataaaaccggcattgttgagttcgcaaaagcgcttgcagagcgcggcgttgaacttctctccaccggtggcaccgctcgtctattggctgagcaaggcctgacggtaacggaagtctccgattacaccggtttcccagaaatgatggacggacgcgtcaaaaccctgcatccgaaagtgcatggcggtattttaggccgtcgcggccaagatgacgcggtgatgaatacccacggcattcagccaatcgatatggtggtggtgaacctctatcctttcgcccaaacggtagctaacccaaattgcacgctggctgatgcggtggaaaacatcgatatcggcgggccgactatggtgcgttctgctgcaaaaaaccataaagatgtggccattgtggtgaatgcgcacgattacgaccgtgtgatccgcgaaatggatgccaaccacaactccctgacgttagcgacgcgttttgatctggcgattgccgcttttgaacataccgcggcgtacgatggcatgattgcgaactacttcggcacactcgtaccttcttatggtgataacaaagaaggggatgaagagagcaaattccctcgcacgttcaatgcgcagttcatcaaaaagcaagatatgcgttatggcgaaaacagccaccaagcggccgcgttttatgtagaagccaatccacaagaagcctcagtcgccaccgcgcgccaaattcaaggtaaagccctttcttacaacaacattgccgataccgatgccgcactagagtgcgtcaaagagttcagcgagccagcctgtgtgattgtgaaacacgcgaacccatgtggtgtagcgctgggcgatgatcttctgcaagcttacaatcgcgcttaccaaaccgacccaacctcggcatttggcggcatcattgcctttaaccgcgagctggatggcgaaaccgcaagagcgatcatcgagcgtcagtttgtggaagtgatcattgcgccgaaagtctcgcaagccgcgatcgacatcgtcgcagcaaaacaaaacgtacgtttgctggagtgtggtgaatggcaaggccaaaccacaggatttgatttgaagcgcgtgaatggtggcttattggtgcaagatcgtgaccaaggcatggtggcacaagatgacctacaagtggtttcgactcgtcaacctagcgacgctgagctgaaagatgctctgttctgctggaaagtagcgaaatacgtgaaatccaacgcgattgtgtacgccaaaggcgacatgaccatcggcatcggcgcgggtcaaatgagccgtgtttactccgcgaagatcgccggcatcaaagccgccgatgaaggcttggaagtcgcgggcagcgtgatggcatcggatgccttcttccccttccgtgatgggattgatgctgcggccgaagcgggcattacctgtgttatccaaccgggtggctcaatgcgcgaccaagaggtgattgatgccgccaacgaacacggtatggcgatgatcttcaccggtatgcgtcacttccgtcattaattggcatgattggtatggggtgcaacgcgccccatcttgtttaagtaaggatttcacaatgcaagttctcatcatcggctctggcggtcgcgaacacgcactggcgtggaaagtggcacaaaacccacaagttgacaccatctacgtcgcgcccggcaatgcgggtactgcccttgagcacaaggtgcaaaacgtcaacattggcatcaccgacattccagcactggttgcctttgctcaagataaagcgattgagctgaccatcgttggcccagaagcaccactggtgattggtgtggtggatgcgtttcgcgctgcaggtttaccgatttttggcccaacccaaggcgcagcgcaactggaaggctccaaagtcttcactaaagatttcctcgctcgccataacattccaaccgcggcttacgccaacttcactgaaattgagccagctctggcttatgtgcgtgaaaaaggtgcgccgattgtagtgaaagcggacggtttagcggcgggcaaaggcgtaattgtggccatgactctgcaagaggccgaagacgcaattcaagacatgttggcgggtaatgcgtttggttcagcaggcagccgtgtggtggttgaagaattccttgatggagaggaagcgagctttatcgtgatggttgatggtgaaaacgtcctacctatggccaccagccaagatcacaaacgcgtgggcgatgccgatactggcccgaacaccggcggtatgggtgcttactcaccagcgccagtggtgacacaggacgtccatgatcgcgtaatgcgtgaagtgattgacccaaccgtgcgcggcatggcagccgaaggcaacacctacacaggcttcctctacgcgggtttgatgattgatagcactggtgcaccgaaagtgattgagtacaactgccgctttggtgacccagaaacccaaccgatcatgatgcgtctgcaatcggatctggttgagctgtgccaagcagcgattgcgggcaagctggatcaggtggaatcgaagtgggatccacgcgcctcgatcggtgtggttctcgccgctggcggctacccaggcgactacgccaaaggtgaggtgatttcaggtctaccgactcaagaaagcgcaggacaaaaagtgttccacgcaggcaccgaaacccaaggcgaccaagtggtgacgaatggcggtcgcgtattgtgtgccactgcactcggcaataccgtattagaagcgcagcaacgcgcttaccaactggcggatcaaatccactggaatggtatgttctgccgccgcgatatcggttatcgcgcgattgcgcgtgagcaagccaagtaagcgggcatccatcttcttatcaatagaaaaaagcgcgaacttcgcgcttttttattcgataggttttttattcgattagattggcaaacatgggccgatttaatcaagcaactccggctctttcacacaatcgtgacccgcatcatcgagcaacagcagctcgtcgatatgcactttgccgttacggatcttgcctaaaaacgccacatagctttcgatagaagctaggcggttaaacacaaagctgggcaaactttgattaaactcgacgcgctgatactcaacgccctgacaagtctcaaaggttttaccattccagtagccttggatcagctctaaaccttgtttgtcctgctctttggttgcctctgccaccgctttggcttgcaaaacgtagtgagccagttgctcttcattcatcggcagtacttttccgcccaaccgatactgctgatacacagcttcgccttctttgctaaaacgaatatggacgcgaaacggcaccaacttcttaccatccagatgctcaccttcacggcgaatctcacgcacttgtccctcttcccagcgatagctggtttgataactgccgtagtcaccggaggtcacgtagtctgaggctgagctcggtttttgaaagctttcggtataccagtaaaaactggtcgcatcaccaatcgttttaccaccagtaaattgattgatctgctcaagattgggattaggagtagacgagcacccggccaataagccagagagcaaaaagaggaaggataactgctgcttcataaacaaaaacgccgagatgttcaatctcggcgtagtataaagcaattacttgatcgcgtctttcagcgctttacctgctacgaatgcaggaacgttagctgccgcaattttgatctcttcaccggtctttggattacggccagtacgagcagaacgatgattaactttgaatgtaccaaaaccaatcagttgtacttggtcgccgtctttcagagcaccttcaaccgcacccagagtcgcttcaagagctgctttcgcttgcactttagtcaggtccgctttctctgcgataaagtcgatcaattgggtcttgttcatttaggtttcccttctcaataggttatcgaatcgagctcactctaaaacataaatgcccgctctggcaaaggtttgtcgcgcaactttcgcttttatgacgcacttttaaccgtaatctgagtaacaactcacaatttgttactaatccagccacaggtttacttgtaattgagtgagagaaaccttatttaaaaagggctaatcgactgggaagcctgtcatttcaatcgatttagtgactgaaaaaagcactttcggctccttcaggcgaagcgatttttcttcatattctccctgtgctttgcggcctttaccgcgaagattgtgagaagaaaagagttcgaacgtgcactttaaaaccaaggaattttatgtttctgcttgcgatatatatctctgtcgcgattggcgtatcgtttatctgttcagtattagaagcggtactcttaagtattaccccaagctatctagcccagttacgccaacaaggccaccctgcggctaatcgcctagcaggcctaaaggcggatatcgaccgcccactcgcctcgattctgaccctcaataccattgcgcacaccataggtgctgcgacggctggcgcacaagcggcggtggtgtttggtagccagtggcttggcctgttctctgctgtgctcaccctaggcattctggtgctgtcggaaatcgtgcccaaaaccataggtgcgacctactggcgtgaactcgctccccaagcttctctcgtgctgcgttggatggtatgggcgctgacgccgttcgtctggttctcagagcagatcactaagcgcctcgcgcgcaaagttgaagcgccaaagctacgtgacgagatctccgcgatggcgatgttggccaatgaaaacggtgagtttgcagaaggcgaatcaaaaatgctgaacaacttactggcgattcaaaatgtgccagtaacgcaagttatgacgccgcgcccggtactgtttcgcgtttccgcggatctaacgattgatgaatttatcgagcagcaccgcgatacgccgttctcgcgcccgctgatttacagcgaagagaaagacaacattgtcggctttgtgcaccgccttgagttgtttaaagagcagcaaaatggccaaggaaacttgctactgggtgatgtgatgcgcccaatccatgtggtgctcaacaccttgagcttaccaaaagccttcgaccagatgatgcaaaagcgcttgcaactgtcagtcgtggtagacgaatacggctcagtgcagggtttgcttaccttagaagacatcttcgagcacttgctcggcgaagagattatcgatgaagccgaccgcacaaccgatatgcagcaactagccaccgaacgctgggagcactggaagcgccagcatcgcatgatcgaaagccgcgacgaagtggaataaaaaacgggagcttacgctctaatgccgatcagttaagcaaaaaatgatcggttgaacgatgtaaataatgacggataaaggctcttagaattagcacttagagcctttatttttcaacttaccaacgcacttaatcttgccaaggctacgccacaataccgaccagcttggtgtggattaagtttttgagtgtaaaggcgcgatgtggagaacatcagagacaaaagaaaaccgtaaaatatttcatgtggcgtcgacaaagaagcaaaatagcagaaataagcttgagggattattgctcagtaaatgccccattaatcaacagggcgtttgcgaattattcagtgctaaagccaagctgcaccacgaatgccactgctgtctccaaatactgcttttgcaaaatgtacttgagctgagtcagaaaacacatgtcttgcagttgcagtgggtaaatctcgatacaactcatcaatattagaaagtccgccaccaagaacaattatatctggatcgagcacattaactaatccagcaaaactacgtgccatgtgatcaattagttgtgtataacaatgtatagcttccggttcttgttgcttataccgcttcatgatttctgaagcggtaatacattcacccgttaaagcttggtagctatcctgaaaaccacttcctgaaataaatctctcaatacaattctgtcgaccacaataacagtaccgtgctgccccatcctgttcgagatgatatccggggagtggattatgcccccattcaccacatatggcatttggcccaactaatacctgacgattaactacaatgctacccccgcaacctgtaccgagtatcgcaccaaaaacgaccatactttctttaccagccctatcgattgcttctgaaagagcaaaacagtttgcatcgttagctagtttgacctcgcgacctaaacggtactgcaagtcacttgataagtcctgcccattgaggaaggtacaattggcatttttgatcaggccagtaactggactgactgcaccaggtaggccgataccaatcgaatcaacaggttgggtggcttgctcagcatccacaatcagactacagacacaatcgacaaactgagaataattatctggcgttgcgatacgctgtcgatagagcatactaccttgcttatctaacacacatatttctatttttgtgccaccaatatccaatccaatcagcatgtagaattccttttgctctatgggatgctcatcatggtccgccatgctcgaaccattattaattgtatgctcgcgcgacacgtcctgctgcacttaagcagtatttttccgtataggcgggaataaagaccgattgccctttgtgtactgtaagaacggtgccgcaaggactaactaaagtagcatcgcaatcaattggcagtaaaatttcggcgctactaactgtgatattagcttgctgcggtcgtgggaaaatcgcgaacttaaaatccgctacaggcactgggaaactgagcatatctccttgttgaattggtgtgagcaataaggtggcttcagatttttccttaaatagagtgcatttagcaagttctaccacatcaatatgctttggagtgagcccagcacgcagcacattatcggaattagccatgatttccaaagctgtacctttcaagtaagcatgaggtgtgcgcgcatctaagaacattgcttcgccaggttgaagggttaaaacatgcagcatcaaaggcgcgaaaaggccaatgtcatttgggtattgtgtcgctagttcttcgattaaggcaaatataggttgttttgcatgcgatcgagcatagctaagcaattgttctaaaacgcgtctttttttttcaccacagagtgagagtaatttagtaaaaaagtgttcgagccctgtttcgttttggtttcgtttaaggtggctcaatagcgaagctatttcatcgatagccaaggcgctaaatagtgaaataatgtcacttaatggacgaaaaccattcatggcttgataattggtaagcgcgtaaaccagttctggtttatggttaggatctttatagtttcgatttgtagcgtttatcaaaattccttgggcattttcgcgagcaaatccttcctctgcttctgctttgcttgggtgaacttgaatcgaaagcgcttgatttgcagcaagaattttaaacaaataaggtagctcaccaaactgttctactgtttggattgagagaaagtcagtttttttttgttctattagagtactgagttttattttttctccagaaaattcgacgtatgagcaaccattcgggtgagtacccatccatacttcagcttgaggttctccctttggattaggaatgtcaaacaactggtttattgagtcaatactgccccatgcgtatgattggataacgttatgcataataaaaaatggagctggaattgcggtgttcatatatggtccctagtcaaaaaaatacttgcattataaactgcacatattcaattacagcatgcaatatcaaaacatttagattcctacctaaaatatagaaactgctttggcagaaaaaaatcaagatactacttccaaacgaaacaccaacaaagaaataggcttatgaacatcattacactacttggaggttggaaagatagtaaaataaacgaaaaagctgcctaagacgctttgggaaagatgactcaaattgtaagccatccttgacggataagaatttcccccctgtctattgaacaaaaattgtgttcaatagacaggggactatctctgagaattctttttcaatcgcgaggaaattacaactccaccccaatattgctgaccccttcttcgcgcagctctttgcgtaggtctttgatgaggtcaatgtcacgctcaaccgcttcacgcagcggacggaaaatcgcccactgtacatcccactcggcgcacacggcttcattctctttttggttatcgttggtgatggcttcaccggtttgtgcttcttccagttgagcgacggtttgtaccgaaatctggctcactttgatcatagattccgctaaatcatcacgatccaacaaaccatgcagcagggttgccaagccttcacaggcatcaatcgcgggatacacggcgtacaaatcaaacgcatccgaagttgggatcagctcttcgagcttttcaagctgatgctcaaagttcactttggcattttttaccgtcatcaattcccacacgctgtcgagaatgtcacggtagatacgcgcctcagcaaactgcgtgtgctcacagaacatagcgtaattcggatacatacgttcacacagacaggccataaaggtaatctgttgccaaggttcaaacttctcaagacgaagctgtagagggttttgtaacatagtcacttcaaatcgttgcggaaaaagacagcggaagtgtactggataaccataagggaaaaaagacgcgcctatgaacaatttccaccagctgtatattctgactgaacatgatgaacactaccgcgagcagatccttgagcgccaactggaagggctcgccttgaccgaagatcgcgccaaggccacgattttgttggccgcaccgccgatggccgcccgccgtttggatgagtttccgcgcttgcaatggctgcattccgcctatgccggcgtcgataccttgatggaccccaaactgcgcaaaaactatctgctgaccaacgtcaaaggcatcttcgggcacctgatcgccgagtatgtgatgggttacgctatccaatatcagcgcgattttcgcctgtatcaaacccaacaagctgagcgcctttggcagccgcgcccttactcttcacttgccaatcaaaccctagtgattttgggcactggctcgattggtagccatttagcccatgtggctaaacagtttgggctgcgagtggtgggcgtcaatcgcaccggcattccggccaaagaagggcattttgatgccacttatcacatcagtgagctgccagccgctttaatgcgcgccgacttactggtgaatacgctgcccaacacccccgcaaccgaagggctgctcaatcaagaaaatcttcgccactgccaccaagcgctgctgtttaacgtcgggcgtggcaaaacgttagtagagcagggtctgccggatttaattgcagcaggacacattcgccacgcgtttttggatgtgtttatcaaagagccactcgctcaagatcacccattctgggacaatccggcgatcaccatcacaccacacatcgcggcggtcagctttccagagcaagtggtcgatatcttcgccgataactaccaacgttggtgcgataacttgccactgcgtaatcagattgattttgaaaaaggctactgatgcttgagtcactgctgacggaaattcgccagtgcacagtgtgtgaaccccatttacccttgggcgcgaatccggtgatccgcgcccatccggcggcgaagattttaattattggccaagcaccgggcactaaggtgcaccaaacctccattccgtggaatgatgccagcggtgagcggctgcgtcagtggttgggtttagatcgcgaagcgttttactgcgaagaaaacatcgccatcatgccgatggggctttgctatccgggcaaagggcgcagcggagatttaccgccacgtaaagagtgtgcgccactgtggcatgccaaagtgctggaacaactgcccaatcggcaactcactctcctgattggacaatatgcacagcattattatctgtcggacaaacccagcaccttgaccgaaacggtacagcagtggcaacgctgggcgccttcggtcttaccgctaccgcatccctctccacgcaacaccttatggctgaaaaatcacccttggtttgagcaagacatcgtgccctacctacgccaacgagtgaagcaagtacttacatagcaagccgttagggtttgaggtagtatggcgcgcagattgattaaggagtaagccatgcttgaaacattaaccttgtggttacagaagtttgatattgaaattgaacgcgtgatccagcttgcggaagcgctcgggctgatcgcagccatttcgattgccattcatctcgtgttacaccgtggagtgctgctgtggctcaaacgccatacccaccatgagcaaagcgtttggcgcaatgctctgtttaaagagcacctatttagccgcgttgccttactgatccaaggtgtggtgattgcggtgcaaacccagttgtggctaagccctaacacctttgcttacgatgttctgcacaccctaacctcattgtggattgtggtgtttggcatgctggccacttactccgtactcaacgtgctggaactgctgatcagccgaacccaagtgggtaaaaacctgccgacacgcggcattttgcaaagcatcaagctgattgtgtttattatcgcggcgctgtttttcacctcaattttgatcggtaaatcgccagtgattctgctcagcggcttaggtgcgatgaccgccgtctttatgttggtatttaaagacccgatcctcggcttagttgcaggggtacaactttcggccaacaaaatgctctcggtcggtgactggttggaaatgcccaaatatggcgcagatggctctgtgattgatatcagcctaaccacagtcaaagtgcagaactgggataaaaccatcaccaccattccaagctacgccctgatttcagattcctttaaaaactggaaaggcatgcaagagtctggcggtcgccgtatcaaacgcagcattttgattgatgccaccagcgtgcattttttaacagaagaagagaaacaagcgctgaaaaaagcgcaactgcttgagccctacttggtcgagaaagagcaagagatcagcagctacaaccaacaaaaacattgggatttggcctgccgtatcaatggccgccgcctgaccaacatcggcagtttccgcgcttatttagagcgctacctgcgtactcaccccaatattcaccaagatatgacgctgatggtgcgtcagttagcgcccactcacgatggcatttcgctagaggtgtactgctttaccagcaccacagtgtgggtggagtatgagcgtattcagtcggatatttttgatcatatttacgcggtactgcctgagtttgacctgcgcgtctcgcaagcccccacaggcaatgactttcgcgctctgagaggctaaacaccgcccctccattcgcgcgcatcgatcttacccctcctccttctaggggggaggacgggagggggtatttcacaccaagccaaacagaaaatgcacaatataagcatccgcaagcgccaaatacccccaccctaaccctcccctaaggagggaaacaagcttaatcttgctgattgataaagagatggctcttgcacctcccccttctagggggaggacaggagggggtatttcacatcaaaccaagcttcccagtcaaagcaccgaatatccgagttgagtaagctcagccgcgaacgcttgcttggctggggcttcaccgtggatcagatgcacttgcttgggcttttcaggaatgccggtaataaagcgcagcaaatcggccttatcggcgtgagcggaataaccggacatcgtatgaatatgcgcgttgacttccacttcagtcccctcaatccagaccgaaggttgaccactttgaatactgcgcccaagcgtgccttctgcttgaaagccggccaaaatcaggtcagtgcgcttatccggcagcagcgcttttaaataatccataatgcggccgccctgacacatccccgacgccgccaccacaatcgccgcctctccggttgaggctaaacggttgaccaagcgctcatgggttcggtgatcttccaccgtaatacactgctcaaacgccaacggatgccgatgcatttgcagccgcgctttggcttctcgtccccataactgcttaaagcgacgataagaacgcgtcactcgctgcgccatcggcgaatcgagaataatcggcaagttagcatcgatttgctgagaaaagatgagctgctcaatatcaaagagcagctcttgcgtgcgaccgacactgaacgccgggatcaaaatcgcaccgccgtcagtcagtgagcgctcaatcatcgcgcgcagccgctgccctcggctctgcacatcctcgtgctgcttatcgccataagtggtttcaataaacagataatctgcccgctctggcgactgcggatcaggcaacaaaggcgtatggcttggccccaaatcccctgaaaacaccaccacctcaccattcggacgccggatttccacatacgccgagcccaaaatatgccccgcaggctgaaagcgcacccagagcgaatcagcacgcttaggctgcactgcaaaccacttttggtaatcttgcacccgcagcaaacggcgcacctcagtcagtacgcgctcactctgcttgggagacatccctaactgcagctttaaaccatcttccagcatcaatggcaccagctccgccgttgccgccgtagagtaaatcggctgcttaaggcccgccgccaataaccaaggcaaacggccaatatggtcgatgtgcgcatgagttaagatcagagcatccacatgccccagcgcaaactccacagccaacgggcgttcatccgccccttgaaacaagccgcaatcaatcagcagcgcttgcccatcggctcgcaattcatggcatgaacccgtgacactcgccttccctccgtgatgaaccacttccatgttgtttctcctgttttgcgccaccttgccgtggttagctcgcctcagcaacgcaccgagccaccaaactgcgagccaatcaccacaaactcagcgataagcaacagcccatcgacaaatcagtgcgtaaataactacatcgacaagagtaaaagccataacaatcgagccgtccaactggacggcttgattgttatggcttaacacgatcacccgctcccttgcctaaaacggtctgaatgatatacgtaaagtagttttttaaattcagcgtttgaatcatctgttgatcaagctctgcaagctttactggtgtcgacatatccacttcgtttacttgagccagtcccgtaatgccagggagaacggtaaacactccacgggattctcgttcagcaatcagatcttgttgattaaacaagcaaggtcgaggcccaactaaactcatttcacccttcagcacattgattaattgtggaagctcatcaagcttggtcttgcgcagaaactgaccgagcctagtgacagaagaagcaccaaccaaatgggttgccaccgacgccgtattttttggcatggttcgaaatttaatgagggtaaatggacgctgattcttaccgactcgctgttggcagaaaataggggagccagtatcaaaatagcccaaaatgcacacaatcaataacacaggccagagtaacaacagcccagctagagcaaaaataaaatcaagaaatcgaataaccatgtctttatcacttagatgattgagataagtagaaatttaccgtgcgcgctatgccctgttcgaaactcacaggtggcgaccagtgtagtgttttttgggtatgagcgatatccagttgtaagttaccgcataagcgctgccccagctctggcttacccaatagcctcagtaaccactgcagtccggtttgtggaatgggtaataatcgggggcgaatctgcattgcttgggcgatagttctaagaagcgtggtcaaagaaacgtcgtggttatctgaaactaaaaaaatctcccctgcagctttggggtgctggcaacaaactaagattagatcgactaaattgtccaaatacaccagactacgcatattccccaccgcaccaagaggtaagggaatttgctttttgacccaattcatcatagaaaggaagttagccttaaccccttcgccatacactaacggtggacgaatgatcacaacttcaagtccagtttctgctgcgagctctaataactgttgttccgcctcatatttacttaagccgtaagggtcagagggaatgtgttgatcatcatgctgaaaagcagacccagctttggtttgctcaccgttgactttaattgagcttaaaaagataaatcttttgactccagcagatactgcttgcttcgccaaattcagagtgccttgtgtattcacatcacgatacgctttaagggcatccgcttctgtttcttgcatttggtgaactctagcggcgcaatgaactacacaatcgacaccgactaaagctctctcccaatctgtatttggtgtgatatcaagcaatacctgctcaaatgaatagggttgttggctgcgcgattgcgcaaccagtgcataccctatattttgcgcttgggtgagtactcgcaaaccgacaaagccagatgctccagtcacaagtatttttaatggtgtttgattatctggttccatcttaccctatctttttacaaaactatgccaacgatcagcatcatgagtctggcaaacgctactcaagcaaactacaattcgggcgatactaatataacgcataacaatatcaacccgttgggttggctaattataaggcgagctgctaagcaatgtttacccctattcaactgctcttaagcgcacagcgtcatcataagcgtatgataacgttgctatatgatgtatttgcgctgatgttttccctttatgctgccatcgcactacgcttagatactttagcattcacgtttagcttcccagagtttctgagcatgatgacaacggtaggggtcactctctactgctttgtccgactcggtatgtatcgcgcagtgctacgttatatgatgctgcctgcgatcggctatatctttttgtctgtcatcatttctgcggtgacgctagcactaagcggctttttctttcaggcctttattccccgcagtgtcccctttatttatgcaggcctagcaacgctgactttaggtgggcctagaatttttattcgcaccatctattaccattattacaagcgtcagaaaccaaatgtttttatctatggtgcaggttcaacagggcgagatctggcctatgctctcattcaaggtgatgagtaccacccggtaatcttcttagatgatgatccagctaaaacaggacaaattatatttgggctgcgagtgcaccatagtagtgattttgaatcactcagaaatctttatgaacccgtaaagatgctgatcgccataaataatatcggtaaaaatacacgtataaaattacttgaacgactctctcattggcccattgagattcaatctgtcccctcagtggaagatattgctgcgggacgcgcaaaagcgactgatgtacaagatcttgatatcgcagatttgcttggccgcgcaccggttgaacccgacttagcgctgttacaaaaaaacattactgaaaaatccgtcatggtcactggagcgggaggttcgattggctcagagttatgcagacaaatcttggctcaaaaacctaaaaccttagtgttatttgagctcaatgaatataacttgtataccatcgatcaggaattacaagcgatcaaacagaatttaaaactcaacacgaaaatagttgcagcacttggctcagtacaacgtgaaaaccgcgtcaaaaaactcatgcaagctcatcaggttgaaacggtttaccatgctgcagcttataaacacgttcctctcgttgaagataatgttatcgaaggcattcgcaacaatgtctttggaacattagcctgtgctaatgcagctatagaagctggcgtaaaaaactttactctgatttcaacggataaagccgtgcggccaacgaatatcatgggagcaagcaagcggatggcagagctggtactacaagccctagccgataaaaacagtacaaccatttttaccatggtacgtttcgggaatgtcttaggctcttcaggttcggtcgttcctctattcaaaaaacagatccgcgcaggtgggccagtaacggtaactcaccctgatataatccgatatttcatgctgattccagaagccgctcagcttgtcattcaagctggggcgatgagtcataatggacaagtctttgtcctcgatatgggtgaaccagtaaaaatcgtcgatctcgccaaacgtatgattcatcttatgggcatgaaagaattctgcgatggaagaagtgatgaaggcgatatcgagatcaagtttactggcttgcgcccaggagaaaagctctatgaagagctacttatcggagagaatgtggaaggcactagccatcaaaagatcatgacagcatgtgaagaaaaactgagttgggatgccatggaagacctactcacggaacttgatgtatgctgtcataactttgatgttgaatgtattaagcgaattttacttgatgcacctacgggttattcgccacaaaaatgagaataaaatgaaagtattgcatgtatatagaacctgttatcctgaaacaaaaggcggtgttgagcaagttattcgatttatagcatcgggaacaaaaccgttaggaatagaaactaaaatacttacattatctgataatcaaacttcttcttattattgtgaaggaacagaaataatctcagtaaaaaaatcgattgaaatctcttcaaatggattctcgtggaagctaattagacaattcaagaaactttcaaaatgggctgacataatccattaccattatccatggccaaccggagactttctctctttatttggctcatcgaatccaagtattgtaacgtatcattccgatattattcgtcaaaagtgcttaaagaaattatatcaaccacttgagagtcattttttaaatcaagcaaatatccttgtggcaacatcaccacaatatgcacacacaagcgagaatttgttaaggcataaaaataaggtaaaaataattccacttgccgttgatgagaatacttatcctatcccatcaaacgataatattaataaatggcgagaaaaagtaggggaaggttttttcttatttgttggcgtattacggtactacaagggtctagatttcttacttgaagcagcaaaaatcaaccagctacctgttataattgctggtgacggtccggaaagagtaaaactagagtcttatattgccaaacacaatcttgaaaacgttaagctagtaggattcatttctgaggaagacaaagtcatattacatttactttctaaagcttttgttttcccatctcacctacgctcagaagcttttggtatatcacttatcgaagcacaaatgtactgtaaagccattattagtagtgatattggcacaggttcatcttatgtgaacatcaatggcgaaacagggttagttgttccgccagctgacagtcaaagcttttccgatgcaatgttaaaaatagaacatgatacaaaactttgtgaaaaattaggtattaatgctcgcaaacgttttgaacaggaattcacagcacatcgctatgcacaaagctatactaaactgtatagtgaactcttcggaaatgtctgttgaacttgcaatgacatacggaatatattaaattattttatgatacatatttaaaacagatattcccattaatatcctgcgttgctttattaaactcaggatgttcagcggatgataatggatgaataaaatatgccttacttccgaattttgagtttattatgttaaaaatctcatcaaaagttctattagacctctgtatatgacccattgcaaattcaaagcaaatataatattcaattccattatgcttttctgtgaattcgtaaatctggtttaatatctctatttctgcgccttcagcatcaatttttataactacagagttagtaggcgatatatctaaactacttaactttctaaccagaacttggctatttttaaccttatctgctatgtctgtatttttttgaaaatataatgatgacaccctattatcaaactcataaacttcgaaaatattttccccttcattctcacctattgcacagccaaaatgatgaaactcaactagtggattatttaattgaacattcatcctaatactattttccatttctgtgagtggttctatcgctataatttttccttgtgtaatatgacgagcagcgattccacagaaagttccaacgtttgcaccgatatcaatataagtggtgtcatgcttacaatgattaacaatccagtgacgcatacctaaatcaaagtttgggtttttgtagcttaaagcatggttcaactgcactctgggaaaacaatgccatccaaattcgctttcaagaattaaaaactctccattgtaaatgaagtttcgattatcatgaacagactttgactgaatagcatcaagctctgttttaattaatttttgtacatagttttttattagatgtttcattactacctcaattttaaataatattagcgtaaaaaataacatacagaatcaacttgcagatgcaggtttgaggacctgaaagggcattgttgaccaataatggatttgccattttattgacatttagaaggaatttcatccaaagcctttagcacggaaaccgcatgaacatcaccgtcacgtaaggctttcaagaaccttacttaggtacttttcgttcattgcgcagttcatccgtttacgtttgataccacctttaaacgtgggttcgctctttaataggttcaaacatatctgcctgatccttgcaaaggcctctgctcgatcgtccgctctaatgcgtgaattgtcctcacaaaatgcggtatcaagtgaccaatccatgacctctaccccctagtgagaacaagtcgcttcaagtaacgtttgagcttccaattctttagagcatatgtagtaacgaatactcacatcttgctctgttgcgactgccgattcttgtcgaattgaagccacggtgcccattgatttaagctcaggccattcatgttcaatatcacccaaaaccgacaaatcgcgattcactaaagccactctcgtttctattcttccgtgacttttttcttgtgtactataagaactaccgtcgaagtcgtgaagcatgtccattcgaagataatcatcaaaggcttgctcaagcattccctgattacctttgaccgccaataaataatccgcttctttatcaagaattttctgtgctattttcttttggcagcccattgcatcaatcgtaatcaagcagccttttacatctagtaagtcaagtagcttggggatcgcggtaatctcgttgctcttagaatcaaccttcagttgcccaatgctcattccatttgctgtagcaagagcgttcaccatgtggattgttcctttgcctttcgagcggtcataagagccgcgtaatgtttcaccgtcgatggcaataacttcaccatccgttagtgtatggcagtccttcatccaggtaatgaagcttctttgcaaagctacaggattaatcatacccatcacacgagaaagcgtatccgcagaaggcattccagcttaaaagtgaccatatcgtttaaggaaatctaagcgagcatgaccaaaatcgataatgccatcccagccatcgtgacccgacaaaacaccacatattgtcagcaaaataatgtctgataatttgtgttctactttgctttcttgtcgatagtctttaatgatttggaaatgcataaatgggttgattgactcgctcatatttaggctcctatattgtctaggagctattacaaaacaacagaaatgatctacaaggcgatcttaaatttcatcggattacatctaaaaactgagattaatgaagcattggtaacttattctaagcatcaccgcagcccttatatatcaacgaccttcatgcggtttccctgggtgtccaaacgatatgatatttgcaacgccaatagacgtgtgatgaacttctgtagtcgcccatgttatttgaatcctcttacttatggtgaataagagtttgtcttctaacatgggcgcattttcgggaaaaatgcccctaggaacaatcaccaccgctaaaagcggtggtttagggatgacaataaaaatcaagtatcttctgatacttttctacaaaataagtttcttttcaagctccaatggtttacgggcctttctgataaatttctgtattggattaccagaatatatatgccaatcatccaaagacttattcaccaacgataatgctccaactgaaacaccttctcccacaatgactttaggtaaaacaacacatccagccccaagtattgagtgctttttgatcaaaactgggagtgacgtaactttcgtaagctcttctggaacagttgggttactcatagccattccggtgtagtcatcagaggaagagtaaatagatactcttcctgatacacctacaaaatcttctagggttatttttccagcgcctatcaagctgctgtatactccaatatgtacgtgagagccaatttcgacgccgccgacacctgctgatatcgtgacataatcatcaattctaacgtttgaacctatagaaattcgactgatgccataaagtgaagccttttcagaaatttttacattctttcctaaagaagaaaaacccatttgtttcaatacatcttcactgtagtaaccgttaccgctcataattacaccctaagtttggaacatcgacttattgaaacgaatttttcttgagtctattctgttgagaactcacagcggtcctcctagagttacccaacgaaccattctatctagcgctacaaccccatcccatggggaatcaaaatgggtcatgtagccgacatctggacatcgcatcgcaccttttaacattatctcgttagcaaaacgaagacgcttttcaccattcatcgccaacccgaccgtttggatatcttcatgtacactgtcgactacatcaaatacattatcaactgcttttactgtaataacacgttgatatgtcggctcaacaagctctatcccttcatcaaacaacaccgtccaacgtaagtgcttgtcatgccaatattcgccaataaatgcatattccgctatctttgagcgaatcttatttgcttgcccaatgtctggtacttgagttggtaagcgtacaagagccttatccattgctgaggcaagcttctctgcaaactctttaggtgttattagaccgcccttctcaacaaaaatggtgtgcggagaagcgcaagcaaactgatcgaacacactagagtcagttgcagcccgacgaatcaactttctgattgccttgtcagagtctagagcatcgctgccaacaaccatcatagaaagcttaggtccaaagaggatatcttgactattatatttctttggaaggccacttacagactcgattgcctctcgtcccccccaagctatacgcacatcagcattggccgaaaacttctctgcaattttagtttggtgtcgatcaaaatatacaacagcgagagtccctaataagtcatcaccgtggatagtgtaaccacctggggtagtgtagctaaggcctttaaaagtcgccaataatactggcaaagcttgcgattcgcttgctgaaactttcagaatgttggcatttttacttaaaatactctgtaccagcgcaaacatgccgagtaacggtacgttacccgacagccagtgagatacgatacctcttggcattgctttttgagagctatggctaatatctttacgaggtaaaaaattatccaaaaaagctcgctgaccattcaatgctgaatcaagcaggtttttcaaacgattgggttcacaccaatcagctaggaagttcaatccagtatgtcgataagggtcaagctccggcgtactcgaccagcttttgcgcgcttcattgattaaaccaagaatagcttctaatggttggttagccagccatttttgcttcctctttaaagaacaaaagatttgatcaagctgctgagatgcggacatagtatcatcgagaaatatcggtgagtggtagatagtcaacctctcttcttgttgagaaagtggcttatacgatggctttttagtcaatttctcagacataacatcaccacagcctcttacttctgctttttttgctcgtccaatgactttgaatctttttccagctttaccacactcacaaagactttcttcaatcacaccaaggtcatctgtaagtacaacattccccggatatgaatgcggtagtgggcttacaaactcaagtaagcctactttacctggcccacacacttctaggttcgattcatcacgaataattacgtcagaataggcatgaatatgtttccatcctgctttacaatctgggtaattaagccccatctgttcagtgaaaccatagatatccacaacatcatcaggagaaatacccaatactgaggcgatatctcgattaaaggtaattttatccaccttctctgactcaagttttttccaaccaccaatatgaataacctgagaacctttaggcaattgaaacgagatccccttgtctttaagggtcttaaaaaccgtgtgataaagtacaaacgtgaatccaaaaattatgagcggctcttcactcgcaagtgaattcagatgttcaacaaacttttgctccagaaattcaagtggagcacttgggctatcagcatctataaaatacttcgatgttgaggcgaagtttaggtaaccttttaccgccgcaatacgagccccaaggttagtggcatttgggcttgtcggatcaatatccataatgcaaaacgggcgacgtttaggccccaacacctcctgcataactcttgccattgctcgagtctgtcgacgagcggttaccttatctaacaatatggtactgggtacgccactggtagcagaagattgaagcttcgcttttatcgtatcatcgcttaccgaagataatttatgtcctattgctttgaagatgtgcacaggtatgggtggaatatctgcaacctcaccatcaaataccaaagggtcaaatttgtttttttgacaaaatttgcgatacatctcgttgcattgataatgatgtactaactctgcaagtaagttcgctttaaatagtggagatttttgctcttctgataattcaaaagggcgagcatcaagtacactggtcagattttcgttatttacaggcattgcttcacaatctctttcacatcgttttctgtaaatcgaacaggatttgacttagcagcagggtcaagtaaagcattttcagcgatcgttgtcagctgttgttctgaaaaatgcatatcagttttctgttctcctaccaatacttcaaaaagttctaataatgcttctttattaggtaacccggatttatagatcaattgttcatacttagttgcagctgtatgttcgcggtaattaaagttgatcaccgcaggcattaataaaccgttcgccaatccgtggcctatattaaacgtacctagctggtgagcaatggcatgtgaaagaccaactatgcaatgattttgaacccaccctgcaaacatagcagcttgttgcagttcagaaagcatttcgctgctccaattatcattggaaaattgatgtcgatagcggtagattattgataccgcctgctcagcaaaagtattcatcaaagggttatcaatcaaagagacataaccttcaatggcgtgagagagagcatcggccacagttgttttcaataccttaggtggaacttctgaaaccaagtcaggatcaaggatcactaagtctggtaaaaaatcatgagtgacaactgcctttttgctgtttgtaacactatcaagcatgacagcagcggatgaaacttcagagccagcccctaccgttgttggtattgcagcaaattttgcgcgaccacgaagggatggcaatgcaaatggtcgatatagaagttctgattcaagagttgggcattcgtagaataaccaagcgagcttagctccatcaatgatagaaccgccgccaagtgcaagaatatagtctggcttaaaatcttcaagctctccaataactccagaaagttcctctacacttggttctccttgccaagagcgctctatcacccggacactttgtgcgttaataaggcgaacgacttgttcaaagtactgagaactcccaaaggaagggctaataataagtgcagctcggttagctactaaaccttttaacgccattcgggcattcctgccattagcgatttctcgggcgttacggaatacaggtagtgggaaacgtagttttagcatgaatgttcctattcagaagacagtttgtatctttgcactttccctgaaacggtctttggcaaagcactgactatactatattttttaggcctcatatgcatcggcaactggccatttatggtctcttttatatttgaaattacattttcgcaatcccaaccagattttacaacaatataggcttgaaccacttcacccatattggcatctgataaagcagcgcatgcacattcttgaacacctagagcttcggataatactttctccacctgatcagggcttacttttttgccgccaacgttaattatttcttttaagcggcctgttaaaaataggtagtccccaacaacacggcctaaatcacctgttttaaagtaaccttctacaaaacaatctgacgttaattggctgttctcaaaatagccatccaacatccatggtgctttaaaaacgatttcaccctcttctccttcaattacttccgctcctttattatcgatgatcttaaaatcagctccgcgatatctatgaccaaccgcgttgatatcatcattatgaaaatcaatgaaagttgctcgagacacttccgttaagccatagtgcataactacattagtgtttggaaaccactctgcgacctgctttttatcctcgaaagggaagtgtgcacttccgaactctataaaatttagctgttctgaatacttacgtatgaggtctttggtcattaaagtaatatatgaccaagccgaaggaacgagacctagccctgtaactttgtaaaactctatagctttgaataccgactttaattgcttaaaagagcagccaactacgatagcaccacctgcaaataaactagtcctcattctagccatagcaaatgagtggcttagtggcattaacaaaagctcaacatcttcattggtattttttacatgagatataatgtgttcagttgctaacactaaacttttatggcttaacaaaactcccttcggctcaccagtagtaccactcgtgaacataatatctgcgatccccctcgcctgagggggaaatatattatcaaatgtataactatctatgtttctaataaaatcctggcttttttcaataaatagttttggatttactttatcttcaataaaagacacgtagcttacgtctgagtcaggagcaacattaacaaatttagcaccgacatagtgaatagaaaaataaagcagtatgaaactatagctattattagatcttacaagtacagcatcctcagatgttacacctaaggatactaacttggcagcagttttttttatatccgaagcaagattttcataactaattgttcgatcattttcatagaccgctatacaatccggtcttgactcggaatggttaaatattctctcaaccacagacataatatttactcgttattaattacagcatcgataatatcttcaacatcttctatttcaagaacttgttcgatatccaaaactactcccaaatccgattcaagagccgcaattattctcatgtgagctaacgagtcccattcagggatatcaccaacggcaagttctttattaataataccaatttctacttcaagaattcctgcaataagattgataattttttcttcagagatagacatataaaccatccaatatagttaaaagattgtattttttatctagttgattattttttgacactgtttaaatagtagtcaatgcatgattgtggtgttccattgaaaacaatttcacctttctccattacaatagcctgatcacaatattgtttaatagcatttaaatcatgagaagacaaaacaaccattcttgacttcttgatcagactttccaaacgtgataatgctttctcacggaaagtttcatcaccagccccaataacttcatctaaaatcaatatatccggagtgaaatgtgtagaaattgcaaaagccaaacgtaagaacataccggtagaataagttctgactggtagattgataaattcgccgagttctgaaaaagcaacgatttcttcaactgcttgttgcgcttccttaaatgtacatcccataaatactaatctaaattcgatattctttagacctgttgcattgggatccattccaagagtgaagtcagtcaatgctgaaatctttccttcgatagtaacctttcctgacgttggtggataaacctgagaaagtaacctaagtagagtcgttttgccagcaccattatgcccaataatacccaacctactgctatcttctagctttagattaatatctcttagtgcatgaacatacttcatttctttatcttttgcagaactagaacccagtacaccaccaattttgctggatattgttgtttgcaaagaatgtgagaaatgccctggcacagggtagtgcaaattaacattagatagctctatcatactacacccaaaaaatgacttttttatcgagtactttgtacgagaagtagctgaccataccaattataaaagtccatgctactaacgaaacaaatgctaaaggattaacgtcgattcctattatcggatttctaattaattccaatagcgaagcaaatggatttatgtacacatagttttgatattgttcgggtagaaagcttactttccacatgacaggacttacaaagaaagctaactgcatcaaaagcccaatcagctggattaagtctctaaatctcgttgaaataacagcacaaaaatagctagcaaataggacgaaaaacagacttaaactcaacgaaatgacaaacataaaactaaattcaaagtttgccgagctagaccatatgacaagcaaaaatatggttggtatattatgaagaagaatcagcacgttccgatatatgtgagcaccgactgaaagcataaaaggttgcctatcatttaggtatactcgagcatctgcaacgaagattcctgtgctttcgttaattgtttgagtataaaacaagtaaattatgtgtccaacaccgacatatggtaaataatcatctactcccattctccatattaaagaccaaattagccctatacagagaatttgtacgaacattgtgatgcttaaccaagtttgtccaaatttagaccgagagtatctacttctaagtgtagaaacccccaatagatgcacaatacgccaattataaaaaaccgaaactatatctttaagcattttcattcccaaaaaatacattttcgtagttacttgctgattctttccaactaattttcaatctattaattgcatctatattttgtctcatatattcctcagagtttatcaatttctcaattttatcaactgtttctttcgtatttacgaaatttgaggataacaaatcaacatcaaagccttcttccgccatttcattgacatggcgaccagtatttatcaaagatggctttcctacagaagaggcctcatattgcggatatgcgcctaaaccaccttcgacattacttggatgcaatacaatgtctgacattaaatagagagaggcatgtaaataattatccacacgtgtaacttcatggattctctcataaagtgatggataccgctcttttagtttcgttggaacgttgcaagtaaaaataaaatcgtagttatctcttcgtaaacaaagctcattgattagcacgaatagctggtcaaaacctttatatggtcggttttgggttgatatgagaacaatttttctattggaaaccttatttttcgtaaggagtctccataatacagaaaaattcagctgatgattaactaaagcttcaaatgccgccttcttagaggctcctgaaaactcgcttttactccaaacctctgaaaaggaaagattactttgttgctttttaaactcagaataatctggagaaccattatagattacatttatcttcgaagattcaattcccattactgtttctaaatagtctttatttgctcttgattgagtaataatggcactcgcgttagaaaaatgcttactcagtttctttacaaaatattcagcagtcaaaggaaattctttgttatactcgaaaacaaacgggtcccagaatgaaacgaacttttcaccacccaaaagatgagtatacgggatgattggagtaggtagccaaaccctacagttattgcttgagaatcgcccccttctttgtagatgagagtagatatataaagataataaatattcaagttgggatacatacatcccaacctttcggaaaatcgctgggataattggcagttttgcaattaccaaatcccataaactatctttttcaacttcatttagtgatacatatcctatcgtttttttagtagacttaccccgaaaacctaatgtgagaacagatatattagggttacttttttccagccccactaacatttcggcatgtttactcgagactacaatttcaattttacgttctggcgagatgtttctaacaatattttcaattgtttgagcaattccctctccacgccaagatgaattaggaggtaagggaacccaaactactagcttctttttttctgtcatgacattcaaatacagttgaaataatttttaatacagttgcaaatttcttttacttgatcatcgcataaccctggccaactgggtaaattaatacctcgatgagagtagctatttgataacggaaaagctgtcttttctgccaaatgctcgtacattggcagcgtgtgagcaggatagaaaaatggtctagactcgatgtcattattttctaagaaggtcatcaacccatcgcggtgcacttcaaactcttggtctaatataatagacgtcaaccaatatgagtggaaagttccattagactctttgtgcacttgcattggtagtccagcgagttcagacctataaatttcagctatatcacgcttgcgctttataattttatcaactctttcaagctgagcaacaccaatcgcagcacatagattcgtcattctatagttatacgcaactaggtcatgccagtagcgcttccctgccactaccccttggttttttaagcgtaaacatttatctataattatgtctgagtttgacacaaccataccaccctcgcccgatgtgatggttttatttccaaagaaactaaacgttgacacatcgccaaatgtacctacttttttgccattaacagcagtacctattgcttctgcacagtcttcaattaaatagaggccgtgctcatcacacagatctcttaaagattgaatatcgcaagcttgtccatatatgtgaacggccataactgcttttgtctttttatttattttacgtttaacgtcctctacgctcacttgtagagactcaccttcgatttcagcaaaaacgggtaacgcaccacactggactatggtattaaccgaggcaacataagtgaatgttggtacaatcacttcatcgccttgagttattcccaacgcgctcattgccaaatgtagcgcaactgttccattagatactgttgtggcgtgctttacttttaaaaactccgcaaactcagtttcgaagcgatcaatatatttcccccttgaggatacccaaccggaatcaatgcaatcgtttagatatttacgctcatttccatccaaacttggttcgtatacaggaatcatttaaaggacctcactctacagatacatttacgttatagccatgttttttcaatagtgcatgactttgagcttgttctaaatcagaagctaccatttcagaaaccatctgttgtaaagtaatttctggcacccatccaagctccttcttagctaggctaggatcacctaacagcgtttctacctctgcgggtctaaaatatgcaggatccacagctacaataatgtcaccaaccttgattgcaggagctttcgttccaataactgacttcactacagctttttcatctacacccttaccgacaaattctaactcaatgcctagttctcgtgctgacatatcaataaactctcttacgctatactgtacacctgtagcaataacaaaatctctaggttcatcttgctgtaacatcatccattgcatcttaacgtaatctttagcatgcccccaatctcgaagagcgtccaaatttcccataaaaaggcatttttctaacccttgcgcaatgtttgccatcccccgagttattttgcgagttacaaaagtttctcctcgtctaggggattcgtggttaaaaagtatgccattacacgcgtatattccgtacgattctctataattaattgttatccaatacgcatacatctttgccacagcataagggcttctaggataaaaaggggtagtttctttctgaggtatttcttgtactaagccataaagctctgaagttgaggcttgataaaacttagtttttttcgtcaaacctaaaaatctgattgcttctagtagccttaaagttccaatagcatctacgtccgctgtatattccggtgactggaaactaaccgccacatgggactgcgcgcccaagttatagacttcatctggctgtacttccgctaatatacgagtcaagttagaggaatccgtaaggtctccgtaatgtagtttgaaatttacatcttcctcatgtgggtctttgtaaagatgatcaacacgttgtgtattgaataaagatgaacgtcttttaattccatgtacttcataccctttttctagcaaaaactccgctagataagaaccatcttgtccagtaatgcctgtgattaacgcaacttttttattcattgttaaatatccaatttcttaattaatttagtaagctcttcaactttatcattcatcaacgcgatattttgtttagattccacattcaatcttaataagggctcagtatttgaatctctaagattaaaacgccatccttcaaattcaagagagataccatcaatggcagagaaatgtatagaattctcgtaataatgtaaataaacttgctccattattagctttgcctgcttgaccttaaaattaatttcaccgctacatggaaacaaaaatctttttgcagatatcagcttagataagctaatatccggggctaaggaaagtaactctgtaatcagaagccacggaatcatccccgaatcacagtaaccgaaatcacggaagtagtgatgggcactcatttcaccaccgtagatagcatcttctttgcgcatacgctcttttataaatgcatgccctgttttagacattacaggcacgccacccgacttagtcaccacatcaatggtgttccagcttaagcgtggatcatgaataattttggcaccttgctctttctgtaaaaacgcttctgccaataaacctacgatgtagtaaccttcaataaaatcgccattttcatcaaacaaaaagcagcgatcaaagtcaccatcaaaggcaatgcccatatcagccttgtgctcctttactgcgtttgcggtatcagcacggcattcaggtaacaatgggttaggaataccattcgggaagttaccatcttcttcatgatgcactttgataatttctagcgggatactcaattcaataaatcgtttttccaactcatcaatcacgtggcctgcagctccgttacctgaattgatgaccaacttcattggtttaattttcgcgggtgtaatataagatattaagtgatctacatattctggaagtaaagaaacctttttgtagttacctttaacttcaacgtccataaattcattcttttcagccaaagcttgaatttctcgtaaaccagtatcaccactaatgggttttgaaccttcacgaaccagcttcataccattgtaatccattgggttatgacttgcggtaacttcaataccaccatcaacaccaaggtagaaggttgcaaaatagatctcttcggtaccagtaacgccaatatcaataacgttaatacctgcatccattaagccattagctagtgcttgtttaagcgcttcgctggttaaacgaacatcaccacctaccacaactgttttatctgcgtcattttcgctttttaaaaactgcccatacgagcgaccaattctgtaggcaatttcattatcaagctcactccctaattgtccgcgaatatcgtaggctttaaaacaagttaactctttcactcttatttatcctcgaaacgtactacatcatcttcgtttaggtatgaaccggattgaatttcaataagctctagcgggatcttacctgggttttctatcatatgatttgtaccaatagggatatacaaggactggttttccgtgattactttaacattaccttcacaagttaccttggcagtaccagagaccactacccagtgctctgctcggtggtaatgcatctgcaatgattgctttttaccaggctcaaccgtaatacggtttactttgtaacgctcgcctttatcaatcgcatcagatttaccccaagggcgataacgttccctgtgttctcgatattcagctcggttttctgccttcaaatgttcaactatcttcttgacttcttgtacttggtttttgtctgcaactaacacggcatctttagtttccaccacaacaatatctttcaagccaaccgcagcaaccagtttatttggggcgtagatataacaattagaggtgccacttaaaatggcatcaccttggcatacgttaccgtctgcatctttatcagatacttcccataatgcagaccaagaacctacatcactccatccggcatccatagatactaccacacctagtttagtgtgctccataacggcatagtcgattgaatcatcaggacatttaaggaactcttctacaccgacacgaataaaatcgtaatcgtgagaaaggccttgcattgcaagttcacattggcgatagatctctggagaatgttgcttcaactcatttaagaacacggaagctttaaacataaaacaaccactgttccagtaatattcaccactggctaaatactgctcagcaatatttaactgtggcttttcaacaaatgagttaatttcataagtgccttgtgtaacctcttcaccccggtgaatataaccataacctgtttcaggagtggtgggaacgataccaaaagtagcaagtttaccagcctctgcctgttgagctgcttgtgaaatagcagcctgaaatgcacttttattttttacaaaatgatcggcagccaatactagcaatacggggtcatcctcctgttcgattgccgtaaatgctgctaaggcgatcgcaggtgcagtgttccttcctgctggttctaagataatgcgagactttttgccataacgacgaatttgttccgcaacgataaaacgatgatcttcattcgaaataacaatgggttcagcaataggtagcccctgtaaacgctcaatagtggcttgtagcatagtatgctgactactgctatctaaggataagaattgttttggaaaagccgaacgtgaaaggggccaaagcctagagccggagccaccagccataattacaggtataaacatctttctctcacaacaattagttttatgattttatttgttctcaaacctagattagagcattgttgaaaagctgataaaccattgatagaaatggaaatacttagccaacaaaataatctatagatacgttaggagcattaagcaacacaggttattgataatatagtggtagtttatagccatcttaattatcaataacaacttatgctattgggtccgacagagtgaagaacatcagagtcctgctgttatcattcaagtatgctaccgcccttgggtctcgctcccaatagcgttctgtaggatctcttttgcaacgaagtctaaaccaaaaccccttacagggcgagccctcaaaaggcggagcttagattttgtgattacagtaagaaaatgacaggctataatgcgtgcaactgttcgcatctataggaattcataatgattatcgtaactggcggcgctggcatgattggcagcaacattatcaaagcgcttaatgagcgcggtatcacagacattctggtcgtcgatcatttgaaaaatggtcgtaagttcaaaaatctggttgacctacagatcgctgactacatggatcgagatgacttcctagctcagatcatggccggtgatgattttgggttcattgacgccatttttcatgagggagcttgctctgcgaccacagagtgggatggcaaatatgtcatgctcaacaactatgaatactctaaagagctgctgcactactgtttagatcgtgaaatacccttcctgtatgcctcttcagcagccacttatggtgaaaccgatacctttattgaagaaccgcaatacgaaggtgcactcaacgtttacggctattcgaagcagcaatttgataactatgtacgccgcctatggctagatgcaaaacaacacgacgaaaccctatcgcaaataacgggatttcgttacttcaacgtatacggccctcgtgagcagcataaaggctcgatggcttcggttgcctttcatttgaacaatcaaatgaacgcgggtgaaaatccaaaattgtttgctggcagcgagaacttcaaacgtgatttcgtttatgtcggcgatgtcgctgcggtcaatttgtggtttttagatcatggcgtatccggcatatttaactgtggtactggtaaagcggaatcgttcaacgaagtggcgaaagcggtgatcgcattccatggtcgcggcgaagtcgaaaccattccattcccagaccatcttaaaggtgcttaccaagagttcactgaggctgaccttaccaaacttcgcgctgctggctgtgatgtacagttcaagagcgtggctgaaggtgtcgctgaatatatggcgctgattaatcgtaagtaagggaaacccttaaaccctcctaacctcccccttaaagggggaggaacaaagggattgcctctttgtagaggggatagatgaattaccttccaaaagagaatatgtaagaaattagccctgtaaggggtgtattatcagatgtggaaattggagtttagatgaatattttgatggccctatcccaactcgaagtaacgggagctgaggtgtatgccactagtgtaggtaatgagctcactcgacgtggccatcaggtattttatgtttccgatacgctcaccaaagctcacgatggcctgttttttaaactgcgctttaataaacgcagcatcccgcggcgcttttggcatgtcgcctatctggtttacctgatcaagaaacatcagatccagttagtccatgctcactcacgagcatcaagctggagttgccatattgcctgccgcttgactaatacaccaatggtgaccacggtccatggtcgtcaaccggtacatgtttcgcgcaaaaaattccatgcaatgggagataaagcgcttccggtttgtgaagcgatacgagagcaattaatcaaagatctcaatgtaccggagagccaactgcacgtaagccgtaatgggatagaaacaagtatctttaaacgcagcgcagcacccaataatcctaagccagttatctctatcattggccgactcagtggccctaaaggtgaactttgctataggttgctaaccgagtgtttagacctcgaccgctaccaagtacaagtgatcacaggtacaccgttaactgagcgttttagcgcactgcaagataaagtctcatttcccggctacagcgccaacgttgaacagatcatggctcaatcagatttggtgattggtgcaggacgagtcgcgatggaggcactcctatgtggccgcccgacccttgcgattggtgaagcaagctgcgtggggattatcgaactggataatctaaaccaagccatggcaaccaattttggcgacatcggtccacacgatctggcgatagatttccagcaaatccccgctttgattgagcaaggcctaagtcaaccgcactgcactcaagagatcactgaacagatcaagcttaactatgatttacaagtgattgtgaatgagcttgaaaacctttatcaaacgttttatgtcaacaagttacaacgagaagtccccatcatcatgtaccaccgctttattcgtgatgacagcgaaaaaggtgtacatggtacttatttgcatgttcagcagcttgagaaacattttcagttgcttaaaaagatgggctttgaaactctgaccttcaaagatctctctgagaagggatttattcatcgcttacaaccaggtaagcgttttatcataattaccgtggatgatggctatcgcgacaactatgacttgttactgccactgctcaaaaagtatcaatttaaagccgtggtgtatgtggtgactggcgagaattttaatcgctgggatgtcgaagtgagtgacaaccctgaaaaagtggtccctttgatgtcaccggagcaagttaaagcgttacatgactctggattagtagagattggtggtcatacgatgactcatccctttttgagtaagctcagtgaatcggaacaacgcgaagaaatattgcgcaacaaactcgaacttgaagcgctaatcggagagccactgacctcctttgcttatccttatggtgaccatgatgcaacctctaaacaactggctcaggatctgggttacccatttgccgtagcgaccaacagtggtccacttttgatgcatcaagatccctatcaaattcgtcggattgcgatttttccaagaaccgacacttttggtctgtggcgaaaagtgaaagggaattatctatttagaaaaatgaacaaaaaataataagaggttgcagatggctggctttggtttaattgcaaaattacgtaataaaattcgggtaaaacctaacaacaagattcaaataggtaaaaatactcgtatccgctattgcgacatttatgttaatggtaataataaccaactgattatccataatggtgcaaatttaaaaggcgtctctatcgagctcaatggcaacaattgcctcttagaaattggcgaaaattgcgtgattggcgaaaattgttttttatcatgccgagaatccggaacaaaattagtgattggtaaggaatgtatgttttcgcgcaatgtaaaactaatgaccagtgatggacatgatattttacgtgatggaaaaaggattaatccggctaaaagtatttatataggttctcatgtatggcttgcggataacgtcactattttaaaaggagtggatatcggttctggttcgattattggcatcaattctacggtaacaaaatcgattggccagtattgcattgccgcgggcaacccagcgagaaaaatcaaagacaatattagttggaacacgaccctgagctattaaaatgaataataaaataactaaaacctcaattttccttactatctcactacttttaattacaccgggattttctgttgtagcggtaggattactgactctctactctagtgttaaattaattaaaaatggcttaaaccttaataaattcgacattattcctcttataaccctgagtgcgtattttttgtcaaacttaccaattaccattattgatggtgatactttaagatatttagatgcaggcattcgtgctctgttatgtatacctatgtactttttcattaagaatgaaatttccaaaggcgcaaatttagataacacactatgcacatcaaccatattggcttcttttggtgctttagcgtttgctttttatcaatttttcatattaaacatgccacgcgttgatggttttctatttagtatcaacttcggttatctcgcagcagctttagctatcttatcttttggcttgtcatttacacaaacaagattcaaatattatttgtatctctcagttgtagctgcaacagtggcgacaatcttaaccttaacaagaggagccattttaacgctactctttgttttcatcttgttctttatcgtcaatgtaagaaaaataaaatttaagcaaacccttgtttttactctaatcagttttttattagtctcagtcagttatcaattttcaccgcgtatacaagaacgggttgattttacaatttttgaaatatccagcattgccagtaacaatattcacgctgcagcttcatcaggggggcgacttcaactctggtatgccgctgttgaagcatttaaacacaatccaatttggggtactacgtattcggaaagagaaagcttaaatattgaactttttaaagaaggaaaagtggatgaatggacgagcacggtgcccagaggtcatgcacatagccagtattttgaagctatagctagtaatggaacattgggaattctggcgattttcgcgatgcttatcttaccatttggggtatttttaaacgactatcgaaaaacaggctctccaatcagccaaactggatacctttttgcctttgggtttatcattttctgtttaactgaagcaccactacaagccaaccttattggaactttttatggctttatggtggcaattttttatgcttacatcgcagccaaaagagcaaaaaattgatgaaaattcttgttattggcccttcttgggttggcgatatggtcatgtcacaaagcttgtaccagcgcctaaaacaacagcatcctgatgcacaaattgacgttttagctcctgcttggtgtaagcccattttggaacgcatgcctgaggtcaatcaagcgattgaaatgaccataggtcacggtgctttcaatctgcttgggcgacgtgcgattgggtgtgagctgcgcgataatcggtatacccatgccattgtgctgcctaattcagctaaatcagccttgatcccttggtttgctaacattccaaaacgtaccggctggaaaggggaatttcgctacggcttactcaatgatttgcgcccagataagcgtgttttccaatatatggtggaaaggtatgttgctttggctcacccaaaagccacaatgcttgccgatgtttcgttagaacattgcccaagacctaaactcgtcatcgacgccatcgtgcagcaagccgctcgacagcgactcagcttagtctcatcacgtcccgtcattggactctgtcctggtgcagaatttggccccgcgaaacgctggcctgatcattactacgctgaagtcgctcgttatgctattgagcaaggttttcaagtatggctttttggctcagcaaaagatcactccgtcaccacccaaattcaacaggctttaagtgaagaacagcgggaatactgcgccaatctcgccggagaaacctccctcatcgaagccgttgatcttcttgcagcttgccatactgtggtcagtaacgattctggtttaatgcacgtttcagccgctgttggttgtaacattgtggcaatttatggttcaagctctcccaaatatacaccaccactgacggataaactggcagtcgtacatacagagatcgaatgtcgtccgtgctttaagcgagtatgtccgttagaacatttaaattgcttaaatcaactaaaacctgcacaagtcattaaagctttagataaatttattggaaaagattcatgaaacacctctggtttgaaaaaggtgcttatgcttcgaaagcggcacgccaatacttaaatgaccattttaaccctctagcagttaagaaaaccgctgtcattcgtcatgcagcgcttggcgaccaagtcattgtgcgcccctttttagttgaggctagaaagttctttcctaatgccgaaatcaccttggtcaccgtgtcaaactacctctatggaaccccctcagacctagcggacaaaacagtaataatgaaaagccgcgatgattcaaaacagctgtcactcaggcaaaaatggcaagactataaccaactggaagcacaagacattatctttgatgtggcaggaacgaatcgctcttactggatgacattactgactaaagcgaaactcaaagtgggctttccttacaaaccctttttatgtggcactttgtataacttggcagtctttcgctctgattttcaaccggaagtggaatgcatgctcgacatgctgaaaatccttggccacaacccgagttatccgcttgattttgcttaccctgacaatagacaaatctgcgatcatgccgctccgtatatcgtctatttcagtggtgcctcccaactgcgcaaaattttaactaagcctgagatgcgggcagtgattgagcaaaccattcaacaacaaccgaatgtgaaacatgtctttcttgaaggaaagaatgagtttgaaaaaggtgagtatttacaagacctagccgacaatggctcgttaacgattcaaccatgtttgcctcttgatgacttagtcaccttcattgcgaaagcgactctggtgattgcccccgatacgggcatccgaaacgtggcaatatcaactcacacaccaacggtgggaattttttatgctacggttccctttcgttacacccctctctatgaagcgcatactatcgtgatgaatgcgaatggtgaaaagccgtctactgagcaaattacctcagcgattgatacaacattaaaaatgcgcttggctgcagccaaaaacacacaggaacaatgaatatgagcaaagtaaccgtattgatcgccaaccgactgattcgtctgactggcaacctatttaaaatgctctcttacccatttcattgggtgtttccaaagctgcgttttacgattcccgcttactcaccagctaagctaaaaatgcgcgccaatgccaccattccacgcactatttggcaaaccaactttaccgatcaagcctcactaccggtttaccttaactatctgtttaaccgcctcatgtcgctcaactgtgactatcgctatgtgagtaccgaagcacgtggggaattcttaaaagaacatacatcaccagaagtttatgatgcttactctcgcctcactaacggtgcagcccaagctgacttatggcgtttagtggtactcaatacctatggtggtgtgtatatggatattgatgccacgctagtatggccgctcgataagctgctcggcgactcacaagagctgtatattcgcattaaaaataataccgagatcactaactacttcattgcaactgcaccaaacaatccagatctacaggccaccattgaacaggtggtttataacgtgaatcactacgagccttccatgggggtgtatcactccacaggaccaacggtactcaataacatcttgtcagctaaagcggtgattcacactcaagaccgtaaatacgtatgtattcagggcacctttaccaatgaacacttccagtacattgataaacctcgtggtaaatggacacacatcaatcccgaagatctcgtgaaaaaataatgctgctccgtacgctttatacgcttttactcactttagctgcaccgtttttactgtatggcctctatcgccgtagacaggggaaacccagtgtcggaaaacgttggaaagagcatttcggcattaccccaccactaaaaaccacaaccccaccgatctggatccatgccgcgtcggtgggtgaaaccctagcggtaacgccactcataaaacaaattaagcaacgttcaccgaatacaccaattctgctgactaccacgaccccgacgggtgctgaacaagcggaaaaattggcggattgggttgagcatcgttataccccgattgatttttcctttgcggtgagaggctttttgcgtcgtgtacgaccttgccaattgatcatagtggaaacagaactgtggccaaatactctgcataccgttgccaaagcgggtttgccgattacactcgtgaatgcacgactttcggaaaaatcctatcgcggctatcagcgtattcacccgttctttaacagtatggcgaaacctctcagcctagtgttatgtcaatttgcagacgatgcgcagcgttttattcagctcggtgtggctgagacaaaaatcaaaattaccggttcgattaagtttgatatcaacatcacctatgaggtgattgctcaaggtgaagcgctcagaacggctttaggtaaacatcgtccagtctggatagccgccagcacacatcaaggtgaagatgaaattgtgcttgcggcacatcaagaaatcctcaagcagcatcctaatgctttgttgattttagtgccgcgccatcctgaacgttttgcggcggtgcataagctcgcagctagccttttttcagtgcaaactcgtagcagccaacaaaccataacctccgacactcaagtgtatctcggcgataccatgggagagatgctggtcttgctcggcgcttctgatgtgtgttttatgggtggcagtttagtgggcaaaaaagtcggcgggcataatttgcttgaacctgctgcactggcaaaacccatcgttacaggccctagcttttacaactttaccgatatcacccacgcactcatcaatgcacatgcctgtgtgattgctgaccaaccagaaaccattgccaagcaggtgaaccattggttttctgatgctcaagaacggcagcaatgcggaaaaaatgccttagcgattgtaatgcaaaatcgtggagctctcgaaaataccttgaccgaattaggttttactaaggaattcgcccaatgaaaaaattgatcgtcgacctcgacggcactctcacccaagctaatacttcagattatcgtaacgtgctacctcggcttgatgtgattgagcaacttcgcgaatatcaccaactagggtttgagattgtgatttcgacggcgcgtaatatgcgcacttatgaaggtaacgtcggcaaaatcaatatccacacgcttcctatcattactgagtggctggataaacaccaagtgccttatgatgaaattttagtaggaaaaccttggtgtgggcacgatggcttttacattgatgatcgcgccgtgcgcccttccgaatttgcctcgatgaatttagaagagatccaccaactctttgagaaggaaaaatcatgttcctaattatgtctggtgcctatgttggccaagagttggaatctgaatttgggcgtattcctccgagttttctgccgttaggcaatcgtcgcctatttcagcatcaagtcgctttggcaccacaaggcgtaaaagtctacctctctttacctgagtcttatgtggtctcagagattgacctccagtggcttgaacaaaatcaggtgacaattatcgctacaccagatggactcagcttaggggcatcactggtggcggcactcaatattagtgggcactcactcaatgcaccactgcacatcctctacggtgatacgctatttaaccaactgcccgttggcgatgatatcgtcagcgtttccacggcaaaagacagctataactgggccgtattaactaatgatgacgtcgattggctacaagatgccaatacgcccatgagtcacgaaagtcagcgaattatcgatggttacttcaaattcagccacccacgggaactggttcgttgtatcacacagagtgaatggaagtttattgcaggcctcaatcgctatcataaaagcgtcggcttaagtgcggtcaactccatcggttggctcgattttggccatgtgaatacttactatcactccaaagccgaattcaccactcagcgcgcctttaatgaactgaccatcaccgctaaatggattgaaaaatcgagcatcaaaaaccaaaaaatcgccgctgaagcttactggtttgacaatctgccgatggcgatgcgtggtttcattccacaatatttaggcagccaaaacagcgaggggaaaatttcctatcgcttagaatatctctacctaacagcactgaacgagttattcgttttttccagattaccgagccaaatctggcagaaaatcttagctagcgcggtggagtttttaagcctatgccttgagcaagcagtcgagcccaatgctcctatcaatactctcgacatactgtttgccgataaaaccgctctacgcctcaacgaattctgtgcagcgcgacacatcactttagaagatcaatggcagtttgctggacaagatatttcgctagcgcaaattctacgtgatagccaaaaacatctgcctgatggcaaacctttgctaggggtcttacacggtgacttttgctttagcaacattttgtatgacttccgagccaacaagattaagacaattgaccctagagggatgacgcctgacgggcagaaaacactatatggtgatatccgctacgatctcgctaagctgagtcattcgattcttggtttatatgactggattattgccggttactaccatgttgagattgccgataacgcgatcgaattaaagattgccgaacagagccatcataaagagacgcaacaaggttttatcgaacttattgaacagaccttcggtctcacggcgaaaaatctctacgcgatgcaaattcaactattcctctccatgttgcctttgcatgccgatgatcgtcgccgccaagatgccttatttgcgaatgcatttcgtctccatcaaattttactgaggcttgatcaatgattgtaatcccaatggcgggaatgagttctcgcttctttaaagccggctatacccagcctaaatatatgcttgaagcccatggtcaaaccctgtttgaacactcggtcaacagctttgccgcctattttgctagcactccgtttctgtttattgtgcgcaatgtttacgacacagcggtctttgtgcgtgaaaaagcgactcaacttggcattaaacagttttacattgctgaattgcataccgaaactcgcggccaagcagaaacggtgactttggggttagaggaattagcaaagcaaggcgtggactaccaaggctcgatcacggtgtttaacatcgacacatttcgtccgaattttgtatttcctgacattagccaacacagcgatggctacctagaagtgtttcagggcggtggtgacaactggtctttcgccaaaccagaacatgctggcagcaccaaagtgattcagacagccgagaaaaatccgatttccgatctctgtagtaccgggctttatcactttaatcgtaaagaggattacttggaggcgtatcgcgaatatgttgcaagacctagccaagaatgggagcgaggcgagctatacattgcgccactctacaacctactcattcaaaaagggttaaatattcactaccacttgatcgcacgtcatgaggtcattttttgtggcgtgccagatgagtacactgactttttgaggcagccacaaccatgatcaagattgatgatgaagcgatcacctttgttgtacaggggccagtgcaagccagcgccagtcgtcagcaaatcgcgggcatcacagagcaatgtttgaactccatacgacgcttttttcctaaatcgaccatcattctgtctacttggaaagggcagccgttggatgggctcgattacgaccaagtgttggaattggatgatcccggcgcaaataccgttttttatgacggtcagccaattaaactcaataataaccgtcagatgtacagcacccacatggggctgaaagcggtaaaaacgccttatgcggttaagttacgtaccgataacctactgacgggtcgccaatttgttgagttgtatgaacgatatgccgatctcccccgagctcagaattatcaatttttgactcagcgagtgctcaccagcagtacgttttttatttcgagccactacggacatccggtgcattttcataaaagcgatctgtttgattttggactgacccaagatcttctgactatttggtctgatcgctggataccagaattacacttcacgcttaagccgggctacaaagcacgccacccagcaacggagcaagttttatgtctgaattggatctccgcactactcgatgaagagcaccatatcgagagtaaaacctgcgatcacgcaggcttaggtgaaaacttttggccacagtttatggccaataacttactcatggattgtccagaaaatattggattggatgtcactgagcgcttctataaacgaggtaatctggcgcttgaatatgaccttaaggattggctgcatcttaatcaaataacatcaataccatatgataagaaacgtctataccgttactatagaaatcaaataggccgtatactcaaaaagatccattcttttaattaaatatcactctctaactttaataaaaataggagttaaggtttttcttaattttagcctaactcctttcctaatagtcttaattataagtgacaaataccaaaaaaatttgaagtttaatggagtgtttttagtttttaaaaactcgttttcatacaaccatttccatctttgaaacgtaaaaaaatcgtagggatagctatttgagtgtcgaagacgttgtggtacgtctaatccaagttcatctccgtcaacaatgataagattatttatcataaaattatacgattgttgccttgcaaaatgatcaccatgttcatcttttaattcataaggatatagttttcttgctgcattgctccaaattttctgctctacattaacactgtcatttggataatatttgtgctgcttcttaccgctcaatgttgatttgaaatcataatcactatataaatcacaatcccatactttaagtagatcttcaacctcaccaaattggaaaaaatcagagaagaagaaaggtacacttagccccctctcaaactccttcgcgaaataattagaacaaacaagcctgttattcagaactgcataaccctccttacgtaaaggaaattgctcaaaaatttctaacacccttcttttgtttaaaatattatcagctctcaatttcgctgcaaatttagtttttacatggcgtaatccagaaacagttgacacaatttgtcgatttatattaacaggtatagcatcatttcgtttactatatacaaatatagttgaacctggatctttattataaataataagatcagcttcaatatcttgcgtattttctccttcccaagtagatacgataatttgacagcctgggaaaattgatcgtaaacgtcgaacagatgtggaggtaatggacggtgtaataggtccttgaattacgaatgtaatctgatcgaatagcatattttactcttcatgtttatagctagaaataatagcaaacgcttcaagactccaattaatccctcgcttgcagacttctttctcaaacgacctcttcaatcgtttgagattcccttgtttccaagaatctccaatttgcacataacacttatcaaaatcaataatccataccttctcttggtcatcaatcaagatgttatgaatattaagatcggtgtggttgacttgcgcatcgtgcattttgcggatctcacggccgattttacgatagagttcatcgctgatcgggctttcttgcaagatactcaccagatcgcgggcattcggcactttttcacttaagagatcggctttatacagcagtccatgtttttgtacgcgagcggcaatcgggcgtggtacgttgacgccagcatcgcgtaagtgattgagcagcataaattcttgatagctgcgagtcttttcccaaccggtgaaccagtaagaatcggccaccagctttccaaacaaaccaccgcggcgataatgacgcaacgcaccttgtgtctgttgcaactgtacaaaccacgtagtgcctcgtcctgtcgcgcttccgagcactttaccattttgctgccaaaactcggggttgcagcattgacttgggtcttcatgcaaaagcgcgtcgtcaaaccaaactttctgctgcgcgtcgttgaacgtctgtatcaaggggcgattcctatcgttatccggtagttttgcagttttgctctgcatctggcgtgctgcattttacattttctggtcagctctgcataattctggctcaattatcgaatagttttatcgaataggcttggctatggcattgtttcaatcagccccacactccctctgtatcctgcgtttatcggcgattggtgatgtctgtaatacgatagctgccgtacaagcgattcaacgccaatggccgcaaacacgcatcacttgggtgacgggtaaactggaagcagaacttatccaatctctgcccgatattcaggtcatcgtgtttgataaaaaactcggatggcgtgcttatactcagctttggcagcaattaaagtccgagcgttttgatgcgctgctgcacatgcagtacgcttttcgcgccagcattgcgactttggggatcaaagcgcgctataaactgggttttgatgcagcgcgcagccaagattttcaaacttggtttaccaatgtcaaagttccctcaccggacaaaatgcacgtcttagatggtttattggcattcgttgagcacttaggtattcgcgatattgagcctaagtggtcactcacctgccaacctgacgatctgacatgggctgaggcgcagtttcagcccgagcagcctcgcttagttgtggtgcccggagcaagcaaagcttataagaattggacggcagagggctatgcagcagttattgaacatgcccaacaacaaggctggcaagtgatcttggccggaagcccagcacaagttgagcgcgatctggccgcgcaagtggagcaagcactcgctcaccccgtcttaaacttggtgggaaaaagcacgctgcaacagatgctcgcactgctcgcaaaggccgatttggtgatcgcccccgatacaggccctgcgcatatggcgaacgccatgcatacaccaatcattggtctctacgctcaccataatcctgagcgcacaggtccataccattatcgccactatgtcgtttccgcttaccaagaagctttacttgcggaaaccggtaaaatgccgcagcaggttgattggcgcactcgggttaaagaccccaatgcgatgcagcgcatcactgcgcaacaagtgattgcgatgtttgagcgtgccgctgctgacatcatggccacacaggtgaacgattgatacaccttttatacccagatttattcgtaacgaggatttttcgtgagtaaaccaacgcttgctgtcgcattgatagtaaaaaatgaagcgcgtcatctggatgagtgcttacaaaccgtgcacgactgggttgatgagatcgtagtgctcgattctggcagtcacgatgaaaccgagcaggtcgcgcgtcgttacactgaaaaattttacgtgaatgcaaagtggccgggctttggcctgcagcgccaattggcacaatcttatgtccaatcggattatgtgctgtggctggatgccgatgagcgagtgactccggagctcaagcagagcattttgcaagccgttgctgccaataagccggataccttgtatcaatttgcacgcctcagttgggtgtttggtcgctttatccgccatagcggttggtaccctgatcgcgtactgcgcctctatccaactcaactgactcgctacaatgacgcattagtgcatgaaaaggtgcacgttgaaccaagcatgaaagtcgaaactttagcgggcgatgcgattcactacacctataacgatgtgcatcactatctggtgaaatccgcgggttacgccaaagcgtgggcggatcaacgtcaagcgaaaggcaagaaggcttccctttctcaaggcatcgtccatgctgtgggctgttttctgaaaatgtatctgctcaagcgcggttttttagatggaaaacagggatttttaattgcactgctctctgcacactctacctttgtaaaatacgcagacttgtgggcacgtgataatgacgagcactacaaacgctaagtcgatatctatcgagtaaagtaacaaagacaaagggagccgcagctcccttttttaatgattaaagctgcacactacgcagccaaggcgcaagctcagtcaatacgctcttcatatcaatccgacccatgttctcttggtttgctttatcgtctgcaggcggcggacaaaaagcgatgtgcttaccttgcgagttgagtggtcgccagcgcagtggcgttgctgaacgcttggctgggaagaatccgaccgtcggcacatccaaggctgccgcgatatgcaaaggccctgtcgagcccgcaatgaaaagctgcgcgcacgccagtgagcgggtgaaatcaaccaacccgtcatttttggcgtacaaggctgccaatactccttgctcagcaagtaaactttgcaattgcgccgctttctcttcttcaccgggacctgcggtgagcaccacttgtttgtgctcatccatcactcctgtgactaactcacagtactgctcaagggagagattattcgctgaaccaccactgccagcatgcacaaaaagccacgctttgtcggggccaatgtctaactgctcagcaagtttgctgcgctgcgctgccaattgctctgctggaaaggtcagatacggtgcattaggttcaataatcggctggccgatatcacgcaaaaaagcgcgtaccaaatcgaggttgtattcatattccggtttggccgattgcgagcgcttttgcttaatgcggtgctgatagaaaatctgcgccaatttggtcgccggcgctaaacggtaaggaatgcgcgctttccacactaacagtgcgttatacatagtcgaaaacaggttgatggaagcatcaaactgctgtgctttaactgtttgcaccagttgcttatgctgcgccttatcagcctgttggccggggtcgatgatcaccgcgtcaatccatggacaaagctctgccaatgcggcggtatatttcggcaccagcgcggtgatatgacaatccggcagagaagctttcagcatggcgaaacttggccaagccagcataaaatcgccaattttatcgttgcgaataaccagtaactttttcattgtgctcgataaggtgtgaaattttgcgtgctcatcataccgacttcataggtaaatgtgaggctttttgttaggatgaggccacttccctgattgatgagtaacggattgtgagccaaaaacgtctttcccgagtgatttaccctggcacttttgaccccatcactaacggtcatctggatttgattgagcgcgccgcgcaaatgtttgatgaagtgatcatcgccgtagccgccagcccgagtaaaaatactctgtttacgctcgaagagcgcgtcgagttcgcgcgccaagtcacctcacatctggataacgtcagcgcgaaaggcttttccggattgttagttgattttgccaaagccgaaaaagcgaatgtattgatccgcggcttgcgtaccacagtcgattttgaatacgaatttggtctcaccaatatgtatcgccgtttaatgccgggcttagagagtgtgtttttaacgcccgccgaagagcacgcatttatctcgtcgaccttagtccgggaagtggcaatccacggcggtaatgtggatgagtttgtgcccgctattgtcgctaacgctctacatcaaaagaaaaaaatctagcgcttcaaagggatgcaagctcacatccctcaatccccttcctacttgaagctgcagcgatgttggctacctgcaactctaagtcgtttgggtatatcaatgctggcactgcgggcagaaaaaggtattgcgctgagcaattttctgctcgcaaagcggctctccacaatgggggcaaggctgtttggctttgccatacacttgcagctcttgcgcgaaatagcccggcttaccatcgctttgggtaaaatctttcagtgtggtgccgccttgcttaatcgccacttgcagcacttgtttgatgttcgccactaaggtttgccactcctctaagctcagcgaatgagcggggcgtagtggatggaggcgtgatgtaaacagcgattcattagcatagatattccccacacccacgaccgctgcgttgtccatgataaaagctttgactgcaatgcgtttgttgcgcgctttgtccatcatatattcagcgttaaaagcttcggtcaacggctcaggccccaaacgcccgagcacttcatggctctcatcaggcgcacaccataaccaagccccgaagcgacgcggatcgttatagcgcagccgtttgccgctggtcatcaccagatccacatgatcgtgtttcgcggcaggaaaatcgccatccaaaatacgcagcgagccagacatacccaaatgcacaatcgcactgccgacggcggtttcaataatcagatacttggctcgacgatgaatcgcgagaatggtctgcccttcaagctgtttcagctcttgagggataggccagcgcaacttgggcgtacgtaacactaaggattgaatggtgccaccgaccaaatgtggggagatccctaaacggctgacttcaacttcaggtaattcaggcatgacaacctcttacaatggcgcagggaatagataactcgcttcggccgagaccgcaatccaacgatcttgccagttttttagcaaccaaaattgtggggtttgatagaaggtgatcctttgtggctcttcgcgatcggcataccacacttctatcgtttgtgcgtttggcaacgttggttgcagggcgcgatacgtcgcctcatccacttctgtcccagtgagtgcatgccaacgctgcactaattcttgcccatcaacactcaactcaggctccgactgccactcttcgcggcttttttctaatgaaaacgcagggaaatacaacgcctgtaaggtggcgtctgttctcagtaagcttggaaactggctcgccggatcgggcaataaatagcttttaatcacggtcggcagattaatcaccgcgataaaagcaatcacagacaaaatcagaatgttgttccaacggcgacgtcgattgggagaaacgcgcataatcactccttgcgataagcaaacgttttgagattaacaaagtgcttagtgagatcctagtcatccccttgctacttgaagctgcaacaccaagtagtttgagtataagaggagctctataccttgggctttctgttattggcagccaaaacccaaataacaggcagaaaaaaacccaaccaaaggctgggtttttttacaacactgtaaacaagagctaaatcaattacttgatttttgcttctttgtacacaacgtgctggcgaactacaggatcatatttcttgatctcgaacttgccaggcatattgcgcttgttcttatcagtggtgtagaagtgacctgtacctgcagatgatactaggcggattttttcgcgaatgcctttagccattgctcaattcctcttaaacgttttcgccacgtgcacggatctctacaagaacagcatcgatgcctttcttgtcgatgatacgcatacctttagcagttagacgtagtttaacaaaacgtttttcgctctctacccagaaacgatgagtttgtaggttcggcagaaaacgacgcttagtagcattttttgcgtgtgagcggttgttaccaactgcaggacgcttaccagttacttggcatactcgtgacatgaatgtcttctccaaatcgtttcagctcgatatcaaccttggtggccgaacctctctctttccaaaatcagaagttgaggttaaaaaccgttatggaatacccatacaaggctatcaaaggtcgcgcattatactaacttgccgcacattgctcaagacccgaacagatccttttcgcaggatttgctgatctttttacggtgcgagctgaatcagggttaaaaaatgtcggggcatattagcagattctcgctaactcacaagcttaaaaatgccgcaaaccataagtgttgactatatccagccacgttcagcaaaagagaccacttccccatcaccgacgacaaaatgatccagcacacgaatctcaaccaaaccgagtgcatcacgcaggcgatcggtgatccttcgatcggcttgactcggttccgcaacacccgatgggtggttgtgtgccagtattaccgcagcggcattatggtgcagcgcccgcttaaccacttctcgtgggtaaacgctcgccgcatcaatcgtcccttcaaataaaatctcatcacgaatgacacgatgttggttatccaaaaacaatatatagaaggcttctcgttggcgatcgcgcagcacgctcgataaataaagtttggtttgctgcggactggtgagggcatcaccgcgctttaaggtttcagcgagataacgctgcgtcatctccaataccgcttgtaattgaacaaatttggcttcgcccaaccctttgtggcgacaaaactgctccttggaggcacaaaacagtgcgcgcagcgatccaaaatcgcgcagcagcagatcagctaaggcgagcacgttcatgccttgggtgcctgtacgtaggaaaatcgccagcaattccgcatcacttaatgattgtggaccgcgttgcagcaatttttcgcgcggcatggattcggtgggtaactgttttaggctcatatcttttctctgggtcggttttgcttacacaaaacagagaaagcaaagggccgcaagcggccctaataaagtttcgaatcacctcaagcggcaatgcaatttcactgttgattaaagcttaaaatgcccaaccaaagtgcccatctgttgtccagaatgggacaaacttgcgctaacgctttcggtctgtttaaagctttcactaagttcattgacgatctgctgaatcgcgaccagattttggttgatgtcttctgctacggcgctttgctgctcagccgcagaagccgtctgaatgcccatatcatgaattaggcttactgctttggagatccccgctaagctctctttaatctgcaccgattccagcgcggttttctcaccacgctcttggctgatgttcatgctctgcaccgctttactgaccccttggtgcagcgcattgagcatttcaccaatctctttagtgctattttgagtacgactcgccagtgagcgtacttcatcggccaccacagcaaagccgcgcccctgttcacccgctcgcgccgcttcaatcgccgcattcagtgccagtaaattggtttgctcagcaatatcgccaatcactttcagcacttgggtgatcttcgccgcctgttggctgagatcgcctaccgcagcagaggtttggttcacttcgttgaccaactcaccaatcccatcaatcgccagattcacctctttctgcgcgacagcaatttggctgttagccgactcaatcgcttgcgcggtcgagtaagtgttgctcgccacttcgcgcgccgtggcgctcatttcagtcaccgcagcgacaactttatcggtctctaaacagtgaccgtccatcttatggctggcttgcgaggtttgttgatccaattcctgcgcagccgcttcgaccgtattggccgaggcgcggatatcagtcataagcggatgcagcttatccataaaggcgttaaacgccttcgctacatcgccaatctcatcttggctctcaactttaatccgcgcggttaaatcgccgccacccgcagccaccgcctgtagtgaactcaccacatgttgcagtggtgcaatgccgcgagacaccaaaacactcaccgcaataatagtgaacaccaaaccgacaaccgaaagcccaatcgcggagatcatttgatcgtagagatccgcctcgcgctgcgcgcgaaactctgccacttgggtatcgacatcatcaatatagatgcccgtccccaatacccaatcccatttcggcaggtattcggcataacccagtttcggcgcttgcgcattaatcgtcggtttgtgccaagagaaatagaggaatccatcgcccgttttcgaggcatcaattaagccagcaatcaccgccacaccattttcatctttcatgccgtagaggtttttgccttctaattcaggcttaatcgcatgtagggtattgaccccttgtgagtcgtaagcaaagaaatagccatcgctgtcaaaacgcatcgctttgaggatttgtttggcttgcgcttggttttcaccggctttatcactctcatataagggtttcaccgccgtcacccccatcatgagataggcttgcagctcttttttcttggcatcaatcagatcggtgcggtagttttctagctctttttgtaaggtagataacccactctgataattcaccgccatgaccaaggcggtaatgacgatcagaggaatgaccgtcaatagcagtaatttggtacggcttcgtagagaagacagcataagattccctttcattattgttagctttgtgaatgacttatctcatattcatggtctattgtctgtgaaatgaccgatgctttgcagctcgaccagtggcgcgatgcacagcggcggttgtgactccaacttttagctcgagctgtgctaacatagcgcgcagattttttgagggatcccaaatgcaatcattggcaggcaaaaagattctgctcggtatcagtggcggtatcgcagcgtataagtgtgcagaattgactcgtcgattggtggagcgcggtgcgaccgtgcaagtggtgatgacccacgccgccaaagaattcattactccgctgaccatgcaggccgtttccggacgtcccgtgtcggatagcttgcttgaccctgcggcagaagcctcgatggggcatattgaactcgctaaatgggccgatttggtgctgctggccccggcgactgccgatctcatcgcgcgcatggccgcaggcatgggcaatgatttgctcaccacgctcattctggccaccagcgcaccagtcgcgattgcgccagccatgaatcagcagatgtatcgcaatatcgcgacccaagaaaatctacaaacgcttatccgccgtggttatctgacttggggtcctgcggctggcgaacaagcctgtggagatgtcggcccaggtcgtatgttggagccgatggaattagtggcgcactgtgaaaacttcttcgccccgaaaattcttgtcggtaaacgcgtgctgatcaccgcgggccccactcgtgaagcgctcgacccagtacgctacatcaccaaccacagctcaggaaaaatgggctttgcgctcgccaaagccgccgcgcagctcggcgctgacgtcacgctggtcagcggtccggtgcatctgccaacgccggtgggcgtcaatcgcattgatgtgcaaagtggattagaaatgcacagcgcggtgatgaaagaggcaacctcacaccagatctttatcgcgtgcgccgcggtagccgactaccgcccacaaaccgtggccgaacagaagataaaaaagagccgtgataacgacacattgaccattgagatggtgaaaaatcccgatatcgtggcgtccgttgcggctctgactgagaatcgaccgtttaccgttggctttgcggcagaaacgcaagatgtcgagacctatgcgcgtagcaagctcgtgcgcaagaatctggatatgatctgcgctaacgacgtctcgattgctggccaaggctttaacagcaatgacaatgccttgaccctattctggaaagaagggcaacacagcctacctttaaccagtaaagacgcgctcgctagcgcagtaatgcatttgattcatgagcaaatgtaggcgttattttcgccacctacttcaaccatttttatcaacacgcttcgaacaacctctgagcttagttacacttcaaaggtttcatctttgtcgcaggcgctgagtctgcgacgtagttgttgttcatcagcagtgataaccaaaaggaaaaacggggcatggccggcaataaaaaaatcaatcgacgcgaagaaatcctgcaagctctagccgagatgcttgaatccaatgaaggggcttcacgcatcactaccgcaaaactcgctaagcaagttggcgtgtccgaagccgcgctgtatcgccatttcccgagcaaagctcgtatgtttgaaggcttaattgagtttattgaagaatccttgatgtcgcgtatcaaccgcatctttgatgaagaaaaagacacgctcaatcgcattcgtttggtgatgcaattgctgctcgcctttgccgaacgtaacccgggcttgacacgcattctctctgggcatgctttaatgtttgaaaatgagcgcttgcgcgatcgcatcaatcagttgtttgaacggattgaaacctctttgcgccaaattctgcgtgaacgtaaactccgcgaaggcaaatccttcccggtggatgaaaatatcctcgccgcgcagctgctcggtcaggtggaaggcagtttgaatcgctttgtgcgttctgatttcaaatatctgccaaccgcgaattttgatgaatactgggcgctgctaagtgcacagattaagtgagtacaatgagtcaagataaatacagcaaacctgaattctccttctctttattgcacccaaaatactggggagtctggcttggttttggcctactcgccctgctggttaacctgctgccttatcctgtgctgctaaaaatcggccgcggtttaggccaattttcgatgcgctttggtaaaaagcgtgtccacatcgccagacgtaatctggaactcgccttcccaaccatgagccaaagcgagatcgatgcgtttgttttggaaaacttcaaaaacaccggtgcggccctgattgaaactgggatcacttggttctggccaacctggcgctttaagcgcattttgattgataaagatacccaagccattcgccaacatgcaaaaacaggccaaggggttttgctgtgttgcgtacatgcactcaatctggaaatcaccgcgcgcgcttttgctgtgctaggcatcggtggctatggcgtgtatcgtccgcacagtaatcctgcctatgagttcattcagtaccgtggtcgaacacgcaatggcaatcagcttatcaaccgaaccgatattaagcagatgatccgcgtgttacgccaaggcgagcgtctgttctacctgccagaccaagactatggccacaataagtcggtgtttgtgcctttctttgcggtagaagaagcttgtaccaccaccggcaccagtattttggcttacaccagccactgcgcgattgtcatcggctccggtttccgtaacgcgcaagggcgttatgagatcatggctgataaatcaattgaagcggactacccacaaaaagatgaaaccgctgccgcggcttacatgaataaatttgtcgaagagattatactgcgcgcccccgagcaatggatgtggctgcacaaacgcttcaaatctttgccggactatgaactgaccaactcgcgctatcagtaaaggtgaatttgtgagcgatcaagacaacggcattgcacgccatctacataacccgcaatttgagtggcgctttctgcaccccaaacactggggcacttggattggcatcgctttcgcagcactgttagcctttattccttggcgcttgcgtgatcgactggcgaaacctttggtgccactcatcatcaagaaaaatggccgcgtagtccgccgcgctcgggttaacctcgcctactgttttccagagaaaagcgagcaagagcgcgagcagatcctgcacgatacgtttgtgaaagcctcgcagtttatgctcggttattcagagctgttggtgcgctcgacccgctacaacaacgcacggggcgaactgattggcgaagagaacttgctgccgctgctagatagcggcgagcgcgtgattttgttagtcccgcactcttgggccattgattacgccgccgttatgctggcggctcgcggctacaaagtcgccaacatcatgaaaccgcagcgcaacccgattgccgattggctgatgcacgtccaacgtatgcagtatggtggccgtatttttactcgcgaatcgggcatcaaacctttcttgcgttccattcaatccggctatgttggctactgggtaccggatgaagatcacggcccgcaaaactccgtgtttgtaccgttttttgctaccgaaaaagccacgctcaaagggtttggcaaaatggctaagctgtgcaaagcgcatgtagtacctttgatgtcatgctacaacagtgattcaggccgttatgaagtgcacattttgcctgcgctgcaaaacttcccaactggcgatgaagaagccgatgcactggcgatgaaccgtgcgattgaagccctggtcacgccacagccggagcagtacatgtggaacttgtcgttgctgaaaactcagcgtgatggcagtgaaatttacgacaactcccatcatggcgatcaaagctaagcgttttgttcttgagcttaatgctagaaaaacagcctcattttgaggctgttttttcgttttaggcttagttggatgaatacgcttaaattccgtactgtgcacgatacgctttcaccgcctctagatgctcagtgttgttaccttgctgttcaagataggtgatgagatcggtcaggctcacaatcgaaatcaccgcacaaccaaaatcacgttccacttcttgaatcgctgagagctcgcccttgcctttctcttggcgatcgatcgccactagcacgccggctaaatcagccttgttggcttggataagctccatcgattcacgaattgccgtaccagcggtgatcacatcatccaccaacatcacgcggccttctaacttgctgcccactagattaccgccttcgccgtgatttttggcctctttgcggttaaagcagtaaggcgtatccacatcgtggtgatccgccaatgcgactgctgtggtggtagcaatcggaatgcctttgtaagcagggccaaacagcacatcaaattcaatacctgaatcaactaacgctgcagcgtaaaaacggcccaagcgcgctaaatcacggccagtattaaacagaccagcgttaaagaaataaggacttttacggcctgatttcaaagtaaattcgccaaacttcagcacctgtttttctagggcaaactcaataaattcacgctggtaagctttcatcatttctctctcttaactcatacacttggacttacttcctccccacagggagaaattcaaacattgttccgtctctttttaaaagaggggggatgttctgtgctccccccttcttgagtagggttgtctttttcccctccccttctaggggagggtcagggtggggttaccagcaacaaacgcatctactcgtgatctaccccctcccaacctccccctaaaagggggaggagttttaaggctagcgcccctaaaagagcgatcacacttaaggctaattccccctagaaggcgatgaggatcaggcatcgtccaaaaagggatttcctaggcaaaaaaatagcccccaattgggagctacttaatcaatctaacaacgatgccttctgcactgcgacaatatcggcaatgccttttttcgcgacagccagcaattccagcaactgctcatgactgaacggctcaccttcagcagtgccttgaatttcaatcattttgccttcttcggtcatgaccacgttcatatccgtatcagcagcagaatcttcgacatattccagatcgcacagcacatcttcacctaggataccaaccgaaaccgcagccacatggcctttcatcgggttcttcttcagttggcctttggcgatcagatgggcaaaagcatcggccagtgccacgcttgcaccagtaatcgaagcggtacgcgtaccgccatcggcttgaatcacatcacaatcaacggtgatcatgatttcgcccatcgcttccagatccaccacagcacgtaggctgcgcgcgatcagacgctggatttccatggtacgaccgccttgcttaccattggtcgcttcacggcgcgtgcgtgaatgggttgcacgcggcaacatgccgtattccgccgtcacccagcctttaccttggccttttaaccaacgtggcacaccttcttcaatgctggcattacacaacactttggtgttgccaaattccaccaacaccgagccttctgcgtacgcagtgtagtgacgggtgattttgatggggcgaacttggtccgcagcgcggttatctggacgcatagggtctcgaccttcttgtggctgtatcaattcggttggggcaggattatagcccaaagcccctacaggcgctaggttaacgaattcagcacggtagcgccgttttgcctgctttgctactattagcgccagtcacaaagagatgaaagcaaaggacatcctgatgatttacagcatgactgcgtacgcacgcaaagaagtcaaaggcgattggggcagcgccgtgtgggaaattcgctcggttaaccaacgctatttagaaacgtacttccgcctgcctgagcagttccgtggtttagagccactgctgcgcgagcgttttcgtcagcgcctgtcacgcggtaagatcgagtgtcatttgcgctttgaagcgaatccagccgcgcaaagccacctcaccatcaatgaaggactcgcccagcaagtgattaatgccgctaaccagatcatgcacatgaccggtgaactcagccgcattaacccattccaagtgatgcagtggccgggcgtgatggaaacgcctgagcaggatatggacgccataaaccaagcactactcagtgcgtttgatgaaggcgtggacgaatttatcgccgcgcgtggccgtgaaggcgataacatgaaagcgctgattgagcagcgtttgcaagcgatcagcgccgaagtggtcaaagtacgcgcacgcatgccagaaattctggaatggcaacgcgagcgtctgttcagcaaatttgaagaggcaaaaatcgagcttgatgcgagccgcgtagagcaagagctgatcctgctggcacaaaaatcggatgtagccgaagagctggatcgtctcgactctcatgtcaaagaagcgcgtgaagtgctgaaaaaaggtggctcatgtggccgtaaactcgatttcatgatgcaagagttcaaccgtgaatcgaacaccttggcttcgaaatccatctcaaccgatatcaccgcctccggtgtggagctgaaagtactcatcgagcagatgagagagcagatccaaaacatcgaataacccttaaagcctcgttgattcggggcttttatttaatcccctaacttcttagtaattggaaacctatggaacgtttgatcgaaaaacttctctattcttcacgttggattatggcgccgatttatcttggcttaagcctgctgctgctcgcgctgggcattaaattcttccaagaaattttccacctactgccaaacatttttactatcaaagaagtggatctgatcctagtcgcactctctttgattgatgtgtcgctggtgggcggccttatcgtgatggtgatgttttccggatatgagaacttcgtgtctaaactcgatgtcgatgagagtgaagataaactcggttggctgggcaagcttgataccagctcgctgaaaaacaaagtatctgcttcgattgtggccatctcatcaattcatctgctcaaagtgtttatgaacaccgaaaacatcgaaagtgacaaaatcaaatggtacttgctgctgcacattacttttgtggtctcggcttttgcgatgggctacttggataaaatcaccaagaagtagcgtcttgaatcgttgaaaaacttcaatcgttgaaaagaaagcgccctagattgggcgcttttactatccccccgtccgttaaggggataacctacagggaaccaacttagctcagatcgacgtctttacaaccgaagaagtaggtagcagcaaagccaacggtataagagatgagcaaaccaccgacaaataccgccatacccgcaaaaataccgtcggctgaagtcatcaggggaatcgccaccacaccggatgggccaaacaccgtattgaggccaaccggcaaacccaaataagagatgaggccgataaagaagccacccgccgcaccgccaatacaggcagtgacaaaaggtttcactcgcggtagcgtcacgccataaatcagtggctcaccaatgccgagaatgcccgggatgatcgcccctttaatttgagtgcgaatggtggtctcttttttggctctcgcgtatagcgccagtgaggcaccgacttgcccagcgcctgccatagcaaggatcgggaacagtgagttaaagccttgcgcttccatcagcgcgaaataaaccggcacaaaaccttggtgaataccaaacaccaccgagattaagaataaaccggccaagatggcagcaccgagtgggttatcattgaggtttaaaaacagccatgacatgcctttaaacagctcaccgccgataggcatgatgatgaggaaagtcaccgcgcccatgatcagcaaagtcaccaccgaagtcaggatcatatccaaatcatccggcatgtattcacgcactttacgttccacttgcgcgcctaaaattgccgccagtaataccccgatgatgttgccgcgcgggtcaattgcaaagccgaagaactcactcatccccgagtaaatgcctttggttgcttctgggtcataaccgagtacaaacagcgaagccagaatcgccccgttcacgccagagccgccaaatgcctgctgcgcgttatagccaatcaagatgctgagaaacgcaaacagccctttgccaaacactttgagataagccaccagatcgagcataaactcgctcggggtttggccaaccacatagatttgctcaagcagagtcgcaatgcccagcagcaagcctgcggcaataaatccggggatcagcggggtaaaaatggtggcaaacttgctcaaaaagcgttgtaccgcactggtttgcttgctcttcatctgctttttctgctgcgcggcaatggtggagagatccgcctcgctcactgcaggtgccacgttgtcgcccgattcaatcaaggcattcatcatatccgcggccgtttgtgctttaccgggaccgaggatgatctgcagttgtgcgtcactttcaaccacgcccatcactccagaaatttttttcaatgccgcatgatcggcgagcgcagaattattcagcgttaaacgcaagcgagtcatgcagttgccacatttggcgacgttaccactgccgcccaccagagacagcacttgtgccatcatggtttgggttattttggccatcatcggctccttgtcttgtctcttcctgttttattcttgattgagcgcagcacggataaaaccttggtgctgcgtcagtttttgagcggcctgctctgcactaaagccccccaatatcatcaaaatggcggtcttacagtggcgaccacacgcggccaatgcggcttccgcttgctcggcgcttacgcctgtcgcttccactacaatgttggtttgccgttggatgagcttggcgttggttgcttccacatccaccatcaggttgccaaacactttgccacttttgatcatcgcgcccgtggtcagcatattgagcaccagtttctgcgcagtgcccgctttcatgcgtgacgagcccgttaccacttccgcaccgactacgggggtaatcacaatatcggcgtacgcttccatcgggcagcccggattacacgccagtgatactacggtggcaccgactgagcgtgcgtactccatacccgcaatcacatagggggtacggccactggccgcgatgccaaccagcacatccttttcacttagatgcagggccttgagatcgctttggcctagctcgcggttgtcttccgcattttcgactgcttttaaaatcgctgtgtggccaccggcaatcagaccaatcacttgctcaggttgactgccataagtcggtggacattcacttgcatccagaatccctaaacgaccagacgtgcctgcgcccatataaatcaagcgtccaccttgagcaaacgcggtcgcaattgcctccaccgcttgcgccacttgcggcaaagtttgtgcaaccgccaaggcaaccaactgatcttgttggttaatcactttcagcatgtccaaagtgggtaaggtatcaatctgctcactggccggattacggctttcggtcactaagcgggttaaatcaatcttcataaggcttctcggcaaatttcgaattgaggcgattctatggaataaaatattccattttggtgataagaatcacaattaaggttattctttaagcagccgttttttggaataatcgtgaaaagcatcgagaaaaataaacgctcaaccatgaaaccattgattgaaaaagcatgaagcgtggcaggcattattcctacaatggaataatttattcatgaggagtgtaaaaaatgtccgtactacaacgcatcgtcagccgtcgcacccaactttccgagagtggccgccagattggtgattgggttctcgccaatgcggcgcaggcggcagcaatgaccagccaagatttggccgcgtgggccaatgtgagccaatcgagcatagtcaaatttacccaacggcttggttttaaaggctacagcgaatttaaactcgccctcaccgaagagctgggacgcaaacaagtcatggtcaaccagcctttacacagcaacatcttggccgatgaccccgttgccgtgattgcccaaaaactggtgcaaaccaaaaccgaagcgatgtttcacacgaccaatgccctgcgtttggatgagtttagtgaggcgatcagctggattcagcaagcggtgcgggtacagatcatcgggattggtggctcagcactggtcgccaaagatctcgcatttaagctgctcaagctcggtattaccgcgctcacggagcaagatagccatgtgcagatcgcgaccgctcgcaccttacatagccaagatgtgctgattgcgatttcattttcgggagaaaagcgcgaaattctgattgcagcggaagcggccaaacagcaaggtgcgaaagtgattgccctgaccacaccgaacaaaaatcgcttacgtgagatagccgatctggcactggatacaattgccgatgaaacgcagcaccgcagctccgcgattgcttcacgaactgcgcaaaacgtgctgaccgacctgatttttctcaccctcactcagcagcgtgaaacgtccgcgcggcagttgatcgatgacatttcttccgacattcgccagatgcgttgagaggcgaacgcctctcaacttcgggtttagcgtgcacgctgactgagtaacagcagcaggaaatagctgccaccaatgattgccactagcgtgcctgcggcaatttgcgcggggaataacaaggcttgccccaaccagtctgcccacaacatcaaagtaccaccgaccaaggcggccagcagaagttgagatggagcacgctgcgcgccgagcatcatcgccatgtgtggcgcaatcaaaccgacaaagctgacggggcccatggtcgcggtcaccaaagcgcacaacagcgcgaccaagatcagcaacactaagctggcgcgactcgcactcaagccgcgagcagaagcaaagccgcgcccaattgagatcaaggtaagccaacgagacaagccaagcgccaacagtgttaaccccaccacacccacgctgagcagcaaagcttgctcgcccgtggcacgataagttgagcccgatagccacagcaaaatctgatagctgtcgcccgttcctttagccaaggtaaattgcaccaaggcttccaacagtgcagtgatagcaatcccagtcaagatcaagctagatggtgcgtaatgatggcgccgcccaagcagcaacagcgccaccaataccgcagcgctgccaagcagtgctgtcatccagtgggtgctctgcaaactttgccctaaaaacaagctagcaaacaccaaagcaaacgtagcccccgaagagacgcccaaaatatcggggctggctaacgggttataaatcagccgttgcagtaacgttcccgcgatcgccaatcccaccccagcaaacagcgcggtgagcatgcgcggccaacgaagcggccattgaaactcactcggcagcgcccagcttgcactttccatctgccaaccaatatgtaggctcagtgccaacaacaaagctgccgcaatgagcatcaccgcccatcgagaaggcgaacggcgatgtgaagacaaggagatagagagcgaatcctgcgcttggagctggcgacgactaaaccagatcagcgccggagcaccaatcacggcggcagtaatgccgctaggtaccacttcctcagcccacacgctcagccccatggcgagcatgtcagtggcaagcagcaacaaagcgccaagcagcgcactgctgtacaactccattttggtcgtgcgcgcccccagtgaacgggcgatattcggggttaataaaccgataaaaccgatcaccccaactgcggtgattgaagcagagaccaaccaaatcccgcctgccatcagaaacaagaaagcaggcaataccgctaaaccacgcgccgccgccccttcatggcctaaccgaagcaaagtcagcactcgaggtgcaaacagcagtaacgggaacaccaaagccaaacgcggcagcaaccaagtgagccactcccagccgttttgcgctaaatcacctgcgccccacataaacacattctgagcgaactcttcgttcagcagtaccaaggccgtggcaatcgaacccagcaaaatgttcaccaccatgccggaaacgactagcggtaatccggtgagattgcgtagccccgctatcgagattatcagtgcgaaagcgagcagtgctccagccatcgcagccagtgcgctgtaatcagccacccaatcactgaaccagatattgacgataatcagccccaaccaagcaccggatgaggttcccaacgtcagcggtgaggtgagtcggttttgggtcaactgctgcatcaagctgcccaccaacccaagcaccgcgccgaccactatggccatcaccgcacggggtagctgcgcgtagataaaattcacctgcgcgaaactttgcgcggcttgatgaccgagcaccaattgccactgctcattgagggttaaattgtgcccccactgtaagctaacaagcgccaacagtagagtcagcgcccccaaaccagttaaacgcagcacactcatgattgcggagccaccgccagcaagctttcggtgatcgcttctgcgctataacgcagcgacatcgccccgccgtagctccacacaggacgcacggaattgacacgccccgcctgcacaaacggcatcgcgcgccacaacaccgatttttgcacttttttctcttccgcaaacggcaagaaatagagcacatagccttgctcaacgtgttgcaactcactcaagcgtttttgcactatgccccactctttcggcggctgcggcagcgctgacgataaaccgagctgttctagcacatattgcggcgtggagttttcggtatacagaaacaccgaggttgggttggcaaaacgcagtgtcaccaccgcaggtaaagtgtcaccaaaggcgtgctgtagcgaagctttcagctcagaaaaacgggcatacatcgcctccagtttttgctgcgccaccgcctctttaccaaacaaggtagctaaggttttaaagtgggaaatcgccacttgggcagcgttatcttgctcggaaaaattgggtagatacaccactggcgcgatgcgccctaaggtggccagcaaatcttgttgcggccctgcggctaaaatgacatccggtttaagtgcggcgattttctctaaattcggctcagtacgagtgccaatatcttgcaccgaacttggcacctcgggttgcacaacccactgcacgtaagaactcaattccggcgcgccaacgggctgaatgcccagttcaagcacttgttcaagcagatcccagttcagcaccaccactcgctgtggaacctcagcaaaagtgtgcgtcccttggctatccgtcagcacaatttgtgcttgcacgggcagtgcgaatagacaaagcgcggcaagccagccaaaaacggcctttggtcggcaaatgttccgcagacgaacattccatagactcatcaagcacatacgatcgaaaccttattagtagaagagtgggaaatgggattcgggtgatcaatcaaacggatcggtgagtgatacagatccgacaaccgctgctcatcgagcaacaattcagcaccgccttcaaaggcgatctgcccctgcttaagcgccacaatgtgggtcgcgtagcgcagcgccaaattgagatcatgcaaaatcacgataatacccacgccttgggtttgattgagctccgccagcagcgccatcaattgatattggtgatgcacatcaagcgccgacgtcggctcatccaaaatcaacaccggagattgctgcgcaagcagcatcgccacccaagcgcgttgacgctcaccgccggaaagctcatccgccaagttatgcgcaaaaccactcacacccgttttttcaagtgccgcatcgataatcagctcatcttccttgcgccatcggcccaaggtgccgcgccacggaaagcgccctaaacgcaccaactcacgcacggttaatccagcgctggtcggcaatttctgcggcaaaaaggccacggctttggcgagggttttactcggcagcgatgagagtgattgaccattgagggtcacttgaccattatcgggcgactgttggcccgacagtaaactgactaaggtggatttgccagaaccgttgtgaccgagcacaactgtcagctcatgggtcggaatggtcaaatgatcgatcgccaaaatggtgcgcccaccgcgaaccatttgaatatcagccaactgaaacattgatccccctaataattgacattcaataaaaacaacaaatcccgccagaagcgggagttgtcttgcagccaatcatccaagaatacggacaatcggcgaccccaaacggcaagttcacaacaattgccgattaccagcgatagttagcactgagtaccgcgctgcgtgattggccgtagtaacaccagtaatcacagccagaaacgaactcgcgatcaaacaggttgttgatgttgagctgcacttgccagttttcagtgatttcatagcccgccatcagatcgaccaaggttacactcggcaccgtacgatcgctcgaacgcggattatctttcgactcaccgatgtaacgtacgccggagccaaacgtccaaccttgcagaccaagctgcgccgcatcgtaatccagccacgctgacgcttgatgtttcgggatcaaaccggcttgttgcgtccccttgccacccgtttcatcggttttggcatcggtgaaggtgtagctggcggtcagtttcaagctatcagtgacataacctacgctttcgacttcaataccttgggcggtcatttcacccgtttgcgtcgccacaaaagtcgttgggttggtcaccagcgcattttgttgggtgatatcaaaccaagctagattgatgtaaccatcataaaactctggctggtacttcacgccaacctcagtttgttcgcctttcagtggcttatacaactcacccttcgcgctatcgatagtgctgagcacatcaaacgattgtgaatagctgaggtaaggtgatacaccattgctggccagatacatcaaacccgcattgaatgaaaactccgcatcgctgcggcttttacgctgcatgttcttttggctttcgttttcagtatcgacccaatccatacggccgccaatcaggccaatccactgctgatccagcttgatttggtactgcgcgtacaggctcgcttgctctttggtaatggtgcgatccgctgcggaagattcatcgataggcgtgaaattgccataattcgggttgaacggattgatggtgccaaagctgtagttatctaactcaacaccttgagtctggtggcgttgcagctctaagcccatcaacagcgtgttttcaacacgggcagaatcccacttcgccaccgctttgttatctaagctcaagctttcggttgaaccatcacggaacactatgccttgcgttaatgtgtctttacttgggtcatcattcgagaaagcgtagctgctgcgcagatagagatcgttatcgccgtaattgaaggtctgtgacagcgcccagacatcattaagatcatgttcgaacaagtaacccaatgacacctgacgacgctcatacttgtcgtaatccggttgccctaagttggtagagggatcgatatgaccaaagttggaatcgattaaggtgcccgccgcagggaaaaatgggttagtcggcacaccgctgtcttccaaaaagctcgccaacagggttaaacgggtttgctcagaaatatcgatgctgagacttggcgcaaggtagttacggctggtttgcgtaccgttcaactgaccatcattctctttcatcaacgcgactaaacggtaacgcacggaaccgtcttgattcgcgtaatcggaaatgtctaaggttaaggtgcgcagcgcatcattacccacttgtaggccaacctcaccttgtggaatgtcggtcggtttcttctgcaccgcattgaccactccacctggaggtgcctcaccatacaaaatcgaagcgggacctttcagcacttcaatacgctctaaagcgtaaggttcgataagccaagtgtagtaaccatcacggaacaggcggctgccatcttggtaggttgcggcatcaaaaccacgcactttgagccaatcagtatcattgtccgcgccataaggttgagcggtgacgccggaggtatagcgcagcgcttcatccaatttttgtggcgcgcgagccacaatctcttcttgagtgacaatcgatagcgcttttggcgtttcttgtgcgggtgtttccactttcaaggctgaagcggtcaccactaaggtttctaactgctcagtttcttggttggtattggccattacactcggtgcggcaaccaaaacaacagggatgaagtgcaagcgaagcgcacgacgaatgtattgtccgagctgactcgggcgaatattgcgcatgataaaacctctgctatagatttgagaatcgtttttattagtattaattttacgcaattttagtgataattatcttaattaaaagcaaaaaattgcgaatctttctcaattactttcattaaggcaccttgttcatgttccaatggtttgaaaaactgaccgaacctttcccggctcaagagccgcaaacaccgcctaaatctttggttgctttctgtcgttactacacgcaaggctttgaaaaaccgctgttattgatgtcgctactcagcgcctgcgtagcgatggcagaagtcactctcgtacgttacatgggagagattgttgatattctcagcactcaagagcgccaccagttttgggaaatgcacggcgaacggctgtggacgatggcggcactggtactggtagtgatgccgattctggcactcgtacactcgatgttgctgcatcaaaccattttgggtaactacccgatgtcgatccgctggtcgactcatcgctatttactcaaacaaagtatcggcttcttccaacgtgattttgctgggcgcgttgcgacaaaagtgatgcaaaatgcgaatagcgtgcgcgaaacggtgctgaaattggtcgatctgtcggtctatatcgcggtgtatatggtgtcgatgctggtgatgattgccgaggctgacaaaattttggtggtgccgatcctcgtttggctgctcttctatatcgcgattcaggtctacttcgtaccccgcttaaaaaccatttcgaccgatcaagccaacgcacaatcgcaaatgaccgggcggattgttgatacctacaccaacatcaccaccgtaaagctgttctcccactctcagcgcgaaaccacctacgcaaaatcgggtatgaagcagtttctacacacggtttaccgccagatgcgtaccttaacctcgcttctctacagtgtggatctgatcaactatctgttgctgtttagcattgcagccctctcgatccagttatggctcgcggaaacggtcaccgtcggggtgatcgcaattggcattacgatcgcgctgcgcatgcaaggcatgtcgaagtggatcatgtgggaaattcgcgctctgtttgaaagcgttggcaccgtgattgacagcatgaacaccatagcgaacccagtggaaattgaggatcgcccacaagcaaaatcgctccaagtgaaatttggtgagctgagcttctcgcaagtccgttttggttacagcgcgcaaaaaaccgtgtttgacgatctcaacttggtaattcaagccggagaaaaagtcggcattgtcggccgctctggcgcgggcaaatccacgttagtcaatctactgctgcgcttttatgatgtgcaaagcggtcagattcgaattgatgggcaagacattagccatgtcagccaagagtcgttgcgccgccatatcggcatgatcacccaagatacttcactgctgcaccgctcgatccgcgataacattttgtacggcaaccccgatgccgatcaagccgccatcgaagaagccgctcgccaagcgcatgctcatgatttcattcaggagttgcaagatgaacaaggccgcactgggtatgatgttcaagtcggtgaacgtggcgtaaaactgtctggcggccaacgtcaacgtattgcgatcgcacgcgtgctattgaaaaacgcgccaatcctgatcatggacgaagccacttccgcactcgattctgaagtggaatcagccattcaagagaatctgcatactttgatggcaggcaaaaccgtgattgcgattgcgcaccgtttatcgacaattgccgcgatggatcggctgattgtgatggatgaagggaaaatcgtagagcaaggcacgcatcaagagctactggcgcacaaagggatttatgcccagttatgggcgcaccagaccggcggttttattggcgaagcctaattcttgagacacgataaagccccgcaaggggctttttactgcgcctcttcggcacagtgcatacggtgaaacacgcggtgaatagcgggggcaaataaagtagcaagggagacaaaaaacaccgtctcaatgaataagctataaaaagccaaaaagaggtgtaaggctgcagattggtggaaatccgccaccggataagggagctcaaggccgctcaccatcgagagtgcattaagccaagcttgagcagcagccagctccgccagcaacataaagccaatcacccctggcagcagaccaacgagcaataccaataaagcaatcaacgcatagcgcaggcaacgccacacaaatcgctcaaacgaaatgacttcttgatgaatcgactctaaacgcattcgcctctcctccattggtcataggtggattatccgtaagtgctaagacctataggcgcgaaaaaccataagtgctaaaacccataagtgcatgagtcttagcataaggggcgaaaaataaaaggaaagcacagactgcgcgcgatggaacaacgctcgactttactggcttagatgcgctgcaagagcttggcaataaacgccagctcctcatcgccctgacctgcggttagggtttccagccacaatgattggctgtaatgctcgccgcgcagcagcaaatggcagccttcaaaatcaattagccaagtgtgtagatctgcatcgcactgcttttccaacacccgagcggaaagcaggttcaccaaacgcaaagcggtttcagcaaaagcctcaaaatcgaagttttcggcgcgcacaatcaagcgcccttccgcggcaagatagtcgcctaaaccgaactcagccatgataggtcaaatgctcctgaatcagatccaaaaacgggtcggcgtatttttccagcttgcgctgcccaaccccattcaccgccaacatttcgccataagaggttggcatgatctccgccatatcaatcaaggtggcgtcactgaacaccacatacggtggtaacccttcgtcatcggcgatcgatttacgcagcttacgcagtttggcaaacagttttttgtcgtagtttttgcccgacaatttgtcggatttcgccgcgcgcgccgcggtatctaaacgcggtaccgccagctcaatattcatttcaccgcgcagcaaagggcgagcttcttcggtcagttgcaatgtcgagttgcgcgtgatgttttggtagagcatgcctttgtggatcagttggcggaaaatactcacccagtaatcgtggctgtgatcgcggccaatcccataagtggtaattttgtcgtgaccatgttcgcgaatgcggatgttttgcatgccgcgcaacacttccaccacatagccaatcccgaagttttgattgacgcgatagacacacgacaaggctttgcgcgcctcttccgtggcatcaaaacgcttgggcgggtcgaggcagatatcgcagttaccacatggcttatcgcgatattcgccaaaataattgagcaatacttggcggcgacaagtttgcgcttcagcaaacgcgcccatggcggtgagcttgtggctttcaacctgtttttgcgcgccatcgggcttttcatcgagcatacggcgcagccagttcatgtcggcagggtcgtacagcatcatggcttcagcaggcaaaccatcacgccctgcgcgaccagtttcctgatagtaggattcaatgttgcgtggaatatcaaaatgcaccacaaagcgcacgttgggtttattaatccccatgccaaacgccacggtcgccaccacaatttgcaggtcatcacgctgaaacgcttcttgcacccaagcgcgctcatcggcatccatccctgcatggtaactggcggcgcgaatgtggttgccgcacagcttttcagtgagcatttccacttttttacggctgccacaatagatgatgccgcactgcccgcgctgagtttccagataacgaatcacttgtgaaaccggcttatgtttttccaccagcatgtagcgaatgttcgggcgatcaaagctgcccagatactgatgcggctcattgagctgcaaacgctgcatgatatcgtgacgggtcgcgtcatccgcagtcgccgtcagcgccatcactggcacattcgggaaacgctgcttaagctggcctaatgaggcgtattcaggacgaaaatcgtgtccccattgcgaaatacagtgcgcttcatcaaccgcaatcatggctaacggcagatggctgagccgttcgataaactcggcggtcaatacccgctctggcgacacatacagcagcttgagctggccagcatgcatgcggttataaatcgcgatcagttcctcgcgcgccaaggtggaattgacacactcggcggcgacaccgttggctttaagctggtcaacctgatctttcatcagcgaaatcaggggagaaatcactaacgtgaccccttccagcaccagtgcagggatctggtaacagagcgatttaccaccgccagtcggcataatgaccaagctatcacgcccagccagcgccgcctcaatcacctcttgctgaccgacgcgaaattgctgatagccaaacacctcgtgcaaaacacgttcaggagtggcaaagagagcagaagattcagccattaaagtcgcggtcatatcgatagagtgcaaagtaagagtcatgggtcgccaacaagctggctattgtagaggggttactcggtgaataaaaccgcaaaatacgtacagtgtacgattctcaggttatacttcgctgctaccgccgccaaagcggtcatcaccataaccagagaagttgttcatgacacccgaccaacaagatgccaaaaaaggaattttgctcgcgatcagcgcatacaccatgtggggcattgcgccgatttatttcaaagcacttggcgccgtatcggcgctggaaatccttagccaccgggtggtgtggtcatttgtgttgctcgcggttctgattcacctcggtcgtcgttggcgcagcgtcgttggcgtagtacacactccgcgcaaattttggctgctgttagtgaccgctttgctcgtggggggtaactggctgatttttatctggtcaatcaacgctaaccatatgctggatgccagtttgggttactacattaatccgctactcaacgtgctgctcggcatgctgtttctcggcgagcgcctgcgtaaattgcagtggtttgcggtcgcgcttgccgcgattggcgtgggcattcagttagtggtgtttggctcagtgccgattgtggcgattgcccttgccaccagctttggtttttatggtctactgcgtaaaaagatccaagtcgatgcgcaaacaggcttgttccttgaaaccctgtttatgctgcctgccgccgccatctacctaatctggctcgccgatacgccaaccagtgatatggcactcaacacttggcagctcaatctgctcttggtttgcgctggcgtcgtgactaccttgcccctgctctgttttaccggagccgcagcgcgtctcaaactctcaacgcttggtttttttcaatatatcggcccgagtttgatgtttttgctcgcagttttggtctacggtgaagcctttaccagcgataaggcgatcacctttgcttttatttggagtgccttggtcatcttcagtgttgatgggttaaaagcaggacacgccgcacggcgtgcacgttagagctcgctaccgaggtaagctatcccggcttacctccctattccacctcgtctaactcgttcaatcctgagacattgctgcataaatcatcgatttagccaacaagccgctagaacaaaactttaacccaacgttaacatgacctcttcataacaacgaaaatggagatgggcatgaattggactcatacccccttggcgctttctgcgctgatgtttgcgatggctgcacaagctaccccgaatcaagccaccgatgcggttgcgccagaacaagccactggctttgagcacaaatcgttagtcaaagccaaaaactggatggtcacggcggctaacccactggcgagcgaagcaggggcttcgattttacgccaaggcggtaatgcgatagatgccatggtgacgacacaactgatgctgggcttggttgagccgcaatcatccggcattggcggtggctcgtttttggtctactgggatgccaagaaaaaagcgctcactacgttcgatggccgcgaaaccgcgccactcaacgccacacctgaactatttttagatagtacaggtcagccaatgaaattttacgatgccgtggtcggcggtcgctcggttggcactcccggcacggtcaaactgctgtgggaaacccatcgtcaatacggcaagctggaatgggcgcgcttgattgaacctgtcgccaaactcgccgagcaaggctttgaggtaagtcctcgcctcgcggcactcattgcagaagataaagagcgtttaggccgttttcctgccaccaaagcctatttctttgatgcacaaggtgaacccctcacagccggcactttactgaaaaacccggactacgccgccacactcagagccatcgcacagcaaggcgcctccgccttctatcaaggtgacatcgccaaagacatcatcgccacggtgcaaaatgcgccgggcaatcccggagtgctcgctcagcaagattttgatacgtaccaagtcaaacagcgtgcgcccgtgtgtgcggcttatcaaagctatcaagtctgcggcatggggttacccagctcaggtggcctgacggtgggacaaattctcgccctcaccgaacaatacgatctcaaaggttggggcgcgcaggatgtgaaatcatggcaagtgctgggggatgcctcacaactggcgtttgccgatcgcggcttgtacatggccgatcaagattatgtgcccgttccgacccaaggcttattggataaaacctatctggccgagcgcgctaaactgatccaacccggcaaagcgctgaccagtgcgccagcaggcaatccgccttggcatcatgcgcagctacgcagccccgatcagtcgatagaactgccctccaccagccacttcaacattgttgaccgtgaaggcaacgtggtttccttcaccacctcgatcgaaaacgcgttcggttcacgcttgttggtgcgcggctttttgctcaacaacgaactgaccgatttttcgtttgccacgcaaagtgaaggtcgcccgattgccaatcgcttagagccgggcaaacgcccacgttcatcgatggcaccgaccattgtcttgcaggataaccaaccctatttggcgattggctcacccggtggcagccgaattattggctatgtggcgcaagcaatcgttgctcacacccaatggggcatgaacattcaagccgcgatcaatcaaccgcatgtgctgaatcgttttggcgaaatcgagctcgaacaaggcacctccgccgagcagttcaagccagcgctagaaagtttgggggcaaaggtcgggatcaaagagctcaactctggcctgcacgccattcgtattactgcacaaggtcttgagggagccgctgaccctcgccgtgaaggcgtcgccatcggcgagtaagcgttaactcaaaaagtgatgggcagagtctgcccatcattttttactcgcacctcatttttcccacccacgcgaagaggcactgatcattttttacaagacaagctctgactcaccgcttaagattttggtaacttagcctactttttggtctctatggatacagtgaattatcgccccagcgcttaccccgcgatcagtctgattgaagccgactatcgccagtttgcgtttgagcgtcactaccatctggatatccatatcggtctcatcacccaaggtgtacaacgtttttatcaccaaggggcttggcatcaagtgggacaaggtggtgtggtactgatgtcacccgatgaattgcatgatggccacgcgcacagtaatacgggctatcaagtacaagtgttctccattgaacctgaatggttacagcagacgctcgaagccaaccagattgagcaagtgatcggctttgagcagttgattgtacaagacccgaccctatttcactccttgcagcaacttcaccatttgctgcgacaggacaacctcagccagctcgccaaagattgcttaccttatcaaggctttgctccgctgcttgagcgttatagctacctaaaacaacccaccgtaaaaccgcttggccaacacaatctcgccctactcaaagagtgggtactcagccagcttgaccaaccgatccggctcgaacagttagcgcaattgtgccaactctccccaactcaatttcagcgccattttaaagcgcaaacggggctcacgccttacgcttggttacgacggctacgcctagagcaagcaatgaaactgctgcaaagtggcaaaccaggcacagatgtcgcgtatcaggtcggcttttacgatcaggcccatttcagtaaagccttcaaagccacttatggcctttcgccttctttgatcactcgcttttcttaaccacgctgtcaaaaatttacaagctcctcgcgctcgccgcgcggcatactgggtgaataatgtgaggagaaagcatgaacgaaatgtccattttagccaccttagccggtgtgcattttattgccttattaagcccggggcctgatgtcgccttagtggtgcaaaacgctacacagcacgggcgtaaaactggcgtgatgatcgcgttaggtttgtcgtgcggcattttagtccatttgattttgagcctgtccggcattagctacttagtcaaacagcagccaatgctgtttaacctgttacaactggccggcggcagctacttgctttatttaggggccggcgctttgcaatcagtgatggcgcaaaaaaacgctagcacaccgacgcacagccctgcgccctccattctcggcaaccgccgtcaagccttcacaaaaggcatgatgaccaatctcttgaatcccaaagctctcgtgttttttgtcagcctgttatctagcctgatcccagccagcatgtctgtgtctggcaaggtgagtgccgctgcgattttggttggcttatccctaacttggttctcctgtttagcttggctgcttaccacgtctgccatgcaacaacgcatgcagcgcattacgcgatccgtcgatagcatatgcgctgcggtgtttatcttggccggtggcgtgattttatggcaagcaagccgcgctatagcacaaaccttcggatggctatgatccgactttggccgatcatgctgtgcgagatctcttacaaagcggtaggacaaattcgctttctgcgataaaaaacactgacaaaaacaacataagcaattgtttttaaataaaatgttcaaaatttcatcatttcgaacatcaagaaatcgcttcgctttgcttgttcagaaagctcagctcagtaagatgaatctcgtcggaaggatactgacacggaacaggaaagcaccaaggattggtgatcttcaggaagaagaatcgaacattcaggatgaatgctcggcaaggaaagcgtaattggacattgaacggacgcaatcgttgctaggatggtaacgacaaggatgggaaatggacacctctggacgaggcaaggactgaacatcaggatgatggcagggacaccgctcagggaacaagtgatgtgaactcgctaggattgtgagttgtaatggaagacacaggacaccgctaggatggcgatgcaaggattgagctgacggattgcagcgtactatcaaggattagatgcagggagcaccttttagtagctggaatgctgcgagtaagactctaaccccggtgggcttgcccccggggttttcttttttctcccgaaaagtcatcaccacttaactcctcaacagaaacgttaatcgttacttcgtatctaggggcaaattggcaatttcttcccgacctccccctaaaagggggagccacgtcgccgcactattctatctacaccttctctaatctcgcgtaagccgtgactaaccacttaatgccttcgccattaaacgccacttgcactcggctttgcgggccactgccttcaaagttaatgatggtgccttcaccaaatttcgggtgacggactcgtgagcccaaattaaaaccggtttcgttaaagctttctttgactacggtttggctaaagcgccctgtactggttggacggctgacttgcgccttcatgcgcacttcatccaaacagccttctggcagttcacgaataaagcgtgagggtttgtgatacttatcttgcccgtacaaacggcgcatttccgcgtaggtgatgtagagcttttgcatcgcgcgggtcataccgacgtaacacaggcgacgctcctcttcgagacgccccgcctcttcggcagacatttggctcgggaacataccctcttccacaccgaccataaacaccagcggaaactctaatcctttggcactgtgcaaggtcatcagttgtaccgcatcatcatgctcatcggcttgaccttcaccggcttccagtgccgcatgggtcaaaaatgcggtcagcatggtcatctcttgcgcttcttctggcttttcaaactggcgcgtcgccgtcaccagctcttccaagttttcaatccgcgctttggatttttcgcctttttcttgctgatacatctccagcagaccagaggtttttaccgcgtggtccgtgagcacatgcagcggcatgtcgatgccttcctcttccaaggcgttgatcagttcaacaaagcggctcagcgcgctcgcagcacgcccagtgagcacttggtcattgagcagaccgacactggcatcccacaaggtgcagccacgatcgcgcgcggcaaagcgaatggtctctagggttttatcacccaaaccgcgcggcggcgtattaatcactcgctcaaaggcggtgtcgtcattgcggttattaatcaaacgcagataactcagcgcatctttgatctcttggcgctcgaaaaagcgcatcccgccataaatgcggtaggccaaactcgcttgcaataatgcctcttccaatacccgcgactgggcgttgttgcgatacaagatcgcgcaatcggtcagtgtgccgccctgctcctgccagcctttgattttgctgaccacaaagcgtgcttcatcgagctcgttatacgccgagtacaccgaaatgggttcgccgaccaaaccgtcagtccatagctgcttgcccatccgctcgctattattggcgatcagtgtatttgaggcttccaaaatggttttggtggagcggtagttttgctccagtcgaatggtattcacgctcgggaattcgcgggtaaatttttcgatgttttccactcgcgcgccacgccagccgtaaatcgactggtcatcgtcacccacgatcatcacgttcgactgagcacccgccatcatacgtagccacgcgtactgaatcgcgttggtgtcttggaattcatcgaccaaaatgtgcttaaagcgcgcctgataatgctcgcgaatgtgctgattaccacgcagaagctctagggcgcgcagcaaaatttcggcgaaatcgaccaagccggcgcgatcgcacgcttcttggtaagcggtgtacagcttgagataagtttgagtaaccggatcaaaggcgttgatgtgcgtcgggcgcaatccttcatctttttgattgttgatccaccacgcgacttggcgtgccggccactgtttatcatccagattgtgcgctttgatgaggcgtttgagcagacgctgctgatcgtcactgtcgatgatctgaaaatcttccagcagcttagcgtcgagataatgggcgcgcagaatacgatggcaaataccgtggaaagtaccacaccacatgccagaggcggtgccatgcatcagctcttcaattcggccacgcatttcggctgcagctttgttggtaaaggtcaccgccatcaccgaaaacggtgaggcttcttccaccgacatcagccacgcaatccggtgcaccagtacgcgggttttaccactgccagcaccggccaaaatcagtaagttttccagtggcgctgccaccgcttcgcgttgtttatcgttgagaccgtcgagcaatagagagggatcgatcatgacttcgccactggttatttatacataatggcggcgattataaccccaagtgtcgcagatacccaaacgtcttgaatgggcgcagcggtggccggaaaaatttcagcccacacgaggtgggctgaaagtactatcgattacgcggcgattccggcatgacgcaacagagcatcaatttgtggttcgcggccacggaagcgcttaaacagctccatcggctcttcgctgccacccatctcaaggatgttgttgaggaagctttggccagtctcacggttgaaaatgccttcttcttcaaagcgtgagaatgcatccgccgaaagcacttctgcccacaagtagctgtagtaaccggcgctgtagccacccgcaaaaatatggctaaagctgtgcgagaagcggttccactccaagcccggcagcactgctactttctttttcacttccgccaaggtttccagcactttgggccccacttctgggtcgtaagtggtgtgcagcgtgaagtcgaacaatccgaactccaactgacgcagaataaacatcgccgattggaagtttttcgccgccagcattttatcgagcatggctttcggcagtggctcacccgtttggtaatgaccagaaatgaacgccagcgcctcttcttgccagcaccagttttccaagaattggcttggcagctcgactgcatcccaaggcacaccattgatgccggataccgcgcccacttccacttgcgtcagcatatggtgaatgccgtgaccaaattcgtggaacagagtcgtcacttcgtcgtgggtaaacagcgcaggcttatcgccgactgggcggttgaagttacacgtcaggtaagccactggtgtttgcagtgcgccactgtcggtagtgcgacgtacacgacactcatccatccacgcgccaccgcgtttgtgttcacgcgcatacaggtcgagatagaagctgccacgcagcgttccttgcgcatcaaaaatatcaaaaaagcgcaccgattcgtgccatacatctaccccttggcgctctttgacttgcatgccaaacaaacggctcagcacttcaaacaggccattcactactttttgttctgggaagtaagggcgcagctcttcatcggagatttcaaacagatgctgcttttgcttttcgctgtagtaagcaatatcccacagctcaagctgcttgacgccaaactcactttcggcaaattggcgcagctcttccacttcacgctcaccttgtggtttggctttgttggcgagatcatttaagaaaccaagcacttggtcagtggtttgcgccattttggtcgccagcgatttttcgctgtaagtgctaaagccgagcatacgcgcgatctcatggcgcagtttgagctgctcagcaatgatttcgctgttatcccatttacccgcattcgggccgcgatccgaagcgcgcgtgacatacgcttcatacacttctttgcgcagtgcttggttatcacagtaagtcatcactggtagataagacggaatatccaaggtcagcagatacccctctaaacctttggcttcggctgctgcttgtgccgccgccagtgccgattccggcatgcccgcgagcaggtttacatcggtgatctgcttggtccaccccatggtggcatccagcacgttgttggagaacttagagccaagctcagacatacgcttactgatttcgccatagcgcttttgctcttgcagtggcaagccgatgcctgacaattcaaaatcacgcagactgtcgctgatgtttttttgctgcgcgcgatcaagcttggcaaactccgcgctctctttaatggttttgtaggcttcaaacagccctttatgctgaccaacccaagtgctgtactcggacaacagcggtaagcagctttcgtaggcttcacgcagctcatcactgttcaccaccgaattcatatggctgaccggtgaccagatacgacttaagcgatcatcgacctcttcaatcggcgcaatcacactttcccagctcggttgtggattttcggctaaaaccttatctatggtgtggcgacaatccgctatcgcctgctcaaccgctggctttacgtgctccggtttaatcgcagaaaacggcggcagatccgtaaaggtaagaagtgggtttgacataaaaagattccttttcagcatagagacaggccgaattttgacctgtgagttgtataagtaaatataggtagcagaacgatttttcaatagctgacccaaggaaaagcgttgcaaaatacgactcactcgcgccttaagccgcctaaaaaaccatgccgttacgctgcgcgctgcacgtaaaatcggtatataatcgagccaatatttttgtttctattactggacgcaagtcaatcagcggtcagtacagcgcccctcaagcgggtttgagagtctattttgttaagttaccgacacagtttccatgcaggcaatcatgcagatgtgctcaagcacatagtacagagcctgatcctcaattctctgcaacaaaaagagaaaccttttgtctaccatgatactcactctggtgtgggtcgttacgatctgacccatgagtggtcggaaaaaaccggcgaatacaagcaaggcattgcccgcatttggcaacaagacaacattccggcagagctcgatagctatctggatgcgattcgccagctcaatcaaggggaaacactgcgttactacccgggttcacctcgagtcgcccgcgcccatctgcgtgagcaggatcgcatggtactgactgagctgcatccaagcgattacccattgctggagcaagagtttcaccgcgatcgccaagtctctatctataaagaagatggcttcgcacgtctgaaagccagtttgccgccgcaagaacgccgcggtttagtgctgattgacccgccttatgagctggctaaagagtaccgcgatgtggtgcgcgctatcgctcagagttacaaacgctgggcaacgggtatttatgcgatttggtatccagtggtcaatcgctgcgatatcgatgacatgttagaaggcttgcaaggcttagagatccgtaaaatcttacaaattgaactcggtgtcgcgccagataccaatgagcgcggcatgaccgcctcgggcatgatagtgattaacccgccgtggacgctggaaagccagatgcagaccattttgcctttcctcaaacaggcgattgcccccgctactggacactataaagtcgagtgggtggtaccagaataagctgttttttcatcaaggcgggtggattgtgacgccctagccctgatataaggaatacaagaaaagagcgaagagcatcttcgccagacataattggagaaagtaatggcaacacattttgactacctgtgcattggtggtggcagcggtggtatcgcttccgctaaccgcgcggcgatgtatggcgcgaaagtcgctctcatcgaagccaaagatctcggcggcacttgtgtcaacgttggctgcgtaccgaaaaaggtgatgtggcacggcgcgcaaatcgcagaagcgatgcacctttatgcagaagattacggctttgatgtcgatgtgaaaaacttcaactgggcaaaactggtggaaagccgtcaagcctacattggccgcatccatcaatcttacgatcgtgttctgggcaacaacaaagttcacgtgattaagggcttcgctaagtttgtggatgcgaaaaccgtcgaagtgaacggcgaactttacacggctgaccatattctgattgccgtaggtggtcgcccaagcattccaaatattccaggcgcagaatacggcatcgactcgaacggcttttttgagctgagcgagcagccaaaacgcgtggcggtgatcggtgctggttacattgcagtagaaatcgccggcgtgctgaatgcgctaggtacagaaacccacctgttctgccgcaaagagtctccactgcgtagtttcgaccccatgatcatcgaaaccttagtggaagtgatgaacagcgaagggccacaactgcacacccatagcgtgccaaaacaagtggtgaaagaagccgatggtagcctgacgctgcatctggaaaatggtcagacgtacaacgtggataccctgatttgggcgatcggtcgccacccagccaccgatgccatcaacctagcggcaacgggtgttgcaaccaatgagcaaggctacatcaaggtcgatgagttccaaaacactaacgttgcaggcatttactgtgtgggtgacatcatggaaggcggcattgagctgactccggtggccgtaaaagcaggtcgtcaactctctgagcgcctgtttaacaacaaactgaacgccaagatggattaccagttagtgccaaccgtggtgtttagccacccaccgatcggcaccattggcctcactgaaccacaagcgattgctcagtacggtgcagagaacgtgaaagtgtacaaatccagctttaccgctatgtacaccgccgtcacctctcaccgtcaaccatgcaaaatgaagctggtttgtgctggccctgaagaaaccgtggttggtctacacggcatcggttttgcggttgatgagatgatccaaggttttggtgtcgcgatgaaaatgggcgcaaccaaagccgatttcgactccgtggtcgcaattcaccctacgggctcggaagagttcgttaccatgtagatcggtgtctggaaaatccaccctgtagatttgtaaactctggaaaccatactagcctctatgtatatcaaatacattggagactggtatggttactgtcgtaaattcgaacaattttgacgttccccgaatctatccgccttcaagtaaatcaacatctattcatctaactgggtttcctaccttttactccaaagaccacgaatacctgctcccggtgaacctctggttcaattacttggtgaatattcgaaaagcagtcgatataacagcaagtgttcgcgcccttaagagatattggcagttcttagaaaccaataattattcctgggataattttccagcaaacgattatctaaaacccacctatagattcagaaatgatgacctattaaaagcagcaagaagcggagagatcgctttttctacagcatctatgtacattcttcatgtcatcaaattctatgaatgggcagctcatgagagatttataacttttactgaagagaacaaaccatttaattatcagatagtccatatagctaactcagggatgatgagccacaacaaccctaggtttacagtacgttcaactgacctcagaatcagaaaaccagcaagaaacgaacaacaaaaactcaatccattatctcaacaagaactactatttttcgctgactgccttaaagaatgttccgacgaatttatcattcatcaattactccaaatacagtctggattgcgcgttgaagaagcttgtacatttccattttctattgttgagatgcctaaccctcatattcatagatatgaagtagaaattggtattcacaatggtgtacacacaaaattcaacaaaacacgtaaagtcgaaatacccaaccagctaatgcgaaaaatgtatgattactcggttagtgaacgtcgactaaagcgagaaaagaaaacagatggtgtaaataaaacactacttctgaataatcttggaaaccctctttgcagcaataacatccaacaacattttcgtcgattaagacatcatattcaaaataaacataatattgtttttagtcatcggactcacgatttaagggctacttatggtacctatcgcttggattcattgttggatcaccttccagttggtgatgctttagctttaattatgggatggatggggcacaaagatgataaaaccacatggaaataccttcgatatttaagaaaagaaaaagcaaatcaaaatgcgattgtaatgcttgaccaaatattggaggaagcaatgctatgacttacacgcctcctaagctaacaatcaaacttcgcacaggaataaaacaaacgttcacttatgacttcactcgttttttctacaaaggagttgcttttaaaagagatttacagcgagcagaacctgcacatcgagatgctgatgttctgagatggtacagaatatttactgagacaaacgaatactctgatctgacaaaacaaagctacctaagagattttgcgaaatacgttcgcttttgtgatacgaaaagacttaatccggaaagctctgccgcagttgagtcatgggagagacacttaatagagcaagttcgtatatcttcaatgaacgtcaattctgcgcggaaaatgatttcttgttcaaaaaaatgcttggaaatgcttggtaacccaagctcagaatggttctctccttatggattgtttcgctctgaacctaatcctactcaaggttattcagatcgagagctgtcttccttaatcaaaattattaactcatttttcagacaggtatccaaacaaatcatggagaacccaagcatacatttgaatgcctcaaccaataaaagaactgcgacctttacctacaacaaccatacacatgaaatcgcctcaccaataacaaaatgctttagtgccgcctacttcatgttgtcctattacacttggggcaatacaaccgtccttctcaacatgacaaagccgaaagaaaaaatatttgacggtggtaaatggtttgagcaaagtgttttaaagcctagggcaaataagtatgtatctatatcgattggggataacggtacatttcatgttcccaaaatagcacttagattttttgagcagctattgcagcttagtagccttatttcttcggatccccatttgctctggcaaaccaaaagagaccatattgcacctttggaacaaggacatatacaaaccttctctaaatggctgtatgagacgtttgacctaaaatctgatgatggtgagccactaaggccaatggcttcgaaatttcgtgccagtggaagttgccgctatttagcaaaaacgggaaatacaactgaaacagcattgctcttaggcaacaccccatacacgttatcaaagcactattcttccggaaatcaggttgagaaccaaaaacaattgcttgcagcaactcacacaattgaaggcgcagctcggtgttcagatattaattccgcaaaagaatttgcaaaaaaagagttgggagtagaagttcttccgtacgaggagttccttgcaaaatatgcagataagcacggcgaaaaaacgattataggaacaggctgtaaaaatgtctattccagtcaggctgacaaatatcgaaggaggaatcactttagcccgaaagactttaatgttgaccacctggcttgttctgacattcataattgcttcgattgtgaaaatcaggtcatcattgaaagtgtcgaggatatctggtgtctactgagttatcgagaatcgatcattgattcaaaagttcaccacctcaatgagcagcattttaataaaaactattcagaccttttaaactcgatcaatcgcattgtcttcaccatccatcccaaagtaaaaagattagcagaaaagaaactgcagaatgaaggaagacaccctctatggccagaaggaatcaacatcgatttttaaggacaacctatgacaccattgtttgaactgcctaaaaacatcctcaaagagaacctttctgaatataaaaacattgttcaactttattctgacggaaaactaaaaaaactcgatgatgttgtagtaacaaagaattttgacggctctcccaacagccactttggtgatgaagaatgggacttccgtgcatatttagatgcaagaatcgtttataaaaaacgcattgttttctcaaaaatagttagtgatgatttggctagagagatgaagctaatttgcttttgctggctttatattgcaggacatcatagaaaaggtgctgtcataaagccttcaacgttaattgctagattttccaaattaagcattctttataaatttattgattctaaaggcttccaatctattaactcattatcatctgaaatcgtttttagtgaattttgtgaataccttaaagggcaaaactacagttctgggcaagtcgaaggtatttacaatgcattgatgcatgtaaaaaaagcagcgaggtatctccccatacaatttgaaataccacaaggacgcacccagtgtaaatttggtagggaaataacggggagactctatgaaggaaaaaatcagttctatgcaattccgaccagactcatggaaaagatataccgatattgttttgatgtagtagaaacttaccatccctataaagaagaaatacatgaactactctatgacatgaggcaaaactatgaagaagggaaacggagagtagacgacaaaatacaaagcggtatatggcaatggataagtgaagaatccaatgaatatcgagttgaagttaataaacatcaaccagcaagttacagcagcattattgacgcccacattaaagatacccacttagaaagcttactccccaaaagtgcattacgcattcaaggaaccatcattgaaattcaaaccatatgctttattgtctgtggtgcattaaccggtatgcgccgttcagagcttttttgtctccattcaaatagtttcaaagaaaaagaaatgtacggtaaaaaatactacacacttcaatcagaacaacataaattttctcaaggtcgagggaaaatggcggaatgggtaacaacaaaatttactcaaaaagcaattgaactagcagaagcaatatcaaggtatatgcgcatacaattacttgaagacgatgatccaatgagcgttcataattctagctgcttatggttaggccaaggacgaaaatcgcaaaagcccattattcgacaagacaataatatgcgtacccattttttaaaaatatgcgagaaagcgggtgctttaataaccgaagatgacctcgatgagtttagagtcatcaatccaaaccgtgaaccaaataatgcggatgagcgtttaaaagtcggaaatgtctggcccttgacgacccaccaactaagacgaaccttcgctgtattttcaaaacgtcataatctttgtcacgatattgcgataaaagaacagttcaaacacctagatctacccacaacagaatggtatggagaaggtggtcttgccagcaaaataaaagcactacagatcgatacagagcttcaatcattcctcaatgacgtaatccaagagtctacgacacagaaaattcatgaatggtataaaggctgtgattcaggtcaactgatggggcatatggccggttcaatcaataaaaaccgaatatctcttcacaaaaaatataaatcatgggatgcgattaatgagcatgtaaaagctggtcgattaacccttgtaggcacgctacactcttactgtatggctggctacgaatgccagatgcataaggttagttccccagccaactgtatgagttgtgaaaaccagcttatcgataaagaaaaagctgaaaactgggacaaacgctatcaatgggtatgtaaacaagttactgacatggaagctataggttcactaacatcttccatgtattcacatttcattacccaaatcagagctgctgaaaaagttctccacaaatttcagataccattcactagatttgagataggtaacgatagatatgagcaaatcccaaattacgaaggttgaactagagcaagcactaggaagaattttatcgggaaaaactcaccgcgtagatcctgcaaggaagatatccgttaaggctgtcgaagaagaagctggactcggtgatggctctgcctattactacaaagatatagtacaaaaaatcaaagagtccgctatccggaactcaccgaaaataaggaatcaaaatgcatatgaagataagatttctagcttaagagatagattaaataaggaaataaaattgaaggaaaagtaccgagagcaagtagaagatttaaaagaacaactatctagtatggcgagccaacataaccagctcaccttaatgattcagcaatatcagtacaaaatttcagaatttgaatccgatattgaacaacttccgaagtacagtgaatgaattagtatacctaagattcgattttcttaaatacagtaattaactctctttctttcttaccaagccaaaagtccttgcggccaactatcagtaagagcatagactcgtcggagacaatatttcttctccaagaatgtctatctgtcgcggaggggaatggtctatcttccgggtgtgtgtgccactccccaaggtacagatgagtaccagcagatctttcaaaggcctcattcactcgtgactgatggtgaactcctcgacgatcaactctgcacctctgacgaatgtcgccagacccaggttcagagatatcgcaaacaaccaaatgttgtcctctacgctctcctataaggacaccagcagactcaggggtaagatgatggagctgacgataagacagtaaccgcgttactacatgtcccataatgacaacaaggcaatcactctcatctttgaaaacaagttcgacatcactcatcacaaatattacatcctgagaagcgctttagagttctcggctttttcgaacgagaaccatctaacatatgctcactatagttccagggaagtgtatgctctagcgtattcaagacggcctcctgagctaaagccgccgttatatggcttactgcagcatcatatggtgtatatgtactcccacaacttatgtgcttctcttttgccagatcaatgccctcaaaacgaagatctatgttgtttcgataaactgctggatcagccatcatacaaccataacagcagcgaccatcatcaaccaaaacctttgaagcccgtccattaccatcattaaatgcatgaataagaacaggcctaatatctgcaattagagtcctagccactgctgcaagacgtttggaaacaggtgggcgacctgttgcatcaataacaatgtcatatttcgatagaacatctgcctggatagggaactgtctgtcaattcctttaatactctgagcgatatggacggcttccttcaggctattggctaaagctatagatttcgctagaccaaagttatgagctgtcagagaatgccgagcaaaattgtgtggtttgaaagaatcattatcataaaggtggaagtaattttctccgcagccagcaccactacgcagcagcagttctgccaaatatccacctatagtcccgcatccaataagagcaatacgcttctgacttaaatttccaacgtctggtcgcaattgattacgacttagtagagtgtctcgatcagctctggtcacacctagccgcttaaagttggcactcacaaacttgccacctaataatgccgcttcattatttatgttccgctttctagcggcattcctaccaaagtaccgcttaccaataacatctaaattcagctccaagtaaacggccaattcatcttgcccctccacatcaaacaacaatatgtgacgttttgtcctcttggccatcaagagagtaaccgtccgagcatgcgcagagtaatcaacgagcttcaaccaacttaacacctcacgaaggcaagatggaggccagtttacacctgccaaacggttcggctttactgatatacaatgtgttgtaattgacacttcttgcagggagctttcatcgaactttctttggttcaaccattttactaactcttcactttgctcagagcaagcagctacgtactctctccggatagagccactacttagctcagcttctactagatgagcctttaactgagcttttctcgatggcttagctaacaggtagagctcttcttctgattgccaataagcactaaactctccttcaagctcaacatcatttgatgttccactctcgacagatgcgacagagttatccaaggttagctgtatttgctcatccacatcttgataagttgactttagatcattggagttccaatcagcctccatttgagtaacatagcacaggcaaaacccgaaattaatgtgaggcagtagtcgacctttatactgttcaggttgctgcagaatatacgcaaagggtaactgtatgtgcgggtcattccacagaaccaaagcaattacaaataccccacctttagtcgagtactcttttacgtagtagcctttgcgtcggctttttgtatccaacagaatgcctttaggcatttgtttagcgggcgtataacgaaatccgcatcccagtaatgtatgatgtaattcctgcttcactttcagccacttaccattgtgctgctgattttttcaggtttcgaggctgaactaggttcttgagcgaaagccggtaaagcctttgccaaaacaataagctcgctattagtaacacgattcccaaacgccatattaatctttttcaaggcctctgacttagagtcagctgactcagcagatgacagaatctctggcaaacgctctagtttgctcataatgtccatctcccgagggccatgcttataagagggtgggaagagtggcttttcatcggtactgtcagggctctctactcccctagcaaactcactaggtaaatgcttagcaattatcttcattgtttctccgagatcactagcatcatgagcaacgctatcaagaatatttaccgttgcagccataagactaatcgatgacggacctccaacatcccactgcgcatctctccacgctttcataaagcgacaaaccttacgaagatgtttaccaatacgtatacaactatcgttgaaccaatcttcaactattttggggtcgctattgatccacttccgatcaccttcacgaagagcaaggtttacgttttctgaatctaattcataagtttcactatcgtcagtaattgaatctgcaacatatgattcaaaaatggcacctttaacaaatgatctatttgcttctaaagctatttgctttttctggaactcatctttagggattgcatacattggtacatcaatatgtgttttctctgcctcaatcttaatcctcccacaagtctgcttagcttcaaatttccagccatgattttcagctacaagtgacttaagtgacgcgtcaacaagaagaattagtaaagaatgaccaatcttaggctctgactcaaaaataggcattggcatataggttccatcatcaatatccatttcttgaccaggctgaaacgggcgattcagcgtgtcatactgaaagcttccctgagtccaaaagcgaggtgtcaatcccaaaaactcatcacgagcatcatcatccatctcgtaaataagcttagccacttctcgttgttcgctgtcagaaaggtgcttaatttgggtcgttgacaccttttcctgaataatttcaaacgtaagagcactttttttcacagccttggcaatacccttagcttcttcaaatacatctcgtgttcttaagcggatgatcttacgcaatgcctttagattgttcttctcctcgtctgtaagaactagcttgcccatcaagccatcatttcggtttgtgtagtactggtgaaagttccaagtcattctcactctcctctaagatttacttaaatttgcgggcaggtactttgaaaaaatctgccaatgctttgtttttagtgaactcttcagtagctaactgcctaccgcggctagctaaattactgagcgagcttgcagaagcgttgtccaaagtgatatcactagcggcttcatgaggtatgttgttatccaagcgcacgaaatttcctatagcatcatgtgtcgcaaactctctcaataacattgctttatggagttcttggttcgctgccatggcgctgagaactaacctctcacccattccccataatcctaggtatccactcttcccggccaaactagaagggctaagactgtactcttctcccaatgtccctacgtttagtatctttacatcgctaacctttgcttcaggaaagtctgttgccatatcgcgaaagacttcatgcaagccaataaaacttggattgttagcaaccaatcccccatctgcaaagtacgaatctaagtctacacagtaatgaggagcaaaatatgtgggagcagctgaggtagctaaggctgcatctattagttttatacgaccatccctatgaaactcaggattgtggggcgttttgaagaactgaggtttacctgtagaaagattaactgtaggaattagaactcgacacttcagatcattaaaagtgctctcttctcctaccatactggctatcgttttagccaatggcttactatcataaagtggacctctggccagtcgataccgtctgcgaaaaactgggaaaaatcgtgggtatttctgctctgggaaaatatacccagcttgttttctaaagacatcttccagttctctggcgctctttccataagccaaacccaaagccagaattccaccaatagaagtacctgtaatcaggtcaaaataatctccaactttaaaaccgttaataccttgtttttcctcgatgattcgctctatttcagctaacaagctgatagtaaacaagcctcttgcaccaccgccattcaaactaagaattcggacttggtttttaaggtgttcatattcaggtggatttggcatgtaacctccgttttcaatccatcacctaagtacactttgcataagttgtgacaatagatttaccacgacttacgaccctatcctcactagcttagtcatggctcataccctggaccattgcagcgtggacattgaagatgctcatagctcttcttggtgagcatctcgaatatacgagttactgcaccatgctttttagagtgtcagcaatatccgttagtaaatctttacgggacatatacttcttcctaccgatctttgcttgattgagataaaacagaagcagcgagagttttcgtttcttcactgtatttagtgctctgcaacgctttagacgctctgctttccatttcagagctagtctgcctggaggttgaagtttgtgataaagccgaaccagcaaacgcttttgcgatcgttgaagcatttgggttctttaggatatgagaggcaagtgaagcaacatcacttgaagtctgtttgatatttttaggcataactaagcttccaaaaattggtgataactatttcatgttcaccaggatggatgctaagctaagtgttcgacgtttagatgaacatccatcctagtaggtgatgattgtctttaagtgagcccctgacaatcgttgggggttttctttatctaatacctgttagtttttcctccacagaaagacactacatattgtgtctttgacactacagataacaagataatgttactaagccagtatttcaagttgcatataacacacccactgtggataactccatttaatgccatcacctgttagtatctgctaacctataacctttttaactaaaagcactctcaaaacctcaagcacataactagctaatacataactaagaaaaataaaaatcacttgatctttggttatatatcgttctatgtcctttcaaaaagcaaggccttagttttgaacttctggtgcactattttttgaccagagagcaccttcagaacatttgttaacccattaacctttcccagtagacacgcagaacgttcttttgcttcatcaagaagcgtgattaattttggttccagttcagggaatcgaatattgagagactggtattcgtcaatctcacctaaaacaatctctaactctcctttatattgattacgctcactcactaataccgagtagtcctggttcaaaacaatctcaatatccacattttctgactttggctccgcatgaagagccttgaaagtgtctgtctgaaagtatcgtttttgacgaccactcccttcaccgttaagccaacctttctttataaaccgtaagatttgccgataaacttttttatacgcttcatcaggatcaatgagtgagtcttttataacaataaactcatctcttaattcaattactgaaaaaccatctaatgttctttcaatcaacaacttgtacatctctgcactgatcttcatagaacgtctcatgtatttctaataccactaaaaactaaggattgcttagtatacagaaatgagcaaaactaagaaaatcttagttaatttgagcttcaagattatgagccataagtgtcattccaaaacccaatcccactgcgtctcaaagaagcacgtaaaaaagcaaaactctctcagaaagccttgggagtacgtataggtatggacgaaagttctgcaagtccacgaatgaaccagtatgagaaaggtaaacacacacctgatgttcagaccttaaaattaatagcagatgaacttggagtgcctttgaattatttcttttgtgaggatgatgaatcagcggagctagcttgtttaatccatcgaatgtcccctgaagagaagaaaaaccttctaaaagatttaattagtaagaaatagatagagacactatatttagtgtttaattaacaaaaaacatcaacatatagtatttcactcatctttcataccaccccaaacatacaaacacctgattttattggtattattttttttgatacagattatgaaatcagttggatttagtcgcaaaaatgcgttttttgatataccttgtacttgaaggctcaaggaatatgagtagaatgtgcgcactttactgttcgcaaatcatactttagtgaatggatatttcggtggaaagcaaatgattacaagcattcatgaatatagaaacgcttctaatagcgacaaaaaccgtctctcccataactctaaatcagacactagcggtaatgttgtgctcttttcacagaaagacgcaaaaaaagagaaagctagagccaatcttttgcgtgctgcacaaaaaatccattggtaaccacgttaattcttgattagcaacatagcaacctgagagtatagaaataagtttcataatttcaggttgtttacaatgaataagtcctccgcaaaaaagatcttaagtacagttccttctccaacaaaatcaaattctagctcatcaaatgatctccaaaaacgaatactagaacgacgttcaagagaactagtcattggcctctgtggggctattggctctggtgtaaaggcattaaaagagagtttagttagttctcttgagacatatggatatgaagttgttgatatccggataagtaaaatcatttcagaaaaaactcaaacctcattagatggattgtcggcatttaagcgttacaaccgattgcaagatcttggtaactcgctaagagaaacacataagagctcaattttagcagcctgtgctatcgaagaaattgcgctggaaagaacattaatctgtcaaaatgaaattgatgaaacctcagaagaaaatgacaatgaaccatcgttaataaaaaccacaaaaaagatcgcatacatcatcgaccagttaaagcaccctgatgaaatcaaattccttagatcggtataccctagaaatttctatcttattggcttgatccgtacagaaggagaaagaaggttaaatctagaggaagaaaaaatctctccatcagaaatagatactctgatgagaagggatcgaaaagatgtttctcatggacaacaagtagaaaaaagcctgtttaatgctgattattttattcataacattcacaatcaaaagcaaatgttggataagtcagtagaacggttcataaagctcgttcacggtatcaatggtataagtcctactatcgatgaaatcggcatgcatgctgcttattcagcagccctcaggtctgcatgcttatcaagacaagtgggtgccgcaatacttgataaccaaggcaacattatatctactggctgtaatgatgtgccaagctttgggggcggtttatataattcaaactcattagctgattttcgatgcgtccatactggcagatgctcgaatgataaacacaaagatattctgaaagaagaaattacagatatattgaagaaatcaatcacaaatacccttgagctaaaagaaatcgtcaaccaaataacatctgaaaccaagattaaaacattgattgaatattcaagagcggttcatgctgaaatggattctcttatagcattagcaagaaacaacaaagaaacatctgtagataaaacattatatgttacgacatatccgtgtcacaactgtgcgcgacacatcgttgctgccggaataaaaaaagtcgtatatgtggaaccttatgagaaaagtttagcaatgaaacttcatgatgattctattagtgataatgctgatgcaaaaaataaagtgtgctttttaccattcgaaggtgtgtcatctcgacgctatgaagtatttttccaaatgcacggtgataggaaagacgacaaaacaggcaaagtactcaacatcaatatccaggattcttaccacgcagattctgaatttttagataattacgcagaaatggaagcaaaaattgcacagtcagtaaacgcattgctgaacgttccatcgagtgaagaagagagcatccaagactagctttagtctggaaaattcacttttccagactctaatttttttcatttttatcaaaaaatttaatttttctggaaaaatatactgaggcattgatacataagactttccagaattattttagatttggatataaagagtatggtcacacgatgcggtagcggtatcgagattccgttctactcaaaaagaaagcggccatcgccgctttctttttatcgatttttcttttttagagaatcatgccgaaaaactttacttcacacacaccacattgagcagtgatgagccttttaacacattgactttgccagtggtgaacatccctttacgcccttctccccaatacggtaattgcacaggccattgatattgttgcatctgtttcgactgcaataacgccgaccactcttgttcggtagcgagacgcatacccagatctcggcacacgatttgcgcagcatcataatcgaggcgattccacgcctgatcatgctccatgtaaaactgcactttcgggttgtcgctgtacggcagagcaaaggtttggctgcctactttcacttgctggcgcaatacaaaaccactgtttcccgaaggtttaggtgtgctgatcagttttgctacgggtttggttggcacggcggcaggtaccactgtgggagcggatttttcttcgcttttcggtttgctcgcgggcttaggtgctgaagcttctgataccgctgtgttggcagccggagccaccgcagcggttgtgggtttggctttcatcaccggctgctgcgcagaggttttcaccacttggcggatgaatgcttgctcaaaggtcgccagttttttgacctttttcagctccttgctggcgagagcaaaatcgctataagggccgatcaaacagcgcgcgcctttgggctcaggcttaacccaaatatcggtcgagatatgttcataaagggtttttactgtggcgagcggcatcggtttgcttaacatgccacactggatccaaaacagagagtctccccgcttgggctttttgccccacaggccatcgccaattgggcaagccgcatccagcacaggtaattggttaaccgccgcctgctgcgcatcgcacaaatagtcactctcggctgaagcaatgggggcgaataacagtaaagccacactcaggttgcagcatagaatccatttcggcatccgcttgtctccttaatactctgtgactgaaatcagggttcgaatcaggcaagttatcttgcctcgaacacttattgggatccggtatagcaaaaataaatgcaaaaaaagagccgcattcaaatacggctcttagtttatggagagtttgtgaagcaaatcaatcggatttacttaccctttgtaaattttcgggttaaacacatcacgcaaccaatcgccaagcaagttaatcactaataccagcaataccaatacaatgccgggaaaggcggttatccaccatgcacccgaaaaaatgtaggtaaaaccgatactgatcagagagcccagtgacggctgatcgaccggtaaacctaagccaaggaaggagagtgccgcctctgacatgatcgcgtttgccacctgtaccgttgaaatcaccaggatcggtgataaacagttgggcagaatatggcggaacatgatacgcggcgctttaaagcccatcacgcgtgccgcttccacatactcttttttcttctccgccagcaccgaagcacgcaccgtacgcgcgtattgcggccattccgccacaccgatgatcaccaccaacatcaccaccgcatattggctgaagaactcgccaccaaaactggctttaaagatcgccgacacaatgatcgccaccatcatggtggagaatgagagctgaatatcggcaaaacgcattaaaaagctatcaattcggccaccgaaatagcctgccgacaaaccaatcacaatgccgagtgtcagttgtaggcccaccgccaaaaagccgatggtcagtgataagcgtgagccgtacagaatggtcgagaaaatgtcacgcccctgctcatcggtgcccagcaaaaagtgttcattgcccccttccatccatgagggtggaagctctgcatccataatatcaatcgacgagagatcgtacgggttggtgggcgcaatcaagggcgcgctgattgccacgatgacaaatagcacaaacaccgcaaagctgctcatcgccactttgtcgcgcaggaaataatagagaaaatcggactgcttaaagcgctcccaacgtgaaggagcgatcgatactgcactcatggttaagctcctttgccagtgaggttgacggtcgggttaatcaggccatacaagaggtcgacaatcgtgttggtcacgacaaagatcaacccaacaaagatgacgtaggcggtgataagtggcgtatccacacggttaatcgcctctaaaaacaagaagcccgttcccggccactggaatacggtttcagtcaaaatggtgtaggccaccatagtaccaatctgcaccccacccacggtcaataccggcaacatggtgtttttcagcgcatgttggtaatagattttgttgagtggcaaacctttggcttgcgcaaacttgatgtattccgagctcagtacttcgagcatttccgagcgcacgaggcggatgaacagcggcaacataatggaagccagtgcgatagagggcaataccagatggcgcaagccatcgagggtaaagaatccggactcccagcccagtaggttaacggtttcgccacgaccataggacggcaaccaacctaactcaatcgagaagacatacatcagcatgatcgcggttaaaaagaccgggatcgaaatgccgatgctgctgcccgccatcactatcttggtaaacaagcttttcggatgaatcgccgaatagaccccaagcgggattgaaaacactatgatgatcaacgtagcaccaaacaccagctccagtgtcgccaccagcttatcgaagatcacttccagcgccggacgcttaaagaaataggaagtccctaaatccccctgcaccgccgcagttacaaaacgagaatatttaataatgaagggatcattgaggcctaattcgtcacgcagtgcttgacgctcagcttcagaaacggactgacccacaagctcgcgcagcggatcacccaggttgtcctgaatggcaaacgctaccaaactgatcacaaacatcactatcagtgcctgatacaggcgcttgaccagaaacgaaaacattccttgccccttaactttccatgtgaatctgtgggcgcgatgaagcgccaaaacctttcagtctgaaaaagggtacggggcccgactgaaacaaaaccctgtacccgaagagaagctctgtagaccaacgcctacagagcagagtggtccgagattactctttcaccaccagatcgccaaagtatgggaagtccataccgttgatgataggtgcgatatctagcgtatttttcgctgcccatgacggatcttggaagtgaagaggcacaaacgccgcttcgttatacaggatctcttccactttcttcagcatggtgctgcgtttttctagatcggtttcctcgttcgcggcattgactaacttatcgacttccgcattcgagtagtaaccacagttgtactgacctttacccgtattggaatcacgggtcatggtcaggaactcagtaaagtttgctgagtcttctgtatctgggtgccaaccaatcatcagcatatctgccgcacacttatcaaactcaggccagtattgcgcttttggcatggtttttaggtcaactttaatcccgatttttgacaacatcgccgatgccgcttgcgcgatcttctcatcgttcacgtaacggttgtttggcgcgatcatggtcaggttgaagcctttctcataacctgcttctttcatcagctctttcgctttgttgagatcaaaacgtggctttaggttctcattgtaaccggcataaccgactgggctttgctgcgcagccgtggtagctgcccctttcatgaccttatcgacaatcccttcattgttgatggcgtagacaatcgcttgacgcacacgcacatctttcaacgctgggttactgttttggttcatttggaaggtaatcacacgagtgcccggcatagtgaagagatctacacctttcgcatctttgatgcgttggtaatcattcggagaaaccggtgcaatcatatccacaccgccagacagcagtgccgcaacgcgagttgcatcttctttaatcactgccagcgtcagtttgtccacattgcctttcgacgctttatcccagtaattggggttgcgttggaactcaagtttcacgccttgctcacgagccgtcaccgtaaatggcccggtaccagagatattttcagaggcaaaagagttaccgtgcttaacgatttctgctttgtttttaccatccgccgtggtgccggtgtagaacttgctgtccatcgggaaaatgtaggtcgccacgttttcaatcagcgggtaagtgccagccgttttgatttcgatggtgtaatcatccaccttagtcaaagagaccagaggttcaaaaatccctttaaaatccgccgattctttcaaacgattgaacgtccataccacgtcatccgcagtaaaatcattgccagagtggaacttcacgcctttgcgcaaagtgaaacgcatggtttcgttatccacacgctgccaagattcggccagacgaggttcaaattccattttttgtgtaaagcgaataagtggatcaaagaccatgtgcgacagttgcagagtaccgcctgacagctgctcatgtgggtccattgagaccgggtcagcgtcgtaagccacggtaatatccgctgccatcgcaccaaaactcaagccagccgctatcaaagccaacgccagtttgtttttcatggttttcattgcataactccttatgcgggaatccagatccctagtttgttgtatttgcttttgtaacaatcgccaacccaagttggtccatggttaacggctatgctgccgtagtgctttcgcgtaagcctgtaaattcaggcattaaggaaatcaatttcttgctgtattcatgctgcggatcggtaaacagctgctcagtgggtgccacttccagtagcgtccccatctgcatgaccccaacgcgatcgcacatctggcggatcacaggcaaatcatggctgataaacagcatggtaagattgagctcatcttgcagatctttcagcaaattgaggatttgcgcctgcactgacacatccagtgccgaggtaggttcatcgcaaatcaaaagacgtggtcgcgtcgcgagtgcgcgcgcaatcgagatccgttgacgctgaccacctgaaaattcatggggatatttcaaccccgccatcttacctaagccgacatgctcgagcagatcattaacgatttgtcgggtttcactctcgcttcgtgtcaacttatggaagcggatcggctcggcgataatgtcaaaaatcttcatccgcgggttcatcgaggtgtacgggttttggaataccatctgcatttgacgacgcagtgggcgacgttcgtgctccgatttcagcgcggttaaatcgatgccttcaaaagtcactcgccccgcattgggttgatacaaaccggcaatcacgcgcgcaatggtcgatttacctgaacccgattcgccgaccagaccaaaggtttccccttcatgtactgcaaaactgacgttattcgacgcttgcacatactcacggcggctttcaaacagcgaatctttggtcacaaaacgtagattgacgttttcgacttttaacagcggccctgtgtatttgcggtgatcttggctctgccccaaccaatggcttttcacatccaacggcttgagctctttcgcttcttcgatatagctcaccagagggaaacggtcgagtttgcgatcagagcgcggtaccgccgaaatcaaactacgggtgtaagggtgctcaggtgtgccaagcactttggcagtcggaccgaactccaccaaatcaccacggtacatcaccgctacgcgatcagtaacgttagaaaccacacccatatcgtgagtaaccagcatgcaacccacattattcttcttacacagttcgcgaatcagattcaggatctggtcttgaatcgacacatccagcgcggtggtaggttcatcggcgatgatcaaatcaggttcaccagccaacgcgatcgcaatcaccacccgttgacgcatgccaccagagaattggtgaggatactgtttaaggcgattttcaggctgcggaataccgacttgcttcatcaaagataaagcacgttgatacgcttcttcggcactcacctgcatgttggcatgaatggtttcggtcaactgatgctcgacggtaaacagcgggttgagtgaggtcatgggatcttggaaaataaagccaattttactaccacgtacttcacgcatcgcttgcggagaaagaccagagatcttctcaccgtttaaatacacttcaccgcccgcaatagttcccggagggctgagcaggtcaatcaccgcattaccgaccgtcgattttccggcgcccgattccccaaccacaccgacaatttcaccacgttggatatctaaggtgagtgatttcaccgccgcgtgcacaccgtgacgagaagggtattcaattctaagatttttgacttctaaaagtgacattccatcagacctctactgctgtggcagcattctgccctgtctgaagcacatcagcgaacaaggcgagactgatgtacattttgcatccattccaatcagaacaatattctgacaatttataaggttctcaatttggcaaatctttcacacaaaagcaacaaagagaggataaaaaagcgccttaacccagaaacaatttccacaaatcgcttaatatgcaaaaaaatcacatatattattggtcttaccatttttaaaaaattgaagaaatctcagtatggttggtatttgttactgtaaacgacgtgattcataacaggagataaaacaaccaacgcataacttttctccacgcaaaaatggaacaattaacaaataagaaacaattgccaaattttgagtgcaaacaacaaagtaaaactctggatggtaagcatctatccagtcataaaaaccaaaaaactcccaatttaactcagataaatcataaaaatagttcattgagtcatactgaacacttcagtaaccatagtcgtgaacagatgtgttagcggggaaatatcgatgaattgtcggtaagatcgcaatttactagagagaaatatgcccaacaacgtaatgatgaaaaagcggccatcggtagacagtgtcaatgcaggacaacttggcgaggaaacatgaattttaaagagataaaatgcaaaaagcctcagcatttgctgaggctttgaagagtggtcggtgaagagggattcgaacccccgaccctctggtcccaaaccagatgcgctaccaaactgcgctattcaccgactatgttttgcttaagagtctttcttaagactggggataactgaatatcaccgaaataaatggggtggctaatggggctcgaacccacgacaaccggaatcacaatccggggctctaccaactgagctatagccaccactgaaagttgtaataaccgcttgtctgccgttatttcagactacgctcttgcctagtctttcaataagtggtcggtgaagagggattcgaacccccgaccctctggtcccaaaccagatgcgctaccaaactgcgctattcaccgactatgttttgcttaagagtctctcttaagactggagataattgaatatcaccgaagtaaatggggtggctaatggggctcgaacccacgacaaccggaatcacaatccggggctctaccaactgagctatagccaccactgaaattctttaccgatattccccgggcgaaatggcgcgcccgaaaggatttgaaccttcgacctttggctccggaggccaacgctctatccagctgagctacgggcgcatgccctatcggcggagtggaataatacgtatatcacattagggcgtctagtactttttttactttttttactgtttgacgcctttttcatcagatgcttgctactattcccttataaaggatgtgactcaccgccggaagatcgcaacttgttgtttattgcaacaacttctcaggatataatcacccgaaatttacattgatttaacagcaattaccgcccgttaaattgaaacactctaaaaataataggtaagcagcacttaccttcggaatgtaaagtgagttaatggatatgtctcgatcactcttaagcgtactgttcgctgctctaacattttctactgcagcgtttgctctaactgaagccgataaaaatgcaattgctgaacgcattaagccggtaggtgatgtgtatctggcgggtagcgaaccagtacaagccgctcctacaggtcctcgtgatggcgcaacggtttacggtactttttgtactgcctgtcactcagcggggatctctggtgcaccgaaaacaggcaatgctgccgattggggaccgcgtatcgcccaaggtaaggatgtgttgaaaaaccacgcgctaaacggcttcaatgccatgccgccaaaaggcacctgtatggattgttctgacgatgaaatcgttgctgcgattgagcatatgatcgcaggcctgtaataagcgggcttaccattccatcaattgataataaagaagggcttgttttgacaagcccttctttatttacttcttaaacatcgctcttaaattagcgatatgcgcttggcctttggccatacgctcttcctgggtgacgggctttttctttacttcccactcgatatcgtcctggggcaactcatccaaaaagcggctttgcgaaggtttgatcagttcaccaaactgacggcgctctttacacacgataaacgttagctcgcgttgtgctcgggtgatcccaacgtacattaagcggcgctcttcttcgacattctcttcatcaatactggtttgatgcggcaaaatgccctcttcagctccaatcaaatacacgtacggaaattctaagccctttgaggcgtgcagtgtcatcagctgtaccgcatcactgtcatcgttctcttcgccacgctccatcatgtcgcgcagagttaaacgctgcaccacctctttcagagttttctcttgctgatcgggattatcgccttccaaatcggccacgatccatgaatagagatcggagacgtttttcatgcgcatttcggccgctttcggactggcggaagtctcatacaaccaatcttcgtaacgaatatcacgcactaatgcgcgcaccgcttccaccgtgttaccccgctcagcattatcggcaatcgccaccaaccactcagtgaagcggcgtaagttctcaagccctcgcccgctcaaatgctgctctaaaccgagctcaaaactggcggtaaataggcttttgccccgcatattggcgtaactgcctaacttttcgagcgtagctgggccgatttcacgcttcggtgtattcacaatgcgtaaaaatgcgttgtcatcatcagggttcaccagcactcgcaggtaagccatgatgtctttgatctctgcgcgcgcaaaaaacgaagtgccgccggaaagtttgtacggcacacggttttgagtcagcgatttttcaatcagtcgcgattgatggtttccgcgataaagaatcgcgtaatctcggtattcggttcgattgagaaacttatgggcgatgatttctgcgatcactcgctctgcttcatgatcttcattattggccagtatgaccttgagcttttccccttccgctaactcagaaaagagcgccttttggtaaacgtgggggttattggcaattaaaatgttcgccgcacgcaaaatgcggctggtcgagcgataattttgttcgagcttaatcagctttaaactcggaaaatcttccccaagtaacaccaagttttgtggttttgcaccacgccatgaataaatggattggtcatcatctcccaccacagttaaacggccacgctcacccactaagagtttgaccaactcatattggctggtgttggtatcttgatattcgtccaccaacagatagcgaatccgattttgccagcgttggcgtacttcttcattgctgcgtagcagtaacaccggcagcaatatcaaatcatcgaaatcgagtgcgttgtaagactgcatctgtttttggtaaagctcaaagcagtgtgcaaaaagcagctgctgttcccctttcgccattgccttggcttgcggcggagtcagcatgtcatttttccagttggaaatggtgctcagtagcaagcgcagcagatctttatcgccgtcgagctgcttttcggtcagctctttaagtaacgcgagctgatcttggtcgtcaaacagtgaaaaacccgctttgaggcccaaagctttaaactcacggcgaatgatgtttaagccaagagtatggaaggtcgacaccattaagccgcgcgactcacctttaccgagtgtttgagctacgcgctctttcatctcacgcgccgctttattggtaaacgtaaccgcagcaatattgcgtgctttatagccacattgctgaaccaaataggcaattttattggtgatgacgcgtgttttacccgaacccgcccccgccaataccagacagggtccggagacgtacttgaccgcttcatcttgtcttgggttcagcttcatagcgctctcaatcctctttatttagccgccaataataatccgctcaccgaggattaccaacaaagaaactgcctttacaaaaatttactgcacaagtgtattgcaaaacagggggtattagccgctataatgaacaaccgttcatttgcagagaaatgtgatgtctgaaatagtgtacggcgataaacagctccaaatccttatcgcggctgaaaaactgattgcagaacagggctttcaagggctctcgatgcataaagtggcgaaagcagcgaatatggcaaccggaacgatttatcgttacttccgcgataaagatcatctcttgattgaagtgcgtttgcacgttagtcaaaaaatcgccgaagccgtacaagctaatcttagagatgacatgtctttgcaagaacgcttccgtactatgtggctgaatatttggacgttggctggctcttgtcgtgacattattagtaatcgagtgcagtatgagtctttaccaacaacaacttgttgcaatgtaagggaactagagcaaaaaatgtttgccaaagtcgaactgttgttcgaccaaggaaagcagcagggaattttcaaacctctcgataaccatcttctttctgcgttgagttttgaaacaaccgtcactcttgctcgtcaatacgctttaggtttttatcaactggatgattcaactctcgatgcaatgattcaagccagttgggatgcaattactcaacactaatttggagttcgcaccagaatgaaaaagtggacattttttatgttgcttatcgcgatcctgctgtttggcagcgtgataggtttcaatcttttcaaacaacagaaaattgccgagtacctcgccaatcgtcctgagccagaatttccggttaccgtagtgaccgccaatccggttgattgggtacccgtgattgaagcgatcggttttattgagccgaatcaaggtgtgacattaacgaccgaaacggcaggggtgattgaccaaattacgtttgaatcgggcacgcaagtcgcaaaagaccaacctctagtgctactggattcagcggtagaacgagccaatttaaaaagcactgaagcgcgcctgcctgcagcgaaagccaaatatgaacgctacaagggtctgttcgctaaaggttctatctctaaagagtcttatgatgaagcagaagcgagctactatgcgctctccgctgatattgaaagcctaaaagccaccattgctcgccgtgaaatcaaagcgccttttgctggtgtgatcggtattcgtaatgtgttcttaggtcaatatttgcagccgggtacagacattgtgcgcttggaagataccagcgtgatgcgtctgcgttttaccgtgccacaaagagatatttcgcgtatttcactggatcaagaagtcgatatttttgtggatgcttatccacagacttcatttaaaggctccatctcggcaattgaacctgctgtaagcgtacaaagcggcctgatccaagtacaagcggatatcccaaatagtgatggcaaactgcgaagcggcatgtttgcgcgtgccaacatcattctgcctaagctggaaaaccaagtcactctgccgcaaaccgcgattacctataccctctacggtgacaatgtttacattgtcagcgaagaaaatggtgagaagcgcgtccagcaacatgttgtgaaagtgggtgagcgctctgaatctattgctcacattctggaaggcgtaaaaccgggtgatgtggttgtcacgacaggtcaagtacgtctgagtaacggtgctaaagttcgtatcgtcgaaagtgatgcgactacaccaccagcagaaaccccaatgctgtaagcggaggcatcatgcgctttactgatgtttttataaaacgtccagttttagcggtatcgatcagctttttgattgtgttgcttggtctacaagccattttcaaaatgcaggtgcgtgaataccctgaaatgaccaataccgtaattacggtgagcaccggctattacggtgccagtgccgatttgattcaaggttttattactcaacccttggaacaagcggtagcacaggcggataacattgattttatgacgtcacagtccgtgttgggtcgctcgaccatcacagtgaccatgaaattgaatacggatcccaacgccgcgttatctgacgttctggccaagaccaactcagttcgctcgcagctgcctaaagaagcagaagatccgaccgtcaccatgtcgaccggttcaaccactgcggttctgtatattggtttcaccagtaatgaattggcatccagccaaatcactgattacctagagcgcgtggttaatccacagctttacgcagtcaatggtgtgtcaagtatcgatctgtatggcggtatgaaatacgcgctccgggtatggctcgatccagccaaaatggcggcactaaacctctccgcagcggatgtgatgagcattctgaatgccaacaactatcagtcagcgaccggtcaggcgattggtgaattcgttctttataacggcagcgccgatacccaagtctccaccgtggaagatttggaaagtctggtggtgaaagctgagaaaggtaccgtgactcgcctaggtgatatcgcgaaagttaccttggctaagagccatgatacctatcgcgcgagtgctaatggccgtgaagcggtcgttgccgcgattaacgcggccccaagtgcgaacccgatcaacatcgccaaagatgtgcttgagatgctgcctgagctgcagaaaaacatgccaagcaacattgaaatgaacgtgttgtacgactcaacggttgcgatcaatgaatcgatccacgaggttatcaaaaccatcgtagaagcggcgctgatcgttcttgtggtcatcactctgttcttgggttcactgcgtgccgtactcatcccaattgtcactatcccgctttcactgattggtgttgcgatggtgatgcagatgatgggcttctcttggaacctaatgacgctgctggcgatggttctggcgatcggccttgtggttgacgatgcaatcgtcgttctagagaacgttgaccgccatatcaaagaaggggaatctcctttccgcgcggcgatcatcggtacacgtgaaattgccatcccagttattgcgatgacgctgacgttgggtgcggtctatgcgccgattgctttgatgggcggtatcaccggctcactgtttaaagagtttgcgctcacactggctggttctgtttttgtatccggtattgttgcattgactctgtcgccgatgatgtgttcaaagatgctcaaagccaatgaagcgccgaacaaatttgaactgaaagtgcaccatttactggatcgcatgacggcacgctatgaacgcatgctgaccgcggtaatggctcatcgccctgtggttattgcctttgcgtttatcgtttttgcaagtttaccaatgctgtttaagttcattccaagtgagcttgcgccatcggaagataaaggggtaatcatgctgatgggtacaggcccgtcgaatgccaacctcgattatctggcgaatacgatggatgatgtgaataaaattctgtctgatcagccagaagttcagttcgctcaggtgtttactggtgttcctaactcaaaccaggcgtttggtattgcgtcaatggtgccatggagccagcgtgaagctagccaagccacagtaaccaaccgcgtgggtaccttggtacaagatatcccaggtatggcggtaacggcattccagatgccagaactgcctggtgcaggctctggcttaccgatccaatttgtgatcaccacgccaagcaactttgaaagcttgtttaccatcgccaccgatgtgctgaccgaagtcaaagccaatccgatgttcgtctactcggatctggatctgaacttcgattcggcaacgatgaagatcaatatcgataaagataaagccggtgcctacggcgtgaccatgcaagatattggcatcacgctcagcaccatgatggccgacggttatgtcaaccgtatcgacctcaacggccgctcttacgaagtgatcccgcaagtggaacgtaaatggcgtctcaaccctgaatcgatgaacagctactacgttcgcgcagcagatggcaaagtgatcccactcggtagcttagttacgattgatgtggttgcagagcctcgctcgctaccccacttcaaccagctcaactctgccaccgttggtgcggtgccagctccgggcacggctatgggggatgccatcaactggtttgagaatttggcaagcagcaaactgcctaaaggctatagccatgactacatgggtgaagctcgtcagtatgtgaccgaaggtagcgcgctgtatgccacatttggcctagcgctggcgatcatcttcttggtgttggcgattcagtttgaatctctcagagatcctttggttatcatggtctctgtaccactcgccatttgtggtgccttgatcgcactggcttggggtacggcaaccatgaatatctactcgcaggttggcttgatcacactagtcggtcttatcactaaacacggtattttgatctgtgaagtagccaaagaggagcagttacacaacaaactcagccggattgaggctgtcatgcatgccgctaaagtgcgtctgcgcccaatcctaatgaccactgcagcaatgatcgcaggcctgatcccactgatgtacgccaccggtgcaggggctgcacagcgcttcagtatcggtattgttatcgtctctggtctggcaattggtaccttgtttactctgtttgtactgccggtgatttacagctaccttgcagagaaacacaaaccactaccggtgtttgttgaggataaagatctggagaaattggcccgcattgatgaagccaaagcggctcatcgtcagctgtaagccaatattcagtctcatcacaaaaggccatttcgatggccttttttattatccaatctaacgacatcgctagctgaattgcatagaatattggcaacttaacaggagaattactatgtttgatgccaaaaaactcgagcagatcgccaagcaaatccatgaagccatgccacaacccgtcaaagaactgggtgctgatgtagaacagaaagtgcgtcaagtcattcaaggccaactgaacaaactggatgtggtcagccgcgaagagtttgatgtgcaaactcaagtgctgttacgcactcgccaaaagctcactgagttagagcagaaaatggctgagcttgaagccaaattagcggataaataagcgctgagttcatacagtaaacacgccacttagcactcaataaagaaaggcttagtcattcgactaagccttcttggtttttattatagtgtgttgttgtgtttgctttggaaatcaatttagggattaatcacccacggcgatgcgcttcatgtctttcatgtaaccgcgcagctcttcaccgatatactcaaccggatggttacggatgatgctgtttacttcgataagcgttgcgttatcaacttgattagagaccacgcctaatcctttaccaatcacatcagtgcccactttcggcataaacttttcacgcaatagtggtaccgccacattggcaaacagatagttaccgtactcagcagtgtcagagattaccacgttcatttcatacagacgcttacgcgctaccgtattggcaatcagtgggagttcgtgcagtgattcatagtaagccgactcatcgatgatgcctgaagccgtcatcgcttcaaacgccaactcaaccccagcacgcaccatggcaatcatcaaaataccgttatcaaagtattcttgctcagcaatttttacgtcggttgttggatagttttcaaaggccgtctcagcggtttctgcacgccagccgaataagtctttatcatcattcgcccaatccgccatcatggtgctagagaagtggccagaaatgatgtcatccatatgcttgttgtacagtgggcgcatcagatctttcaactcttcagacagctcaaacgctttgatttttgcagggttagacaggcgatccatcatatgagtaataccgccaaacttgagtgcttcggtaatggtttcccaaccaaattgcaaaagcttgcccgcataaccagggtcgatgccatcagcaaccattttctcgtaacaaacgatagagcccgcttgcagcataccgcagagaatggtttgctcacccatcaaatcggatttcacttccgccacaaaagaagaagctaaacagcccgcacgatggccacccgttgccgcagcccacgctttagcaatttcccaaccttcaccttgtggatcgttttcagggtgtaccgcgataagagtaggaacgccgaaaccgcgcttatactcttcacgaacttccgtacccggacattttggtgccaccatcacaaccgtgatgtctttacggatctgcatgccctcttcaacgatattaaaaccgtgtgagtaacccaaggcagcaccttgcttcatcagaggcatcaccgcattgaccacactggtgtgctgcttatctggcgtcaagttaatcaccaaatctgcggttgggatgagttgttcataactacccacgttgaagccattattcttggcattcttaaatgactgacgctgttcatcaatcgcagcctgacgcagagcgtaagaaacatccaaacctgaatcacgcatattgaggccttggtttaggccttgagccccacaacctacgatcaccactttcttaccttttaggtaatcagcttcggttgcaaactcttctcgcgccataaaacggcaacgaccaagttgatccaactgttcacgcagattcagcgtattgaaataattcgccatgagggtgctccttaataagtgattccgttaagtcggtgcgatctgaccgaataaactcatactaagccagagacaaaattgcgcaaagtgatatattcacaactagttattgcaacaaatgcaacataggaacttttgtgaacatcaaaactctgcagctattcatgcatctatgtgactgcaaaaatttcagtaaaaccgcttctgcaatgcatctcagcccttccgcactcagtcggcagatacagaagctggagcaagatttaggtcacacactttttctgcgcgacaaccgcagtgttgaactcactcccgcagcccaccaattactgcccgttgcggcacgcatcattcacgactggcgacaattcactaccgaactcaacgatgacagccaagaactacgaggagagataaagctattctgctctgttacggccagttatagccacttacctgagcttctcagctcatttcgcctcaagcatccttatatcgaatttaaactgctaacaggcgatccggcacaagcgatcgataaaatcctgcacgatgaagcggatatagcaatttctgcgatgcctgaacaactgccaagccgcattgaattcgccacaatcagtgagatccctctttccgtcatcgcaccacttgggatcagcagctttatggatgagctacaaaaagagcagcctgattggaatgaaattccgtttattgtcccagagtcgggaaccgcgcgcgatagagccaatacctggtttaagcaaatgaagataaagcccaatatctacgctcagatcgcaggacatgaagcgattgttagcttggtggctcttggatgtggagtagggattgctccggatgtggttatcaataacagccctgtgcgtgacaagatccagcgcttaagcgtcacccccatcaaaccctttatgctcggtgtttgctgcaagcgttcacagttagataatccgcttgtccaagcactgtggcgggtcgtttcggcaaagaaaagcgttgttgataaataaagaactttagaagaataggttatcggtactgtatcgataatctagatattgaaaatcaagatgacagaatgcaaaaaggccgctgagttgtcagcggcctttcttaatagtggcggagagatagggatttgaaccctaggatagctattaaccatcgccggttttcaagaccggtgctttcaaccactcagccatctctccgcaaattgtgtgctaatagcgtggtgacactatcagcgagattaaaagcctggcgatgttctactctcacatggggagaccccacactaccatcgacgctgtttcgtttcacttctgagttcgggatggaatcaggtgggtccaaacgctatggtcgccaagcaaattctgtttttgatttcacttttcttaaaaagtgataaccaacaattctggaaagctgtcttgttctctcacacattcttatgcgctcagctttgagtccactacaaaaccccttgggtgttgtatggttaagcctcacgggcaattagtacaggttagctcaacgcctcacaacgcttacacaccctgcctatcaacgttctagtctcgaacaaccctttaggacagttaaactgtcagggaagactcatctcagggctcgcttcgcgcttagatgctttcagcgctttatcaattccgaacttagctaccgggcaatgcgtctggcgacacaacccgaacaccagaggttcgtccactccggtcctctcgtactaggagcagcccccttcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccaaacaccgccgtcgatatgaactcttgggcggtatcagcctgttatccccggagtaccttttatccgttgagcgatggcccttccatacagaaccaccggatcactatgacctgctttcgcacctgctcgaaccgtcattctcgcagttaagcgggcttatgccattgcactaacctcacgatgtccaaccgtgattagccaccttcgtgctcctccgttactctttgggaggagaccgccccagtcaaactacccaccaggcactgtcctcaacccagataatgggtctaagttagaacatcaaacatacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacactgcatcttcacagcgatttcaatttcactgagtctcgggtggagacagcgtggccatcattacgccattcgtgcaggtcggaacttacccgacaaggaatttcgctaccttaggaccgttatagnnnnnnnnnnnnnnnnnnnnnnnnnnnnnnnnnnnnnnnnnnnnnnnnnnnnnnnnnnnnnnnnnnnnnnnnncggcaggcgtcacaccgtatacgtcatcttgcgattttgcacagtgctgtgtttttaataaacagttgcagccacctggtatctgcgactctcgtcagctccatccgcgagggacttcaccatcaagagcgtaccttctcccgaagttacggtaccattttgcctagttccttcacccgagttctctcaagnnnnnnnnnnnnnnnnnnnnnnnnnnnnnnnnnnnnnnnnnnnnnnnnnnnnnnnnnnnnnnnnnnnnnnnnnnnnnnnngcatggcatcaatgacttcactaccgtagtagctcgacgtcgtgtctcagccttagagagagccggatttacctaactctcaagcctacgcacttgaaccaggacaaccgtcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtctaaaagacattgccgcagcttcggtgtattgcttagccccgttacatcttccgcgcaggccgactcgactagtgagctattacgctttctttaaatgatggctgcttctaagccaacatcctagctgtctgagccttcccacatcgtttcccacttagcaatactttgggaccttagctggcggtctgggttgtttccctctccacgacggacgttagcacccgccgtgtgtctcccggatagtacttactggtattcggagtttgcaaagggttggtaagtcgggatgaccccctagccttaacagtgctctacccccagtagtattcgtccgaggcgctacctaaatagctttcggggagaaccagctatctccgagtttgattggcctttcacccctagccacaagtcatccgctaatttttcaacattagtcggttcggtcctccagttgatgttactcaaccttcaacctgcccatggctagatcacccggtttcgggtctatatccagagactgagcgcccagttaagactcgctttcgctacggctcccctatacggttaaccttgccactgaatataagtcgctgacccattatacaaaaggtacgcagtcacaccacgaaggtgctcctactgcttgtacgtacacggtttcaggttctatttcactcccctcacaggggttcttttcgcctttccctcacggtactggttcactatcggtcagtcaggagtatttagccttggaggatggtcccccatattcagacaggatatcacgtgtcccgccctactcgatttcacgctcgatgaagcgtcggttacggggctatcaccctgtatcgccaagctttccagcttgttcacctacttcaccgagtgcttaagggctaatccaggttcgctcgccgctactaccggaatctcggttgatttcttctcctcggggtacttagatgtttcagttcccccggtttgctctgttaacctatgtattcagttaacagtaactgcttatgcagttgggtttccccattcggaaatcgcagactcaaacggctcttactgccttatctgcgcttatcgcaagttagtacgtccttcatcgcctctgactgcccaggcatccaccgtgtacgcttagtcacttaaccatacaacccgaaggagtttcgggttgctgtttaaacaacctaagttgtctcgcgtttaatttacatgagtgcgagacagattttgccggactcaaatttgaacaagaccgaagtcttattcgataccaagcacacttgaatgtgttgttggtgtttatctttcgataaacattgagaactttacaaacaacaataaattgttgttttgtcagctttccaaattgttaaagagcaaagtacttcttatcactaagagccactttttaaggactttcggcggcaaaaatctgaaccacgcagtgttgggtggtttggaaatgtattccaaaaatgcttaaagagtggtgggcgataccgggttcgaaccagtgaccccctgcttgtaaggcaggtgctctcccaactgagctaatcgcccacatgttttacttcctgtggaggaaggaaatggtgggtcgtataggatttgaacctatgaccaattggttaaaagccaactgctctaccactgagctaacgacccattaacttctcaagggaagtggtatcccgtaggggagtcgaacccctgttaccgccgtgaaagggcggtgtcctaggcctctagacgaacgggacactaagatactcttctctaatctaaaccgaatcaatctgtgtggacactcatcacgataaccatcgtgtaaggaggtgatccagcgccaggttcccctagcgctaccttgttacgacttcaccccagtcatgaaccacaaagtggcaagcgtcctcccgaaggttaaactacctgcttcttttgcagcccactcccatggtgtgacgggcggtgtgtacaaggcccgggaacgtattcaccgcaacattctgatttgcgattactagcgattccgacttcatggagtcgagttgcagactccaatccggactacgacgtactttgtgagattcgctccacctcgcggtatcgctgccctctgtatacgccattgtagcacgtgtgtagccctactcgtaagggccatgatgacttgacgtcgtccccaccttcctccggtttatcaccggcagtctccctggagttcccaccattacgtgctggcaaacaaggataagggttgcgctcgttgcgggacttaacccaacatttcacaacacgagctgacgacagccatgcagcacctgtctcagagctcccgaaggcactccagcgtctccgctagattctctggatgtcaagagtaggtaaggttcttcgcgttgcatcgaattaaaccacatgctccaccgcttgtgcgggcccccgtcaattcatttgagttttaatcttgcgaccgtactccccaggcggtctacttaacgcgttagctccgaaagccacacctctagggcacaacctccaagtagacatcgtttacggcgtggactaccagggtatctaatcctgtttgctccccacgctttcgcatctgagtgtcagtatctgtccagggggccgccttcgccaccggtattccttcagatctctacgcatttcaccgctacacctgaaattctacccccctctacagtactctagcttgtcagtttcaaatgcgattcctaggttgagcccagggctttcacatctgacttaacaaaccacctgcatgcgctttacgcccagtaattccgattaacgcttgcaccctccgtattaccgcggctgctggcacggagttagccggtgcttcttctgtaggtaacgtcaaatgattaaggtattaacttaaccaccttcctccctactgaaagtactttacaacccgaaggccttcttcatacacgcggcatggctgcatcaggcttgcgcccattgtgcaatattccccactgctgcctcccgtaggagtctggaccgtgtctcagttccagtgtggctgatcatcctctcagaccagctagggatcgtcgccttggtgagcccttacctcaccaactagctaatcccacctgggcatatccggtagcgcaaggcccgaaggtcccctgctttgctcttgcgaggttatgcggtattagccatcgtttccaatggttatccccctctaccgggcaatttcccaggcattactcacccgtccgccgctcgccacccaaggaacaagttcctctgtgctgccgctcgacttgcatgtgttaggcctgccgccagcgttcaatctgagccatgatcaaactcttcaattaaaagtttttgaagctttcgcttcggctcaatgaatactgattactatctttcgatagtgaattgactgtgctgaatgattgctcattcaaatggtcactcagttcattgataaatcttttttgattatcatcaacgagtgcccacacagattgattggtttatattgttaaagagcgctcttcttggcggtctgcttcagaagaggcggccattttagcgagataaactgttgtgtcaaacacttttttcagtttattttcgttggcgatttcgccacctaaaacaccgaactgaatcactactaacgcttactgcgtctgccgtgtcagtgagggcgcattatagagatctgcttcacactgacaagtgtttttttggttttttttcgctgtttttcactgttcgatgaaaaaagagtcaccaaggcctgaaagtgatggttttctctaccaattgcggaattgttcaccaaattgagagactttttcccaattggtgtactccacttctttactggtatccgtttctccccccgtcaaggtcatgatcaaacgtatcatcattttgtcgaaccaacggtaacgcgggtaatacagtgccccagcaaatacggcaatacgctctggttgccacggtgactttttcaggaaggtttgaatatagacactcccttctggcgtatcttttccttgatcttcttttctcgcggtgagattgacgcagaagaaagcggctttgctattggtcagcgtcgtgacatgacgttgaataaattgatagagcttttcattgaggcggccgtaacgaatcgatgcaccaatcaagattttttcataatccgccaacgctatctcatggacctgatgcagatcttggatgtcgcaatcgtactccggcatctgctgagcgatacgttcgataattttccgcgtttggccttcttggcttgagtacaacagtaacgctttcacagctctctccttagtattatcactaactacgccagaatgtcggcgtaagcagaatcaatagagtaaatatttctaagcgtccaaacagcatggacgcaatcaaaatccacttagctttgtcattcacatccgcaaagtgtacggcaacttccccaaggccaggccccaagttattcagtgtggcggcgacagcagaaaatgcgctgagctcatccattcccgtggcgatgagtgcaagcatacacacgacaaacaccagtgcataagcagagaagaagccccataccgcatccacgacgcgctgtgagagtgctctgccgccaagtttgatcgggtagatggcgcgagggtgaactaagcgcttcatttcccgagccccttgtagggtcagtagcaacacacggatcactttcatgccgccacccgttgagcctgcgcatcctcctataaaagaggagaagagcaataacacaggtaaaaagagtggccagtccgaaaaacctgtggtggtaaaacccgctgtggttgagatggatacggtttggaacagcgcttggtcaaaggcttgataaaagctgtcgtaagagtggtgtttcagtaacacagaaaagcagatcacaaacagcagaacttggatgacgaaaaatgcacgaaactcaggatcgcgccaatagtacttagggtgtacaccgcccgttgcgaaagcagcataatgtaaagtgaagttacatgatgagatcagtaagaaaacgacggtgatgaggtttatcgcataactgtcgaaataccccatactggcatcgtgagttgagaaaccgccgatggcgatggtcgagaagctatggcaaatcgcatcaaataaactcattcccgctaaccagaaagcgctggcgcaagcgatggttaagcttaaatagatataccaaagcgctttggcggtttctgcaatccttggagtcactttggtatctttgactggtccgggaatttccgctcgataaagctgcataccaccgatgccaagtacaggtaaaatcgcgacggcaagtacgatgatccccattccaccaaaccattgcaaaaattggcgatagaaaaggatggctttggggagttcgtctaagccaacaatcacggtcgcccccgtggtcgttaacgccgaaaaggattcgaaaaacgcatcggtgactgaaatgttggggtcggctgcgagcaaaaaaggcaatgcgccagcgctgccgattactgtccagaacaatacgacgattaaaaaaccatcccgtgccttgagttcatgtttatgatggcggttcggaaaccagaataagccgccacacagcagtaatacaaaaaaggttgagacaaacggcacacctgccccatcgcggtagatcaaagccaccaacgcaggcgcaagcatagaaacgctaaatagagcgagcaaaagcccgacaatacggataattgaacgaaattgcattatggttcgagctgactcgctaattctgactatgttgtggtgagcgactcacctgtattttcgcgccacttttattgatcaaggcttgtgtgaaagcatctgattgcaatgcctctaattccaccaccatttcgacttgttcattatagtgagcctccatttccgtcgcagaaaattgcgccattatggaatggagtaatggaatcatggcgtagtctagcgtcaggtgcacagatgtggtgatttttttctcaatagtttgaagtcgcttgagcgcttgttgaacaccgccaccatacgctttcactaagccaccggttcccaatagaacaccgccataataacgagtcactaccgccgtaatttcgccgatatgagaccccgtgagctgagccaagatgggttttcccgcagtaccggatggctcaccatcatcactcaatccccacagcatggagttttcaggtcgcccagccacaaacgcccagcagttgtgtctcgcatccgcatgacgctgcttaatctcatcaacaaacgctttggcactggcaagatctggcgtatgtgccaaataggtaataaacagactctttttaatctcttcttcaaaccgaacagaagccatgggaatgaggtagggatgaagattcataactcaggtctcaataaaaaaggcgcccagtgtaacacggcctcaccataagctcgactcgacttaacgcacaatgttaaacacttgtttaaaaaatgtattgaaattagctaatctcaggttcaaacttaggcaactggtcaaaccagaacataaaaatgacaaccgctctctcacacaatcactgattgtatgtcacggagatagacaatgatttaccaagccaaaaccctacaggtaaagcaactcgctaatggaattgccgagctctctttctgtgctcctgcttccgttaacaaactggatttacacacactggaatccctcgataaagcgttagatgcgctcgctgccgattccagcgtcaaaggcctcctactcagctcagataaagaggcttttatcgtcggcgctgatatcaccgaatttctcgggctatttgccaagccggaagcagaattggatgagtggttgcagtttgccaatcgcatttttaacaagttggaagatttacctttccccaccttatcagcgttaaaaggccatacacttggcggcggctgtgaatgtgtactcgccaccgattttcggattggtgatgccaccaccagcattggcttgcctgaaaccaaactgggcatcatgccgggatttggcggcaccgtgcgtctgccacgtttgattggcgctgatagcgcgatggaaatcatcacccaaggtaaagcgtgccgcgcggaagaagcgttaaaagtgggattactggatgcgattgtcgatagcgacaaactgatcgattccgcaatcaccactttgactcaagcgattgaagaaaaactggattggcaaaaacgccgtcagcagaaaacctcagcgctgactctaagcaagctggaagccatgatgagctttaccatggcaaaaggcatggtggcgcaagtggcaggcaaacactatccagcaccgatgacatctgtcgtgaccattgaagaagcggcgcgtttaccacgcgatgctgcgctggatatcgagcgcaaacacttcatcaagctcgcaaaatctaccgaggcacaagcgctggttggtattttcctcaatgatcaatacatcaaaggtctagccaaacaatccgcgaaagcggcaagccaagacacccaacacgccgccgtgctcggcgcgggcattatgggcggcggcatcgcctatcaatcggctctcaaaggcgtacctgtgctgatgaaagacatcgcaccgcactctttagaactgggcatgaccgaagcggccaagctcctcaacaaacagttagagcgcggcaagatcgatggtttcaaaatggctggcattctggcttccatcaccccttctctgcattacgctgggattgatcaggcggatgtgattgttgaggccgtggtggaaaatccgaaagtaaaagccgcggtactgagcgaagtggaaggattggtcgatacagaaacaattctgacctccaacacctcgaccattcccattaacctgctcgccaaatcactcaagcgcccacagaacttctgcggtatgcacttctttaaccctgtgcatcgcatgcctttggtggaaatcatccgtggtgaacacacctcagaagacaccatcaaccgagtggttgcttatgcggcgaaaatgggcaaatcaccgattgtggtcaatgattgcccaggattcttcgttaaccgcgtactcttcccttactttgcaggctttagcctactgatgcgtgatggtgcaaacttcaccgaaatcgacaaagtgatggagcgtcaattcggctggccaatgggcccggcgtatttgcttgatgtggtcggcattgatactgcacaccatgctcaggcagtgatggcggaaggcttcccaactcgcatggcgaaaagcggccgagaagcgattgatgccctgtacgaagcgaaaaaatttggccagaaaaatggcagcggcttctatcagtacaccgttgataaaaaaggcaaaccgaaaaaagccttcagcgatgacgtgctcgccattcttgcgcctgtatgcggcgcaccacaaagctttgacccacaaacccttattgaacgcactatgattccgatgattaatgaagtggtgctctgtcttgaagaagggatcatcgcctccgcgcaagaagctgacatggcgttggtgtacggtcttggcttccctccgttccgtggtggtgtattccgttacttagataccataggcatcgccaactatgtggctatggcggaaaaatacgctgacctcggcgcgctctatcaagtaccgcaactgctgaagaacatggcgcaacaaggaacatctttctacagcgctcagcaagtcagtgccctgtaaatcggtttagaaaaggaataacaaaatgaatacagtagtgattgttgattgcctacgtactccgatgggacgctccaaaggcggtgcgtttcgccaccaacgtgcggaagatctttcagcacatttgatgaaaggcattctggcgcgcaacccacaggtcaatccaaaagagattgaagacatttattggggctgtgtgcagcaaacccttgaacaaggctttaacgttgcgcgtaacgcagcgctgcttgcgggtctgccaattgagattggcgcggtcaccgtcaaccgtttgtgtggatcgtccatgcaagcactgcatgatgcggcgcgcgcaatcatggttggcgatgcagagatctgtttagtgggcggcgttgagcacatgggccacgtgccaatgactcacggcgttgatttccatcctggcctgtctaagaacgtggccaaagcagcgggaatgatgggactgaccgcagagatgcttgggaagctgcatggtattagccgtcagcagcaagatgagttcgctgcgcgctcccatgcgcgtgctcatgcagcaacattagaaggtcgctttaaaaacgagattctgcccaccgaggggcatgctgccgatggcacgctgtttaccctcgattacgatgaagtgatccgcccggaaaccacagtggcgggattagctgaactgcgtcccgtgttcgatccggccaacggaactgtgactgcaggaacctcttcagccctttcggatggtgcttcagcgatgttggtgatgagtgagcaaaaagccaaagcgctcggtttaaccattcgcgcccgcattaaagcgatggccgtggccggttgcgatccttccatcatgggttatggccctgtacctgcgacccataaagcgctgcaacgtgcgggcttaaccatgcaggatatggatgtggtggaattgaacgaagcgtttgccgcacaatctctaccttgcgctaaagacttaggcttactggagatgatggatgacaaggtcaacctcaatggcggcgcgattgcgctcggtcatccactgggttgctcgggtacacgtatctcaaccacgctgatcaatttgatggaagccaaagatgcgaaatatggccttgctaccatgtgtatcggcttaggtcagggtattgcgaccatttttgagcgcccataacccttccgttttgcctatcactgaagcgtcgtttaagagccagcaacgctggctcttcttataatgttatttagcttgtagccaatcactgtaaagttgatcgctactgcccagataattcaccatccactcaatcaatttatgattatcgtctttgcgccacactaggcagcagtggctaagcagtttttcatcgggcagtaccttctccaccaactgaccgctggccagtagcggctgcgccatatgccttggcatatagccgaccccgagtccactttttaaactttcaatcgcgctgtaccagtttggcagtagcaaacgacgctgtttagggtagtgttcggtatggcgtttgggcaatacgcttgaggtatcgtccaaacagatggctaaaaactggctgataaacccttcactcaaattctgctcgcgcacgcaggggtgattgggtgacatcacaaatgcccagtcaagaatgcccatatcgcgtacttcaaaatcgccgcccactggtactgctgcggttgcgccaatcacaatatcggcgcggccttgtgcaatcgcttcccacgagccgttgaacacttccatgttgatctgtagctcggcgaaatcaaaggtttgatagaaggcttccaccatcggcttcatcttgtccagcttgactacgttatcgagtgtcaccttcaaggttttacgccaaccatgcgcagcgcgtttggtttgcgcgcggatctcctccatctggcgcagtaactgccttgcctcaagcataaacaactcaccagccggggttagctcgaccttacgtggtaaacggcgaaacagcaccacacccagctcactctctatttggcgcacactgtagctgatcgccgaaggcactttgtgcagcacctctgccgccgcagtaaaactgcctaaacgcgctacggcgtccaacatctccaaagaggatttggaaaacatcactcacctatctatcaatttttttgcatgataaccgaaaaatttgccgtttctcttcatcacaagacaaaactagaatgtaactacagaaaaatcctggttggcgccaacggatactgaaaaaaacatgtgtgaataattttgatggacatgaaaaaatgaaagtatctttcttccagttggtttacctttcggcactctccatgctcggttttattgccaccgacatgtatctgcctgcgtttaaaatgatggaaaccgcttttgcgaccggccctgaacagatcgctctatcactgacggtgttcttagtggggatggcgcttggccagttactgtggggcttagcttccgacaaatttggccatcgtaatacgctgattgctggcttactcgtttttaccctcgcctctgccggactcgcgtttagctcaacggtatggcaactgctactgctgcgttttatccaagcgattggggtgtgcgcgcctgcggtgatttggcaggcaatggtgatcaagcgttacccaagctcagtcagccaacagctgtttgcgaccatcatgccactggtggcgctctctccagcactggcaccgcaattgggtgtgctgctggcagattactttggctggcacagcatctttttgactttaaccttgatgggtattgtgttggtggtaagtacgggcttacaaaccaatgaaattgctgagccaaaaaccacttctatcgcgcaagatattaaaggtttactgaaaagcaaaacctatctcggcaatgtgatgatgtttgcttgtgcatcggcggcgttttttgcctacctgaccgggatgccggaaatcatggcgcagcttggttatcaagcacgggacattggcctgagctttattccacaaaccattgcatttatggtgggtggctacctaggtaagaaagcggttcagaaatacggtgatgaactggtgctcaaacagttgattgcgctgtttaccctgtcagcggcgatgatttttgtcgcctcacaatggacgctcagctcaatttggccaatattggctccattctgcttgattgcggtggctaatggtgccatgtatccgatagtggtcaaccgtgctttatccagtgctaagcaaagcccagcaaccgctgccggattacaaaacagcttacagatcagtgtcagcagtttatccagtgctctggtagcggcaatggccagccaagctcagccagtaacgggtattgctattgtgctttgtactggtggtttgtggttaggctatgtactttccaaccgtacattacgcgaacagttcactacgccggataattcacgcgtcgtcagtgatgaataaaacagaactttgagcaatacaaaaagagccgcattcgcggctcttttttcaatcggttcaattatttctttttcgccggacgctgccagccagcaattttgcgctctggcgcgcgagtgatgactaactcaccttcagcgacattcttcgtcagggttgtaccggcaccaatggtcgcaccgttaccaatggttacaggcgctacgagctggcaatcagaacccacaaacacatcatcaccaatcacggttttgtgcttattggcaccgtcgtagttacaggtgatcaccccagcgcccacattcacgcctttgccaatctcagcatcgccaagataagtcaggtgattggcttttgagccttcaccaagacgagcatttttcatctccacaaagttgccgacatgcgcatcatcgcgtagctctgctccgggacgtagacgagtaaacggcccaactgtacagttttcaccgaccgtcgccccttcaattacgctgtatgggcggatcaccgtgttgtcatcaatctcacaatctttgagaattgagcccgcgccaatcactacgttattaccgatcgatacattgccttcaataatcacgttaacatcgatttccacatccgaaccgcactgcagtgttccgcgcagatcaaaacgtgcaggatcgcgcagcatcacaccttgctcaagcagcttcttggcctgacgcgcttggaaagcacgctcaagacgtgccaattgaatgcgatcgtttaccccttccacttcgattgagtgtgaaggatgcaccgcttcgacggcacgaccttcatcatgcgctgccgcaatcacgtcagtcaggtagtattcgccttgcgcgttattgttgtttagccctgccaaccaacgcttaaggtcacggccagtcgccaccagcacccctgtgttgacttctttgatcagcttttgctcttcactggcatctttttgctcaacgatcgccaccacagggccacgtttacgcacaatacggccgtaccccgttgggtcttccagaacaacagtcagtagtgcaatgccatcggtgggctgtgcttcaagtaaactttcaatagtgtcttcagaaatcagcggtacatccccgtacaacaccaagattttttcatcatcttggaaatggggagaggcctgatctacggcgtgccctgttcccagttgctgcgcttgcaaaacccagttgacgttttcgttcgccagagcttgctgcatctggtcgccaccatggccataaaccagatggatattttgcgcgcctaggttattacacgtatcaatgacgtgtttgaccataggcttacccgccaatgtatgcagcaccttcggcatattggagtgcatacgagttcctttccctgccgcgagaattaccgtactgaatttcatttgttatctacctagtcatttttctgcgtcgtattctaaacagcaaactgaaaatagttaattgccgattatctcgaaaataagaagagagattattttcatagaaaatcacgtttatttattagtgatcagtcaataacgggacaaaaaacatcccataacgtcacacactcttaccgataagcggtgcacaagagacaaaaaagcctgacataagtcaggctttttatcagcttatttgcatgattaacgacgctttttggtcagttcaatcacgcgaagctgtgcgatggctttagccagttcactggccgcttgtgcaaagtccatatcgccatgctggttgagaatacgctcttccgcacgacgtttggcttcttctgccttagctgcgtccagatcttctccacggattgcggtatcggccaacacagtcgctgtgcccggctgaacctcaacaataccacctgagacataaatgtactcttcgtggccgtgcagtttcacaatacgcaccataccaggcttgatagcggtcagcagcggtgtatggccgtggaaaatacccagctcaccttcgctaccggtcacctgaaacgtttcaaccaagccagagaacagttttttctctgcgctcactacgtccagatgaaaggttattgctgccatatcgcctcctagtcagccttatagcttcttcgcattctcgatagcatcgtcaatcgtaccgcagtacataaacgcttgctctggaatgtcatcgtagtcacctgccagcagacctttgaaaccacgcagggtttctttcagaggtacgtatacccctggatcgccagtaaagacttctgctacgtggtaaggctgagtcaggaaacgttcgatcttacgcgcacgagcaacgacttgcttgtccgcttcagacagttcgtccatacctagaatcgcgatgatgtctttcagctctttatagcgttgtagcgttgcttgcacgccacgcgccacatcgtagtgctcttgaccaacaaccagtggatccaattgacgtgaagtcgaatccagtgggtcgatcgctgggtatagacccatagcggcgatgttacggttcagaacaacggttgcatccaagtgagcaaacgtggttgctggtgatgggtcagtcaagtcatccgcaggtacgtataccgcttgtacagaggtgatagaaccttttttggttgacgtgatacgttcttgcagaacacccatctcttcagccagtgttggctggtaacctaccgctgaaggcatacggccaagcagagcagatacttccgttcccgctagggtgtaacggtagatgttgtcgataaacagcagtacgtcacggccttcatcacggaacttttccgccatagtcagaccagtcagtgctacacgcagacggttgcctggtggctcgttcatctgaccgtaaaccatcgctactttcgacagttctggttgttcaacgtttacaacgcccgcttcctgcatttcgtggtagaagtcgttaccctcacgagtacgctcacctaccccagcaaatactgacaaacctgagtgctgtagcgcgatgttgttgataagttccatcatgttaacggtcttacctacacccgcaccaccgaacagaccgattttaccacctttcgcaaacggacagatcaggtcgataaccttaacacccgtttccaaaagttcagttgcactagactgttcttcgtagcttggagcaggacggtgaatcgagtacacctcttctgcgccaatgtcgccacgttcgtcaatcgcatcaccaagcacgttcatgatacgacctagggttttagtacctactggtactgaaattggagcgccagtgttttgtactgtcattccacgacgtaaaccatccgagctacccataacgatagcgcgaatcacgccaccgcctagctgctgttgaacttccagaaccagacgttctttggaatccacaacattcagagcatcgtaaacacttggtacttcgctctgtgggaactctacgtcgactaccgcaccgatgatctgtacgatcttacctgtagccatcgttaatcctctaaactgtttgttttacctaagcttaaaccgcagccgcgccgcctacgatttccgacaattcttgtgtaatcgccgcctgacgggctttgttgtacacaagttgtaaatcatcaatcaggttgctcgcgttatcggtagcagctttcatcgcaaccattcgggctgcttgctcacacgctaggttttctacaacaccttgataaacctgcgactcaatgaagcgcagtaaaagcgcatctaatagaggctttggttcaggctcgtagatgtagtcccacatgtgatcacgctgcatatcttcgctgtccgattttggcaaaggtagcaattgatcgatctttggtttttgcaccatggtgttcacaaactggttgaacaccagatagaggcggtctaactcacctttatcgtatttcttcagcatgacgccaaccgaaccgatcagatcttctaagcttgggctgtcgcccaaaccagaaacctgagccgctactttcgcgccgctgttgttgaaaaaagcggtcgctttcgagccgataatcgccagctcaatctgcgcacctttctctttccaagtttgcatatccgtgatggcttttttgaacaagttaatgttcaaaccaccacacaaaccgcggtctgtagaaataatgatgtaaccaactcgcttcgcttcacgctcttctagatacggatgacgatactctagacttgcgttggcgacatgaccgatcactttacgtattgtttgtgcgtaagggcgtgatgactccatagcgtcctgtgaacgacgcatttttgaagcagccaccatttccatcgctttcgtaatcttctgagtgcttttcacactcccgatcttagtacgtatctcttttgcgccggccatcgttactctccgttagttggtggcagaaactgccaccgacctcattaccaagtttgggttgctttgaaatcgtcaaccagcttcttcagctgagcttcgatctcatcgttgtaagcacccgtcttgtcgatttgcgctgccaattcagcgtaatgagcacgagcatacgatagtagagcagcttcgaagtcgagaaccttgttcagttctacgtctgtcagatagccacgttccgcagcaaagatcaccagagcctgatcaaagacagacattggtgcatactgtttctgcttcatcagttcagtcactttctgaccgtgagtcagctgacgcttggtcgcttcatccagatccgaagagaactgagcaaacgccgccaattcacggtaagcagccagagcagtacggataccaccagagagcttcttaacgatcttggtttgcgctgcaccacctacacgagaaactgagatacctgggtcaaccgctggacgtacgcccgcgttgaacagttcagtttgtaggaagatctgaccatcagtgatcgagattacgttggtcggtacgaatgccgatacgtcaccagcttgagtttcgatgattggcagagcggttagagaaccggtcttacctttcacttcacccttggtgaaacgctctacgtactcttcgtttacacgagcggcacgctctagtagacgagagtggaggtagaaaacgtcgccagggaaagcttcacggcctggtggacgacgcagaagcagtgagatttgacggtaagcaacagcctgtttagacaggtcatcgtatacaatcagcgcatcttcaccgcgatcgcggaagtattcacccatcgcacagcctgagtaaggcgcgaggtattgcagtgcagcagattcagacgctgaagccaccacaacaatggtgtttttcagtgcgccgtgctcttccaatttacgaactacgttcgcaatggttgacgctttctggccgatagcaacatagatagagtaaataccagagtttttctggttgatgatcgcatcaatcgccaacgcagttttacctgtttgacggtcaccgatgatcagctcacgctggccacggccgattggaatcatcgagtccactgatttgtaaccagtttgaacaggttgatcaaccgacttacgatcgataacacccggtgcgatcacttcaactggtgaagtctgttttgcaccgattgggcctttaccatcaatcggctcacccagagtgttaactacacgacctagcagctcaggaccaacaggaacttccaaaatacggccagtacctgttactttcatgccttcacgcagatccgcgtatggacccattactaccgcaccgaccgagtcacgctcaaggttcagtgccagtgcataacggttgcccggtaattcaatcatttcaccttgcataacatctgcaaggccgtgaatacgaatgataccgtcgcttaccgatacgatagtaccttcgttgcgagcttcactaacaacgttgaaagattcaatacgttgtttgatcagatcgctaatttccgtggaattaagttgcatgctccaatccccatcaagactgcaatgcatcgctcagacgcttcaaacgtccgcgtgctgagttatcgatgactaagtctccggctcgaataataactccgccaagcagagtctcatctacactgcaattcagctgaactttgcgctctaaacgctgctcaagcttgctgccaatttctgaacgctgttgttcactgagttcagtagcggaaatcacttccacatctactttcttctcatgttcctgctttagcacagcaaagtgctcataaagcgcaggaatcgccaacagacgaccattttctgccattaccttaatcaggttttggccatgaccatcaagctgttcgccacaaactgcaataaaaatctcagccaatttattagctgagcccgagctggttaacagctcgtgcatttgttcgttttttgcgacttcagcggtgaaagcaagcatctggctccaatggccaagttgctgtttttctaccgcaaaatcaaaggctgctttagcgtaggggcgtgcgattgtagtcaaatccgacatatgcgccccctccgttaaagttttgcagtaatgttgtcgagaatatctttgtgcgtatctttatcgattgaacgctcaagaattttctcagcaccagcaattgccagagttgcaacctgtttacgcagctcatcgcgagcacggttacgttctgcttcaatctccgcttcggcttgagtcaggattttctggcgttctgcctgagcttcctcacgtgcttcgtcgatgatttgtgctttacgtttattcgcttgctcaatgagctcagttgctgtgcgttttgcttctttcaattgatctgaagcattagcttgtgccaggtctagatctttctttgcacgctcagcggcttgcaaaccatcagcaattttcttctgacgatcttcaatcgctttgataatcggcggccacacatatttcatgcagaaccacacaaacataccaaaggaaattgcttgacctagcagagttgcgttcatattcacaacagctaccccctaaagtggacttagtgttaatcaacgacaaatcttatcgatttgtcaggacaaagcttgattaaccagctagctgaccaacgaatgggtttgcgaatgtgaatagcagagcgattacgataccgatcattggaaccgcgtccagcagacctgcgatgatgaacatcttaacttgcagcataggagccatttcaggttgacgcgcagcgccttccaaaaactttccgcctaatacagcgaaaccaatcgcagtaccaaccgcacatagaccaacaataatagctacagcgattgcagagaagctcaatacagtttccatctaatttctccaaagattcaatgggtattaaaaattcaatttattaatgatcgttatcttcatgagccattgacatatacacaatggtcaacatcataaatacaaacgattggatcaaaataaccaagatatggaagatagcccaaggtagggatcccatccattgcaggtaccatggcagcatagccgcacaaagaataaacactacttcacctgcaaacatgttaccgaacagacgcataccgagtgatagcggtttcgccagcagcgaaacaacttcaatcaataggttgaacggaatcatgatccagtgattaaacgggtgtagtgccaactcttttgcaaacccgcccagacctttcactttgatgctgtagtaaatcatcagagcaaatacgcctagagccatagccatggtgatattcacatcagctgacggcaccacttttaggtaagggataccaagccaatgctgtgctgggtaaggtaagaaatcgataggcacaaggtccatcaagttcattaaaaatacccaacaaaagatagtgagtgccaaaggagcaattagtggattgcgaccatggaaagtgtctttgacgtttttgtcaacgaactctaccaccatctcaacagcacactgcagcttacccggaacacccgctgtcgcttttctggctactgcacggaatactccaaggaatatcagtccagttaaaacagagaagaacaggctatcgatgtgtacattccagaaactcgactcttccgccactagccccaacttgtaagttgaaaggttagtaaggtggtgagtgatataactggaaggtgtgagcgcttcacctggcgcagccataactcatcctattttttgttgttaatgaatagcactggcgcacagatattgatacctagagccagcaaataggttagcttcagtggaacaagttccaactgcatatacatgtaggcaacggaaaacaggacgatagtgatgagaattttcagcgcttcacccgtataaaacgagatggcgaccatttttaacgcgcgcgcccctgcaaacaggaaagcacaacccgcaaaaacagcgttagcaatgacaaaaatgccaccaccgactaaggctgaaagcccccaatcaccatttaccgccactgcaaacacagctgccgcaaccataactgcactgaactggatcaataacaatcgctttgcaagctctcgtccttgcctcgctagcacagctaccatgtattcttacctctagtaatcaccacagctcgaaccgctttttcggactgggaaattggcgaaaattatacggtggcatcaactgattgcaatgaaaacaccgcaaaaagttacaattttgcatacaatccgacaactttcgcataaacaatgtgatttaccacaattgatttaaatcaattatctcacttagttttgcagcttggcaatcagtagctctaatttgtgaggctcatcaagactaatcgtcactttcgatttaccgtttggggttctcactatagagacttttgctgctaatttctcacttaaattttgtgacaattgttgtatttctaggtcttctgacacgttttttgcgtcagatgggtcagataaacatttttttacaagttgctcagtttgacgaacggtcagttgcttcttcgccacttgctgcgcaatttccacttgctgttcaccttctaacatcagaagagcacgagcatggcccatttccaactgtttggtctccaataagcgctttacgtcatcgctcaattggttcaaacgcagcagattggtcacagtcgtgcgtgacttgccgatcacttccgcaacctgctgatgggtaagattaaattcgttttgtaaacgctctagcgcttgtgcctcttccatcgcattcagatcttcgcgctgaatgttctcgatcaatgccatggcgatcgcaccacgatcttccacttgcttgatcaaacagggcacttgctttaaccccgcttgtttggcggcacgccaacgacgttcccccgcaatgatctcatatcctccggtgggcagatgacgcacgacaatcggctggataataccttgagactgaatggatgccgccaactcttccagagcttctggggaaagatctttacgtggctgataaataccgggcttgagattagagatggaaagatccgccaactcaccttccgccgacatcgactgactgagtgaagcaacttgctgcttttcgcgagccaatgaactggtcgcgagtagtgcatccagcccttttcctaaaccacgtttagtcatgtaaacgaattcctatagttgttgttttatgcgggaatctcttcgcgacgtaacatctcaccagctaacgctaaataggccttagccccggccgattgcttatcgtaatacatcgctggtttaccatgacttggcgcttcggccagtcggacattacgtggaataaccgtacgatacactttactaccaaagtgctttttcaattgatcagaaacttcattggccaagcggttacgtgggtcgtacatggtacgcaagataccttcaattttgaggttatcgttaaccacggcggccagtttgctgatcgtatccattaacgcggttaagccttccaacgcaaaatactcacattgcataggaaccaacacggaatcggcggctgccatggcgttgattgtaagaaggtttaaagaaggcggacaatcaataaagatgaaatcatagttatcacgcactgaggcgagtgcgtttttcaagcgcacttcacgggcaaacacttccatcagtttgatttcagccgcagtgacatcgccattggcggcaatcaagtcatagtgaccagtggttttgcgacataccacttggtcaaacggcgcatcttcaaccaaaagctcataagccgtggagtcaacctgatatttatcgacgccactagccatagtggcattaccttgtgggtcaagatcgaccaccagtactttacgtttggtagcggccatagaggcggccagattgatacaagttgttgttttcccaactccgcctttctgattggcgattgctacgattttacccacggtatgcctcgctgttatcccttgcgcgataagattacaagatgacgctcaccttccaactcaggaacttgcaaagctttgatatcggtcacagaacaccactcagggagtagggtgatttcatcatcaggccgtactcctttgagggctaaaaataccccagcattcggttttggtagatgctgacaccagttgaccatgtcggtcatcgacgcaaaagcgcgacttaatacgccatcaaaaccggattcaggatcaaactcttccactcgactctgcacgggtaacacattgttgatcttgagatcgtggatcacctgttttagaaaacggatccgtttaccaagactatcgatcagcacaaactctttatctgggtgcatgatcgcaagcggaataccaggcaatccaggcccagaacccacatcaataaagcgctcaccgacaagatgcggactgaccaccaaactatcaagaatgtgtttcaccaacatttccatcggatcccgcacggaagtgaggttataagctttgttccatttgtcgagcagctgcacatacccaacgagctgctcacgttgctgctctgtcaccgttaagctggttttgctgatcaaggcgtcgagtttgactcgtaacggattcattacgccgcttctccctttttcagcatgccgtgttttttcaggtgaaccagcaaaatcgaaatcgccgcaggcgtgatacctgaaatacgtgatgcaattccaatggtttctggtttagccgcattgagcttcaataccacctcgtttgaaagacctttgacttgcttataatcaagctcagctggcagcttggtatgttcatggcgcagcgatttttcaatttcatcttgctggcgctgaatgtagccatcgtatttaacttgaatctctacctgttcggcggcttctgcatcttccaaagcaggggcaaaagccggcaaagtggtcagcagctcataggtcatttcagggcgacgcagtaagtcttcaccactggcttcacgcgacatcggcgttttcagcagggtattgagctgttcgacgccaaccgagtttggattcatccaagtttcttgtaagcgttgacgctctttggccatgttgtcgattttttggttgaaacgtgcccaacgcgcatcatccacaaggccaagctcacgcgctttttcggtcaaacgcagatcagcgttgtcttcacgcagcagcagacgatattccgcacgcgaagtgaacatacggtaaggttctttagtgcccatggtcgaaagatcgtcgatcaacacgcccatgtacgcctgatcgcgacgtggactccagccttctttgtcttggctgtacaagctggcgttcagacccgccatcaagccttgcgcagcggcttcttcgtaacctgtagtaccgttgatttgtcctgcaaagaacaaaccatggatatatttggtttcatacgtttgcttcaaatcacgtggatcgaagaagtcgtattcaatcgcgtaacccggacgaacgatatgtgcgttctcaaaacctttcattgaacgtacgatctgcacttgcacgtcaaatggcaagctggtggaaatgccgttcggatagagttcagtggtggttaaaccctctggctcaataaaaatttggtgactgtctttatcggcaaaacgcatcactttatcttcgatcgatggacagtaacgcgggccgatcccttcgatgatcccggcatacatagggctgcgatcaaggttagcgcggatcacatcatgggtgcgctcattggtgtgcgtgatgtaacacggaatttggcgtggatggtgctcacgcttgcccatgaaggaaaaaactggggtcggattatcaccgtgctgcgcttccaataccgagaaatcaacgctattggcatcgatacgtggtggtgtgccggtttttaagcgatcaacacgaaatggcagttcacgcagtcggtgcgccaaagcgatcgatggtggatccccagcacgacccccagcatagttttcaaggccgatatggatcttaccgccaaggaaagtcccgacggttaacactaccgctttggcatgaaatttcaggcccatctgagtcacaacaccacgaatatgatcatgctcgacgatcacatcatctaccgcttgttggaacagggtgagattcggggtgttttctaacacattacgcacataggctttgtacagagcacgatcggcttgtgcacgagttgcacgcacggctggcccttttgaagcgttcagtgtacgaaattgaatacctgcgtgatcgatagcttgcgccatcaaaccgcccattgcatccacttctttgactaaatgacctttaccgatcccaccaatggcagggttacaggacatttggcctagggtgtcaatattgtgggtaagaagtaacgtacgctgtcctgtacgtgctgcagcgagagcggcttccgttcctgcgtgaccgccaccaaccacaatgacgtcaaatgtttcgtgataaagcatgaacgacctcaggtattcatcgagactatgggttaacaaaagaggcgtattctaacctctttcggttggctagaaaatcgctttcctgttttttcgatcaagg

SEQ ID NO: 8 - DNA, 61 bp, Artificial Sequence
  Description of Artificial Sequence: Synthetic oligonucleotide
aggtatatgtgatgggttaaaaaggatcgatccttgctctcttgtagtaccacactcatat

SEQ ID NO: 9 - DNA, 52 bp, Artificial Sequence
  Description of Artificial Sequence: Synthetic oligonucleotide
tcatcattattactcgagtgcggccgcattacgacgtttttgaccgaagccg

SEQ ID NO: 10 - DNA, 57 bp, Artificial Sequence
  Description of Artificial Sequence: Synthetic oligonucleotide
taatgcggccgcactcgagtaataatgatgagctcaacattactcgcctcaaaaact

SEQ ID NO: 11 - DNA, 56 bp, Artificial Sequence
  Description of Artificial Sequence: Synthetic oligonucleotide
ccgggagagctcgatatcgcatgcggtacctctaggcgatcagagccaagcgtaag

SEQ ID NO: 12 - DNA, 20 bp, Artificial Sequence
  Description of Artificial Sequence: Synthetic oligonucleotide
aagccgtggggaagtccttc

SEQ ID NO: 13 - DNA, 28 bp, Artificial Sequence
  Description of Artificial Sequence: Synthetic oligonucleotide
cgctgtcactgtataacaatggaaagtg

SEQ ID NO: 14 - DNA, 61 bp, Artificial Sequence
  Description of Artificial Sequence: Synthetic oligonucleotide
aggtatatgtgatgggttaaaaaggatcgatcctacctgccattacatcgatgatttgagc

SEQ ID NO: 15 - DNA, 60 bp, Artificial Sequence
  Description of Artificial Sequence: Synthetic oligonucleotide
ccgggagagctcgatatcgcatgcggtacctctagcatcaagttctgttctcgcacaagc

SEQ ID NO: 16 - DNA, 54 bp, Artificial Sequence
  Description of Artificial Sequence: Synthetic oligonucleotide
taatgcggccgcactcgagtaataatgatgatcgctcatatggcttaagcgcat

SEQ ID NO: 17 - DNA, 56 bp, Artificial Sequence
  Description of Artificial Sequence: Synthetic oligonucleotide
tcatcattattactcgagtgcggccgcattacatcaagttctgttctcgcacaagc

SEQ ID NO: 18 - DNA, 60 bp, Artificial Sequence
  Description of Artificial Sequence: Synthetic oligonucleotide
aggtatatgtgatgggttaaaaaggatcgatccttttacagcctgactaggttcttgctc

SEQ ID NO: 19 - DNA, 52 bp, Artificial Sequence
  Description of Artificial Sequence: Synthetic oligonucleotide
ttatcatgcggccgcactcgagtaatgataagcggagcttaactcagtgggg

SEQ ID NO: 20 - DNA, 62 bp, Artificial Sequence
  Description of Artificial Sequence: Synthetic oligonucleotide
ttatcattactcgagtgcggccgcatgataaagttattatgtagacctctcagtaacatccg

SEQ ID NO: 21 - DNA, 55 bp, Artificial Sequence
  Description of Artificial Sequence: Synthetic oligonucleotide
ccgggagagctcgatatcgcatgcggtacctctagaagacgatagcgcaaagcgc

SEQ ID NO: 22 - DNA, 52 bp, Artificial Sequence
  Description of Artificial Sequence: Synthetic oligonucleotide
aggtatatgtgatgggttaaaaaggatcgatcctcaaccggcttcgggcaac

SEQ ID NO: 23 - DNA, 53 bp, Artificial Sequence
  Description of Artificial Sequence: Synthetic oligonucleotide
ttatcattactcgagtgcggccgcatgataaattaaggaataccgggcgacgt

SEQ ID NO: 24 - DNA, 61 bp, Artificial Sequence
  Description of Artificial Sequence: Synthetic oligonucleotide
ttatcattactcgagtgcggccgcatgataagatgccgaaaatgatgagcgatttattcat

SEQ ID NO: 25 - DNA, 66 bp, Artificial Sequence
  Description of Artificial Sequence: Synthetic oligonucleotide
ccgggagagctcgatatcgcatgcggtacctctagtgagaatagtaatttcgtttttgatggccat

SEQ ID NO: 26 - DNA, 25 bp, Artificial Sequence
  Description of Artificial Sequence: Synthetic oligonucleotide
atctcttttgagttgtgtcctaatc

SEQ ID NO: 27 - DNA, 61 bp, Artificial Sequence
  Description of Artificial Sequence: Synthetic oligonucleotide
aaaacaccaaattttaatttaatcatggacgtcctcctattcagccgtacccgatttagca

SEQ ID NO: 28 - DNA, 49 bp, Artificial Sequence
  Description of Artificial Sequence: Synthetic oligonucleotide
atgattaaattaaaatttggtgttttttttacagttttactatcttcag

SEQ ID NO: 29 - DNA, 52 bp, Artificial Sequence
  Description of Artificial Sequence: Synthetic oligonucleotide
gcaatccaagacgcttggtgagagttaatttgccatactaattgcggcaatc

SEQ ID NO: 30 - DNA, 24 bp, Artificial Sequence
  Description of Artificial Sequence: Synthetic oligonucleotide
ctctcaccaagcgtcttggattgc

SEQ ID NO: 31 - DNA, 60 bp, Artificial Sequence
  Description of Artificial Sequence: Synthetic oligonucleotide
ccgggagagctcgatatcgcatgcggtacctctagggcgtgttcgcttctagcctattgg

SEQ ID NO: 32 - DNA, 64 bp, Artificial Sequence
  Description of Artificial Sequence: Synthetic oligonucleotide
aggtatatgtgatgggttaaaaaggatcgatcctatgagccgttttccaatatcgatactcaag

SEQ ID NO: 33 - DNA, 42 bp, Artificial Sequence
  Description of Artificial Sequence: Synthetic oligonucleotide
gattaggacacaactcaaaagagatggcgaaagcgagcacgc

SEQ ID NO: 34 - DNA, 58 bp, Artificial Sequence
  Description of Artificial Sequence: Synthetic oligonucleotide
aggtatatgtgatgggttaaaaaggatcgatcctaagtgcgggtatcgccatgtgtac

SEQ ID NO: 35 - DNA, 52 bp, Artificial Sequence
  Description of Artificial Sequence: Synthetic oligonucleotide
gcagaaaagtgcaaaatcttcattcaaatgtgattcccctttggtcaccctt

SEQ ID NO: 36 - DNA, 52 bp, Artificial Sequence
  Description of Artificial Sequence: Synthetic oligonucleotide
aagggtgaccaaaggggaatcacatttgaatgaagattttgcacttttctgc

SEQ ID NO: 37 - DNA, 56 bp, Artificial Sequence
  Description of Artificial Sequence: Synthetic oligonucleotide
ggagagctcgatatcgcatgcggtacctctagcaattgacgaacttgctcatcact

SEQ ID NO: 38 - DNA, 20 bp, Artificial Sequence
  Description of Artificial Sequence: Synthetic oligonucleotide
gttgccttggagcaagaccc

SEQ ID NO: 39 - DNA, 20 bp, Artificial Sequence
  Description of Artificial Sequence: Synthetic oligonucleotide
cgatgctgttcacgccttcg

SEQ ID NO: 40 - DNA, 48 bp, Artificial Sequence
  Description of Artificial Sequence: Synthetic oligonucleotide
gtgatgattggtaccagatcttaattaaggtgcaggaagcaacggccc

SEQ ID NO: 41 - DNA, 27 bp, Artificial Sequence
  Description of Artificial Sequence: Synthetic oligonucleotide
tcagtcacctcctagctgactcaaatc

SEQ ID NO: 42 - DNA, 61 bp, Artificial Sequence
  Description of Artificial Sequence: Synthetic oligonucleotide
cacgcattgatttgagtcagctaggaggtgactgaaagaggagaaaggatctatcgaccac

SEQ ID NO: 43 - DNA, 52 bp, Artificial Sequence
  Description of Artificial Sequence: Synthetic oligonucleotide
cggggattggtaccgcggccgctctagaggtgagaggctgaacctctttgca

SEQ ID NO: 44 - DNA, 468 bp, Artificial Sequence
  Description of Artificial Sequence: Synthetic polynucleotide
aagaggagaaaggatctatcgaccactacctcgaccctgatgaaataaagcagtcgttttagagctagaaatagcaagttaaaataaggctagtccgttatcaacttgaaaaagtggcaccgagtcggtgcaaaaagagtattgacttaaagtctaacctataggcataattatttcatcactatttttgtcgattatcttgctgttctagagagcgggagctcaagttagaataaggctagtccgtattcagtgcgggagcacggcaccgattcggtgcaaaaaatttatttgctttttatcccttgcggcgatataatgtgtggatagaactaaacaaagggagcattatagttggagaggcatgagaatgccaagttccaataaggctagtccgtacacacctaggagactaggggcaccgagtcggtgctcggcaggctgaatgcaaagaggttcagcctctca

SEQ ID NO: 45 - DNA, 58 bp, Artificial Sequence
  Description of Artificial Sequence: Synthetic oligonucleotide
aggtatatgtgatgggttaaaaaggatcgatcctgtgacacaatgaaacagaagcgag

SEQ ID NO: 46 - DNA, 46 bp, Artificial Sequence
  Description of Artificial Sequence: Synthetic oligonucleotide
ctttgcattcagcctgccgagtgataggtaattgtgtcgaaatcgg

SEQ ID NO: 47 - DNA, 46 bp, Artificial Sequence
  Description of Artificial Sequence: Synthetic oligonucleotide
ccgatttcgacacaattacctatcactcggcaggctgaatgcaaag

SEQ ID NO: 48 - DNA, 59 bp, Artificial Sequence
  Description of Artificial Sequence: Synthetic oligonucleotide
ccgggagagctcgatatcgcatgcggtacctctagtctcttccgcaaactgaatgtgtg

SEQ ID NO: 49 - DNA, 20 bp, Artificial Sequence
  Description of Artificial Sequence: Synthetic oligonucleotide
tgagcatctcgcagcagatc

SEQ ID NO: 50 - DNA, 21 bp, Artificial Sequence
  Description of Artificial Sequence: Synthetic oligonucleotide
gttgtaaggcactttgtcggc

SEQ ID NO: 51 - DNA, 1047660 bp, Artificial Sequence
  Description of Artificial Sequence: Synthetic polynucleotide
  modified_base (538840)..(538853): a, c, t, g, unknown or other
tggagtattaacagaaaattgataccaaacgaacaaagttaagtataaaaaccgcgtttaaataacccacatattcttcgataaggagaaaacattttaaatattacagtgtcacttatttacaatgtaaagccacgttttgaagtgatgatgaataaataaaagcgagccgtaagcggaacgattaaaccgagccactaagttacggtgaatgccattctgattgaaatgatgcgcaggattcaagcaagatgagaaaatgcctatctttcctccagcgaataggtatcaccgaaacgatgatcaagagcagcagcttgatcattcttccgtaaaaaatagagggttaaggaaacatgatcaagagctcatcatggctatgagtcgaggcaagagaattaacaattgaagatcttcaatcggatcgatgatcaagaggtaaatcgtcgcggaagcatgtaaattcattatcaatttacggtcgatgtcaggcagagtaaggctttggctagtcagtgatgaaaaaccgtctatcctaacaagtctcagtcaaaacaagataaacagaacaacagccatgatcatgctttcgtaatcccgctccgtcaccttggccagcgcaatatggcgctgaagatgtcaattggaagcacaagtcacaagtattcattgcgatatggccaagaaatcatcctctcttgatcatctttccgtggtcatgagagtacgagaggaaggagatacaacgacctatcttgatgtcatccactcaggttgtggataaactgtgtgagcaccttgatcatgcttagaagcttacgttgatcattgattctgttgactgatgatcatgcttagaggaacaaatgatcatgctttcgatcttgtattgatcatggtttccatcgatacatgatcatgcttctgaatggcttaaaataatctcttttaattacaataaattagaactaaaaatcgtcacagatcattagatcactctaatcatatttaatcatttaaatcagaaagatcagttatttaaaaacaacaaatttttctttatttatgatctctttttctttattctcttggaactatagtgatattacggtaagtgtgatacggatctaaccatgagctcagaagaaaaacgattgatcaaattgccaagaactcacaaagatggtcatctttttgaagtctctgaagccgcgattgactggattgaacagtatcaacactttaaaggtgtcacgaaaagcattgttgaacttttgaatctgatctcactgcgtggattacgcagtagagatggcttagtttcaaccacagaactgattgatgcaaccgatgggcagctgacgcgtgcagccatccagcagcgcttgagagcagcggtagctgttggattgttcaaacaaatcccagtgcgttttgaagaggggctggctggcaaaaccatgctccatcgtttcattaaccccaaccaattgatctcggtactcggctcaaccagcttagtcactgaatcggttaagcaaaatgaaaagcaaaagcgctcaaaagcattagcgcagacgcaagtcaatcaacgtttactgcatgagcatggtttaaatacaccgccagccatgaaagatgaggctgatcagtttgtggtctcaccgactaactgggcagggatcattgatcaagcgttagcgccacccagaacccgcaagagctaccaaaagtctatggtttcgatatcgggtactcgtgctgtgattgaaacacgatcgtctaaaaacatcatgacggtcgacgatctgatgactttgtttgccttattcactttaacagtgcaataccatgatcatcaccaagatgattaccatttcaatgctaaacaagcaccaaacaaaacgccgctgtatatcaccgacattctctctttacgtggcaaaaaagacagcggcccggcacgtgactcgatccgtgacagtattgatcgtattgaatttaccgattttcagttgcatgaactgacgggtcgttggctcagtgagaatatgccagaaggctttaaaagcgatcgttttcgctttttagcgcgcaccatcaccgcttccgaagaggcacctgtggaaggcagtgatggcgagatccgcatcaaacccaatctgtacattttggtgtgggagccttcgttttttgaagagctattgacgcgagattatttcttcctatttccaccggagatcttgaaacaacataccttggtatttcagctctactcctatttccgtagccgaatgtctcgtcgtcataccgatgtaatgatgctgagtgaactcaaccaaaaattggccagaaacatcgaatggcgacggttttctatggatctgatccgcgaacttcgtcgtctctccgaagggaaggggagtgaagatctgtttgtggtcaatctctggggttatcacttgactgtgaaaagcattgaagagaaaggcaaagtggtggattaccaagtcgatatcaaatgtgatgtggaagaggtactgcgctattcacgcgccaaaaccaccaacgcgggtaaacgcaatatggctccaaccttgcctaaccctttacgtaacgagctggtttccaagcagaaactggctgagttatcgagcatcatcgatggtgaatttgaaccaatccagcgcaaagccccttcgccgagaggccgcttaggtcggcgcgtgaagctacgtaaacatcttgtcgaaatcaatgctgatgaaatcaccattactctatcgcgttatacctctccagaagcgctagaacgcagtataacggctttagcggctatgactggacacgccccttcatcaatcaaagaagagtgtgtagagctcatagacaagctagattggctgcgtgttgaaaacgatgtgatccaatacccgacattgagcaagctgcttgagctctacaacagccaaaatgagagtaaacatctgtcgatcgaaaaattgatcgcaggtttagcggtacgccgtaaagtctgtaaattggttcaagatgggcacattgacgaaacggtgtatcgagccttagatgagatggccgctggagcctaaccaaaacggattaggctgggcgttggttttgtgacttaaacctgacaacagtctgacattgaaccgaataaccgccgatacactgcttcacgaatagacaaccttttgtcctatctgatgaattgtagattggctcatatgttttaagcgagtttaaatagctcgctctttttttgcctacgatttggcaaaatcctgactcagtgctttctatcccgactatccgcgcatcggatctcgagttccttgatcatcgttccaagcatgaaacgccataaaacgtacatgcgcatcgatcaaggcgtgagattgagattctccacccacttgatggttgagatgttcaagactcagcaccatcagctgttgcatccgtagcaaacaccaagatttcaactccaagtcacactcaggttgagcggcgcagagctggaatcgaccgtaagccaaattgagatattgcaaggccttctcggtatccgtctcgcgataaaactcaaattgacgcaaacaggcatcaagccagcaggcaatcgctttgctttgagtggaattgagcgcaggctgccagagtgcttgcggtgcgccaaaaatcaaaggttgtaattcagcgacggcagcacaatcgttatgttgataccagtgatgaatggtgtgtaaccagtgctgtagttcattcataccgtaagtctcgatcatcaaaaaaagagttgatcccataagatcaacgatctgaagcaaaccatatggctgatgccacgctttcattcttgtagtgtggttcacgaaggcaatgtttgccatatactcttgatagggaaaggggaagatcaataaaatgaccgagaagagaggcgttgtactgcgaaataacgcgccaatttagcggtgagtttgggtattagcaaaaagaatatctatagttttattgataggatttctgaagtattgccataatcacaatatggattaaatctacttaacaaagcacagcgcctttgctacagattagctgttcctagcatggtttttcggaggtatctatgtccattaattctattgaccatgatgacatgacgaacattgccaacaaatgggattcaattgaagaaattgaatcccagcgaccaacaaagaacttgaagtcagcggaagctcgacgccgtattgaaacgctacgtgagatacgcgaaagcggcctgactatcgaggaagctaaagagctgggtttgttgcactagcctttggtatcagagatatcgatgaagggtgacttaggtcacccttacttatttttattgctttagttgatttgaagcacccaaagcaacattttgactcttaattttccgcattcctatgttatatttcgccccacgattttattgactgtgggcttactaatgtctttcaaccttgcattactgactgcggcagaaaaaaacagagtagaacttgataaacaagcttcttaccttgtttggcgacttaagcaagcaaaagcgggaccggaagagatcactaagcagatggccaagattgcttctgaaagcgaaaaacagtggtttcaacagtcgatagagaagtacaaaagagtgatgggcgttgcgtagcgtctatgctcagcaggtggcaaattgcaaacagcaagccttctgctaaaatccgtcgcaacacattgaattagagagaacatcccaatgggaagaagttttgaagtgcgcaaagcctcaatggcgaaaactcaaggcgcaaagattaaagtttactcaaaatacggtaaagagatttacgtttgtgcgaaaaacggcggtactgaccctgacatgaacttatcgctgcgtcatctgatcacgaaagcgaaaaaagaccaagtacccgcacacgttatcgaaaaagcactggataaagccagcggtggagcaggtgaagattaccaaccagcacgttacgaaggtttcggccctggtggcgcgagtgtgatcgttgactgtctaacggacaacggtaaccgtacctaccaagacgtgcgccaatgcttcgtcaaaacgggcgcgaaaattggtactccaggtgtggttgcacacatgtttgatcaccaagcggttttccaattccaaggcgatgatgaagaagctattcttgaagcgctgatgatggctgacgcggaagtgacagacatcgagcatgaagatggtgtgatcactgtatttgcacctaacaccgaattcttcaaagtgaaaactgctctgaacgaagcattcccagatctgactctggatgtggaagagatcactttcgttccacaaaaccgcactgttgtaagcggtgaagacgcagaaaaattccagaagttcctcgatatgctggatgactgcgatgacgtacagcaggtttaccacaacgcggatatcgaataatcgttatcttaaaaagccgagcgaaagctcggctttttcattttgggatatcagcatcctaccttcagcgccaagtcatttgggtataaaaacaaaaatcataaggagaacaagatgagagtcagctttattggattaggcgtgatggggtatcccatggcgggacatctacaaaaagccggttttgacgtcacggtttttaatcgtactcaggcgaaagcggtggcgtgggcgaaacagtttggcgggcagtatgctgaaacggtagcagaatgtgtcaagaacgccgatgtggtactcacttgcgtaggtaatgacgatgatgtacgcagcatgaccacggcagctactggcgctattcccgcgatgaaaccgggcgcagtattgatcgatcacaccacgacctcagcactgttggctgaagagttgtcggcagcggcgcagcaagcgggtttgcattttatggatgctcctgtttctggtggtcaggctggcgctgaaaatggcgtcttgaccatcatgtgtggtggcgatgaagcactctttgccaagatgcaacctatctttgccgcttacgggcgctcttcggttttgatggggacggcagggcaggggcagcgcgctaagatggtcaatcagatctgtattgccggtgtgctgaatggtctctctgaaggactgatgttggcagagcaagccggtttggatatcccgaatctggtggcgtgtttgaaaaatggggcggctggctcttggcagatggaaaatcgcgcgctgaccatgagccaagagaaatttgattttggctttgcgattgattggatgatcaaagatttgggtttctgcctagatgaagccgcgcagttaggcctgagattaccgatgacagaaaacacgatgaccgcttaccagcgcctttctgcgcaggggttaggtcgtatggatacttccgtactgattcaagcggtaaaagaagctgctaagaaatagccatgctgaccacaaaaagcgcctcagtgtgagaggcgctttaggtcaacagtgaccttggtgcagttcgtggtatagcggttcaatttacactgtaaacaactcacactttaaagcgcgccaccagctcatacagctcgtgagctcgtccatttaatgtctggctaccttgacggttctggttcgctaaatccgccgattcgctactttggtcagaaattaccacaatacgctgtgagatctcttgtccgacaatgctctgctcttcagtcgctgtcgcgattaaggcgttcatatccataatagtgccaattgacgcttggattttttggagcgcttcggccgctgcgttggcttctcgcacggtagtaatactgcgctgttggctcgattccatggcttttacggctgcgtctgagcccgctttcaactgttggatcattgtgtgaatttgctgagtactttcttgggtacggctagcaagcttacggacttcatcggcgaccacggcaaaaccgcggccttgctctccggcacgcgcggcttcaattgccgcgttgagggcgaggaggttcgtctgttcggcaatatcttgaatcacggccaatgagctagtgatgttattgacatcgccttcaagtttggcaatgacgctgctggcatcggccacttcttcggccaaagcttggactgagcgagccgcagcgttaacgatgttatgaacgtcggtcgcattatcttcagcgtctttggctgactgcgcggcattattcgcgttgttagagatctcttgagcggtcgttgtcatctcggtcatcgctgtagccacttgttcggtctcttctctttgattcgacgctaaatggtcaacttgagtcgcccgttggctcatggcattggtctcttcaaccacttgctgcccaacttgattgacccgtttaatgatgttttgcaagctctctacaaaacggttgaagttgtggctcaatttatgaaattcaggaacactgaatttttccatgcgtgcggttaaatccgcatcgccactggcaaatgaactaatggaattatcaaacagctccagtgggcgcatgatgcttcggttaatcattattgccatcacgctaaccagaatgacaataagcagcgtaatgccagccagtgtatatagcccttgttcgagctgctcttctgcgcgcgcttccatctctgcaatttcagcatcgacatcgtcagtgtaaaaaccggtccctatagtgagatcccactgtgggagatagaccgaataactcagtttaggtaagggcgtctgttcgccgggtttggggaaataataggttgtgaattggtttaatttggcgtttttcagcaaatcttgaatcagatagttgccttgggtgtcttgcatgttcataaagttgtcgcctaagccattcgtcgctttacctaataacaggcgagtaccttttgaatcataaccaaagatataaccgctttgtccaaactgaatttcacgtaatatcgcgattgcatcatcgagaggggcttggcgggctttgagtggagcaagcgcagtatccgcgatttgcaaataggatttcagttcggcctgtttcatttccatcatggcctcacgggtattgcgcatctgctcttggctgagtaagcgggtttcgctaaaagtaaagtacatcatacttaatgctatggtgagtaaaggcaccaaagaaaggatgtacaggcgttgtcgaatcgtcaggctcatagttgtggctcacttcgttagttattattccctttctcgttgaagcggtatcggtattggctacgtccgtttacccaatcacatcgtctgcttatgctcatggggatcaacttgcttgcacctatctgcaactccaagtcgtttggggatatgagaactttattaataagcctagttcaaaaagggatattgtgtagtgagtggcggaagatgtttgagtataagcaaagagagcgtgctatactctgcgccctttcagttcgatagagcgaccatcatgaaccttaaaaccgatattcaacaactcaacaatcgcatcgatacttgccgccgtaagttggatgccgcaaaaagtcgtgccgattcagagatggtcagcaagtttaccgatgaattagaagccttgactaagcgtttgaatagcgtgaaaagcaagcaagattacgatctcaataaaatgcgtaaaaccattgccgatatgcctttctctcgtgagctgactaagcttgagcaagcggatttaggtaagctgaaaaaatcggtgaaagggttagtgatcgtgcaccctaccaccaaaatcggtaaagcattgcgtgtcgaagtgatgacgggttttgcgcctaagccattctaaatatggcaaagaatttaaatagaaagagccagcgtttgctggctcttttgcgtttgtcaggtcgatttagtagcccatcagctgcaatagttgctcggccgtttgtaccgcttctttgcggttggcgatattgagtttctgatacagattacgaatgtgggttttgatggtggtacctgccacatccaactcatgggcaatctgctcattactgaaaccggagtagatgagcccaagcacttgccattcacgttgcgtgagtggactagtgcgcactagctctggaatgttcgggtgattcaccagcttttcgacaaactcttcatcaaaatgaatggatcggctgcgctgagtggtggagatctccttgagcagcagatgggcacgatggcgttccaaatctcctagctcacctttgtgaaccagcttctccagcagatgaccaatcttgctgccatcaattaagaaattaccaatcatgcccgtttggttggtgaggcgcagtgcttgtttgagcttatggcaggcttgcaaatcatctccttcagtaatggccagcagcgcttccacaatcaaattgcgattggtgtcggtgacgagttgatattcttgcgcctgctcttgaataaagtccaaggtatggcgcgcttcgctgagttcaccgagttggatctgcgcgcgcgcgatattacgccactgcaattgggagaagtggttgcacgctttatctggtcgagtgctggactgtagccactgacggatctcggtgctgttttctttgacttgccagtacagcagcaaagagagcgaagcattcgccgtccaatccacatggtaagtcgattgtttgagtagatgctgtatctgttcaataaagcgtccggctttatccagctcacctcggccaatcgcaattctagccagcatcgaataacagtgcaggtgcttactttgcgaatggttttctagcacgctcagccccttataagcggcttgttcggcttcatctaagcggttccagcaccataaaatttgcgcgcgaatccgcagcaaaaattcatgcagcggtacttgatgcagttgctgctcttcaatcaacttaaacgcgttatcctgaacttcgtaagccgcttgcacatacccttgcgccagtagaatttcgctctgttgcagtagtgcccataaagcttggtgatacacctgatattggcgtgccagtttctcggtctgctgcatcatggagagcgcacggctgagatgacctaatacgtggttcacttcaccaacgacagaggtcgcgacaatgcggctgcgataggtcgtgtgatccaactggcttaacgcgagttcagccagttccagcgctttttctggctcgttttggttaatcgcgacttgggcacgcagggcgttaaattcgccttgctctttggtggagagctcaacgttgagcgctttcatctctttcgccgctttggcaagcagtgcgccgacatcattgtatctatgctggctctgcgccagccaagcttgcagcatgcacaatttaggctcgcggtacagttggggcggcgagagttgattgatcgccgcttccaacacttcgagttcgccttggttaaacattttccaaccatattggctcaaaatgctcgccagcagctcagtgtcttgtgctaaatgagcatgacgcagtgcttgatgaggtgccgcggcttctaaccacgctttggcggcggcgcgttgcaaatcttgctcttgctgcggaatgcgcgcttgacgttggtgcgctaaaaattcagcaaacagattgtggaagcgataccagttagtttccccttccagcggtgagataaatagcccgaagcggttaagtgactcaatcattgccagagcatcatcgcgccctgttaagctgctgactaatgcatcgtcaaaatgatcgagtaccgaacactgcatcaagaaatagcgggtttcatcgtcgagcagatcaaacacttcttcgaccagataatcccaaagatgcgcatggttaaagtgcgaaactgattcgatggtttgagctagcgtgcggtgctgatgctgcgcttggagagcgatgagctgcatcgcagaaggccaaccttccacataatcgcgtaggtgattcgccgtcagcgcatcaatcccatcggaaacgcgttggttgaaaaagcgggtcgtctcttcggtatcaaaagccaaaagctcattgccgatctcaatcattaaatcacgcacgcgcagattagccgtacccaaaggtggggttgaacggctggtgaccaccaaggttaagttatcgggcatgtgctttaagaaaaagcgcatcgcttcgtgaatggtttcatcatggatcaggtggtaatcgtccagcaccacataacattcgccgtggtagtcggccatctcggcaaacacttcactaaacagcgaatgcaatgacgaaaactgacgcttctctgccaatttttgcgcattggggcaggcgttatgggttgctttattaatcgcttgcagcaggtagttcataaagcggaacggatcgttatcgctatcatcaatgctgtaccaccccagattaggcttgtcggcaagccactgcgcggccatggtggttttgccatagccggcgggggaacgaaacagcaccaatttataacaggtggcgtgctgcaataaatccagcacacgggggcggacgatggcgttatgcaaacgtcccgggcgagtcagtttcgaagggatccacatcttctttctctcgtctattccagtcagagcctcatgctcttttaacttgaaacgcaagttccaagcctaaggggaggtgaatacgcgaggcgtatcacactcagatgggcgaatgttacttgaagtcattctgtgcgtttattgatccatactgagttttttgtcttcttcacgtttcgcacgttactacgccctatatttgtgatgtttgtcactaatcgatctttttaaaacggacgatattgttcaagcctctacgccatttagtgaaaaatgggtaacaactgcgaaattattgtgatctatttagcagagtggacaaatgagtgatggctcgttttctgacttttcataaagcctagctatggttaatcggcaggtggtgtgatccgaatcactgctatctctagctgaacggtgcattgatgggagctagatcactcactaccagactcctgtgcctctacgccttggctcctcctcccaattgatgagaaaagtgggaggatgttttgccaaagtcgtagaggcaggatagggctcagatggattagaaccaaacagtgagagttcacaatgaaacctactcaacagaaacagtttgacaagaagttgttccaagaaaacgtaaagcgtcatttgaccgcgacttatgccacaacagtagagcacgcttcggcgcgtgcttggtacttggcgatgggacgtgcccttgctgaatttacgacgtttgatttgctggaaaccgaacaggatgaacgcatcctcaatagcaaaagcctgaactacctatcgctggagtttttgattggccgcttaacgggcaacaacttgatcagcatgggtgtgtatgaagccgtagggcaagcgatggaagagctcggccagaacctgagcgacttgctggaagaagagcgcgacccatcattaggtaacggtggtttaggccgtcttgccgcctgttttatggattcttgcgcggcgcaagaatacccgaccgtgggttacggtctgcattacgaatatggtttgtttaaacagtcttttgaagaaggccgtcaaaaagaagcgccggatgcatggtgtggagtcgaaggctacccgtgggaagtcgcgcgtcctgagctgaagcaggaaattggtttctacggccacgttgaagtcgtcaatgaaaatggcaaagagcgtcgccgttgggtaccgggcatgctggtgcaagcgatgccgtgggatctgccgattgtcggctaccaaagtgatacggtttacccgctgcgtttgtgggagtgtcgcgcaatcgcacctttctcgttagaaagcttcaataacggtaactactttgaagcgcagcacgcgctgatcgatgcaggcaacatcaccaaagtcctgtatccgaatgacaaccacgaaaaaggcaaaaccctgcgtttgatgcagcagtatttccacagtgcagcgtcggtgcgcgatattctgcgtcgccacgaggcggcagggcacgcgttggcggatctgccgaaatacgaaaccattcagcttaacgatacgcacccaaccatcgcgattcctgagctgatgcgcattctgatcgatgagaagctgatgtcgtgggaagcggcgtgggcgatctgttcgcacacttttgcttacaccaaccacactctgctgccagaagcactggaaacgtggagtgagtcgctgatccaacgcctgctgccacgccacatggagatcatttacgagatcaaccaccgtttcttgcaacaagtgcgtgccaaatggccgggtgatgtggcgaaacagcaaaagctctcgatcatcgaagaaggcttccaccgcatggtgcgcatggccaacctgtgtgtggtcggctcttatgcggtgaacggcgtagcggcgctgcactcagaattggtgaagcgtgacctattccctgaatttgttgagctctatccgggcaaaatccagaacgtgaccaacggtatcaccccacgtcgctggctgaagttctgtaacccgggtttatcggcgctgatttcagagaagattggccatgagtggcctgcgaagctggaccaactgaccaaagtggcgcagtacgccgaagatgccgcgttccaaaaacgctttatggaagtgaaaaaagccaacaaagcgcgtttggctgattgggtgaaagatcacatgggcatcgagctcgataccaatgcgattttcgatgtgcagatcaaacgtctgcatgagtacaagcgtcagcatctcaatatgctgcacatcttgtcgctctaccatcgcctcatcaatgatccaagctttgacatgcatccacgtgtggtgttctttgcggcaaaagcggcgccgggctaccacttggcgaaagagatcatctatgccatcaacatgatcgcgcagaaagtcaataacgatccgcgggtcggcaacaagctgaaagtggtattcatccctgactatcgcgtcagcatggccgaaatcatcattccagcggcagatgtgtctgagcagatctcaaccgcaggtaaagaagcatccggtaccggcaacatgaagatggcgctcaacggtgcgctgaccataggtacgatggatggcgcgaacgtcgaaattcgtgaagaagtgggcgatgacaacatctacatcttcggtttggaagtggatggcgtagaagcactgaaagcgcgtggttataacccatacgatttctatcatgctgatccgctcctcaaagcatcgctggatctgctggtgggtgaagagtttacgccgggtgctccgggcaaactgcgcgcgacctatgacagcttgctcgatggcggtgacccatatctggtgctggcagatttcgcctcttacgtgaaagcgcatgaagcgatcgacaaacagtatcgtgaccaagcgggctgggcgaaaaaagccatcctcaataccgcgttagtgggcaaattcagctccgaccgcagtatccgcgactacgtgaataacatttggaaactgagcgctgtacagcgttaagcccctttggtgagtcagacccctctggctcaccttttttacataccctacacggaaggggaaagcagtcccttcggagagagcgatgaatcaagacaatgcattaaaacaagtcgctgcaatggcaaaaattgccgatcgatatgtcagcgcgtggggcagtgaagctcaagtggaagacgacacgatccgtcgtcttttggcgtctcttggctacgataccagcagcgatgacgccttgctgcaatcggcagagaagaaacacaaaaaagatgtggtggatccggtactcgttgtacaccaaggttcggcgatcgaagtcccgctctaccttggcgtgagtgcgcgcgaaagcgaatttgattggcgcttgcagaccgagcaaggcgaggtgctggaaggctatctgcaatcacaaattgtacgtgatgaacgtgccgaaggcggcccactggtgtttgctctgcctaacgatctgccgctcggttatcacaccttattgattgcccgtaagcgtcgcaaagcaccttacgaaatgaccctgattgtgacgccacaagcttgctacaagcaaccagctttggcacaaggcaaaaagctgtggggaccgagcgttcaactttataccctgcgtacccagcacaactggggcatgggagactttggtgatttgaaacagctcgtggcggatattgcatcacgcggtggcgattttgttggcttaaacccgatccatgcgctgtttccagccaacccagagggcgcaagcccgtacagcccatcctctcgccgttggctcaacattctgtacattgatgtgagctcagtacctgaatttgcactcagcgccgaagcgcagcaaaaagtgggtagcccagaattccagcagcgcctccaaaaagtgcgtgatgcccattgggtaaactacagcgaagtggctgagcttaaaatgagcgtcttacctctgctgtttgccgaatttaaaaaacgtcatctggataagcagaccgatcgcgcgcacgcgttcttaaagtttgtggaagagggcggagaaagcttgctgcatcaagcggcgtttgatgcgctgcatgccgagttacatgcacaagatgcgtcggtgtggggctggcctgttttcccagagaaatatcgccgttttgataacagtgcggtacaaaaatttattgaagatcatcaagatgcggtgcacatctacatgtacttacagtggattgccgatactcagatccacgaagtgcaatcattggccgaagaaaaaggtatggcagttggcttataccgcgatctcgccgttggcgtggctgattctggtagtgaaacgtgggccgatcacggtaacttgttgcaagatgtcagcattggtgcaccgccggatgtattggggcctttggggcaaaactggggcttaccgccactcaacccacaggcgcttcaagccacggcgtatgacgcgtacatcaaattgctgcgtgccaacatgaagcactgcggagccttgcgtatcgaccatgtactgggtttgctgcgtttatggtggatcccgaaaggcgaaaacgcgacgaaaggcgcgtacatttactacccagtcaaagatatgttagcgattttggcgcttgaatctcaccgtcaccagtgcagcgtaattggcgaagatctgggaaccgtaccggatgaaatcgtcgagctgctgcgcgatgcgggcgtgcattcgtacaaagtgttcttcttcgaaacgtcgaaagaagatggcggttacgtttctccggcgcattacgcagagcaatccatggcggcactctgtacccatgacatgccaaccctgcgcggtttctggcactgtgatgatcttaaaatgggacgtgaaataggcctctatcccgatgaagagcagctgcaaggcttgtttgacgatcgcctgaaatccaaacagggcattctcgattcagtggcgtggcacggctatttgccggatggcgttggacgtgatgcgactcaggttccgatggattcctacttgagcgaagcactgcaactgcatgtggcggcaggctcttccgcgttactgagcgtgcagttggaagattggttagagatggataagccagtcaatattccgggaactgtcaatgaatacccgaactggcgacgtaagttatcgatgaatctggacgagatttttgcgcgtgaagaagtgaaccgcattgcggcacgtctgaccgaagtgcgcagcaaagccagacaataaggacatcagtgaccaatttcttaactatgaccaaaagaagtttcgggttggtcactctttcctccttgctaagtccggtaagatggatacacgctttgcccgcgccttgcgggctttctgttatacccaaataccttgaagaggcgctaacacgccgatctttaagccggaaggggatattcgctagttaggttaggagttaggtttgaagatcacaaaaaaaccatccaaggttcaacaattttatgatcagttggcgcgtgcagcctttgctgatcccttttcatttctaggcccttacattcccgctgaacaaggtgcgctgcgagtgtggatgccgggtgctgacaacgtcgcgttggtggttgaagggcaagctcgtgtggcgttagagcgtgaaggcgagggcggctttgtgctgaaagatggccgtaatctgcgttttacgcactaccaattggctgtcgattgggcgggtaccgagcagttactcgatgatccgtatcaatatcacggcctctacgctgaatatgaagatctgcatacgccaaagcagatgtatcaccatatgggggcgcagtttgtcaccctagagcgtgatggaaaaatggtctctggcgtacgttttctggtgtatgcccctcacgcggcggcgtgcagtttgattggcgcgtttaaccattgggatggtcgtcgccatccgatgcagcgtctcgattacggtatttggggaatttttatccccggcttgccggaaggcacgcaatacaaatttgagctgaaaggcccacatggagaaggtctgccgcataaagcggatccgtggggtttttatgctgagcaatacccttcttttgcttctgtgacttatgatcatcgtcgttatcagtggcaagatacggcttggcagcagcgccctgtgactgaaaagcgtaaacaagcgctctcgttttatgagctgcacgttggctcatggaagcgaggcgaaaacggtgaattcctcaattatcgtgaattggctgatcaattggtgccttatctggttgagatgggttatacccatgttgagttaatgcctgtcgctgagcacccattttatggttcttggggctatcaaccggttggtctgtttgcgcccactagccgttacggctcgccggatgatttcaaatattttgttgatttgtgccaccaagcggggattggtgtggtgctcgattgggtgcctgcgcacttcccatcagattctcacggtctggccaattttgatggcacgcccttattccatgatccggatccacgtcgcggttggcatcaagactggaactcttacatctacgatcttggtcgcgagcatgtgcgccgtttcttagtcgctaatgcgctgtattggtttgagatgttccatatcgatggcattcgtgttgatgcggtcgcatcgatgctctatctcgattattcgcgtagccatgatcaatggatcccgaatgttgacggtggacgcgaaaactacgatgcgattgctaccttcaaatggatgaacgaggaggtatacaaacacttcccgaatgcgatgacgattgccgaagaatcgacggctttccccggtgtttctgccccgacctttatgggcggcctcgggtttggttttaagtggaacatgggctggatgcacgatagcttgtcgtacatcaaagaggatccggtgcatcgcaaataccaccacaataccctgactttcccgctgatttacgcgtttagtgaaaactatgtgctctctttatcacacgatgaagtggtgtatggtaagcgctcacttatgtacaaaatgccgggtgatgagtggcagcaaaccgccaacttacgcgcctacttgggttatatgtatggtcagccgggcaaaaaactcaactttatgggtaccgaattaggacagactgcggagtgggatcacgatggtcagttgcagtggttcttaacgcaatttgagcgccatgccgggatccagcgtttggtgcgcgatttgaaccatctgtaccaagcccaaacggcgttgcatcagcttgattgcgatccgcgcggcttcgaatggcgcttacaagataatgccgatctcagcgtgatcgctcatgaacggatggatgaagccggtaatcgtgtgttagtgatcaccaacttcacgcctgttccacagcaggaatttcgcttaggcgttcctaaaacagggaagtaccgcttgttgctcaataccgatgccaagcagtacaacggcagtgattatccggtattgcaggatgtgagtacggaagcgatcagcagtgaaggtttggatcaatcgctgctattgagtgtgccgccgctcgcgacgctattttatcaatggagtgcgaagtagctcttcccgtttgtcgttatatacctttcctacttggagcggcaacgccaagtaggaaggctataccttatgaaaaaaaccgctgcggcggtttttttgttgattccctactcatgatcttttacctgcagcgctaagtggtgagtggatctttctgaatacgggatctttgccaaagatctctgcttcctaaactcgtgactttttgcccgccaagcaagatcttgctcagcgttgggcagttttttgctttgctgatggggctatttctataacttattgattttgaatggtgtgaaagttggcatcccacttgctctttgtatcgcgacggtgcgcagagcgcgttaactcattcattgacttaaaaatgatttattgaaaggaaatagccatgccaactccatgttatatctctatcgaaggccaaactcagggtcttatcactgcaggcgcatgtactgctgactctatcggcgattcattcgttgaaggccatgaagatgagatgctggttcagcagtttgaccacgtcgtaaccgtaccgactgacccacaatctggtcagccttccggccaacgtgtgcacaagccattcaaattcactgtggcgctgaacaaagcggttcctctgctgtacaacgcgctctcttcaggtgagaagctgaaaaccgttgagctgaaatggtaccgtacttctatcgaaggcaaacaagaaaacttcttcaccactaagctggaaaacgcgtctatcgttgatatccactgtgaaatgccacactgccaagacccagcaaaatctgactttactcagaatgtgactgtgtctctgtcttaccgcaaaatcacttgggaccacgttaacgcgggcacctcaggctctgatgactggcgtaagccaatcgaagcgtaatttacgctgcgagaatgtcgctcaccttcgggtgggcggctgtgaaccttaaacccagagtatcgtttggcgcggtattgtgggtttaaggttttgccatttttaatgtaggggaaggaaaggcaggatggcgacattagcgtacagcattgaggtggaagggctggaagatgagactctggtggtcagaggctttcacgggcaggagtcactctccaacagtgtttttttagggcaagcctgttacgggtttcgctatcaaatgcaactggcgagtcgggtatccaatctgactgccgaccagatggtcgataagcgtgctgagctcaagctttaccgcaactcacaattggtgcagcgtgtgcacggcattgtacgtgcctttagccaaggcgatatcggccatcaccacaccttctaccaactcactttagtgcctgccttagagcgcttatccctgcgccacaatagccgcattttccaaaagcagactgttccagaaattctctctatcttgctgcaagagatgggcatccacgattacgcttttgcgctcaaacgtgattgcgtgcagcgtgagttttgtgtgcagtaccgtgaaagtgatatcgactttctgcaccgcctcgccgctgaagaaggcttggtgtacagctttgtccatgaagcgggcaaacataccctctatttcagtgatgccagtgacagcctaagtaaactgccggagcccatcccgtacaacgccttagcgggcggcacgatggatacaccgtacatccacggcttaacctatcgcacccaagcggaagtgagcgaagttcagctcaaagattacagcttcaaaaagccggcgtactcgtttttacaaaccgtgcagggtactgagctggattatcagcaaacgcgctaccaacattttgatgcgccggggcgctacaaagacgatgtgaacggcgccgcctttagccaaatccgtttagactacctgcgccgccatgcccacaccgcaacagggcagagcaacgagccgctgctgcgtgccggctataagtttgacctgcaagagcatcttgaccctgcgatgaaccgcgattgggtggtggtctctattaaccatcaaggtgagcagccgcaagcgttacaagaagagggcggcagtggtgcaacgacctacaacaaccagttcagcttaattccagggcatctccactggcgcgccgagccacaacccaaaccgcaagtcgatggtccaatgatagccacggtcgtcggtcctgaaggcgaagaaatcttctgtgatgaacacgggcgggtgaaaatccattttccgtgggaccgctactcgaacggtaacgagcaaagctcctgttgggtacgggtgtcgcaaggttgggcgggcagtcagtatggctttatcgctattccgcgcatcggtcatgaagtgattgtttctttcttaaatggcgacccagaccaaccgattatcactggccgcacctatcatgcgaccaatacgccgccatacactttgccagagcacaaaaccaaaaccgtgctgcgcaccgagacgcaccaaggggaagggtttaacgagctcagttttgaagaccaagcgggcaaagagcaaatctacctgcatgcgcagaaagacttcgatggtttgattgaaaacgaccacaccacggtcattcgccacgaccaacacctgaccgttgaaaacgaccagttcactcagattaagcacaaccaacacctgacggtcgagggggagagtcgtacgctcgtcaaactcgactgcagcagcgaaatcggcggttcattgcagcaaaaaatcggcagcaaagcgatttacgatgcaggcacagaggttcaccttaaagcgggtaacaaactggtcttggaagcaggcaacgagcttaccatcaaagccggcggcagttttattaaagtcgatgctggcggtgtgcacgtcgtcggctctgctattaacctcaactccggcggcagcgcaggcagcggctcaggctatggcggtaaaatggccgagttgccacaaggggtggataaagccaaaacgccgcaagagattgagctagccgcggtaactcccactcagcagtctatgtcgcctttacttaaggcgcgacaaattgaagcactcaaaggtcctgcacctgtgtgtgaagtgtgtgaagaggccaagggaaattaatgcgttcaacaaattcctttgtcgtgcataactgggtgagcttggttccagagatggaaatggatacacaagaaaggctttaccttttggttgatggtgctcaaatcagccatctagcacaagccttgtatcgtctatcgggtgaattggttttggagcctttgtacctttttccgccttttgagcagcttaaagaggtgtctccttatctcgtgttagcaacggatacggttaaaacctggttccttgagcagaatcaggggttagctgggttcttttttgcttctttagattctattgaagagattgctgaacaactgcgtcgtttgatccaagtggagtccccttatggttcaacggtgtttcttaaaatggcgaacagtgaatgcgcgtatgtacttttgagtacccaatgccaaccgctgtggaaagtgatcaatcgagcttggttgccgacacgtcaaggttggcaatatgtgcaacgacccgaactgacggcgactcaagacactcctgtgcgattcaagttaaccgatgagcagtggcaacggcttggcaacatcacatggcttaataccttagaaacggtcgagcggcatgtgcagcagtggttcccggatttagcgcagcagtggcagtctgaccctgaactatttcatcgtcatgctcaatgggcttaccagcagggctttagcagtgagcgagatttaatgctgttttttaatgtgttggggtttttaggtgttgatgctcttgaaaaagggaagtatcccgagattgatcctttgttgcatcaggcttcaagtcgtacgccttcgcaacgcattgaagctgccgcagagctggcttatcaacattcacaatcatcacaggaggtacaaggatgagtaatcccaatcaagctgcgaaaacaggacagaccaatgatgcgcaaaatcccgccagtgcatgtccttttaaacagccgttaatagggataattcctgttcgttacgcctttgatgtttatgatgatcaaggtcaagcattacatcctttacccaaagcggatcgacagtggaaaggtcaattctctatcaagcagcgcagttacactttaaggcaactgcgtgatggctggctctatgtctatgatgaaacagcaaaaacactgcacgaatatgaagtcgttggctgcaagttgaccaaaattgattggtctgatgatgaggcaaacaaacccactcacgagcgcggttcgaaaggtgaaagcaaaagctgtttactctatcccgcccagcacacgctctctatcggttatgcgcatcaacgatggacgtggcgagtgtgtgagcatatgcgctccaataccagcagccgtcatgctgtgatgcgtaaagtgagccttaaacagtttgagtccaatggtactcaccctcatgcacattttgctcagtatcttgaagactatgtggcggacatcgggacgccagctgagcaggatatttttaaagatacctgtaccccttcattaccggtagagaaaagtgaagaagcggtgaaaggtacggaattcaaattcgttgccgacaaagcggtggtaagcagcagtgattatttgcaagatttgccggagcaaaactgcggtttatttgtggcgctgaatgaccctttagcggatgtgtcagatttatttgttacttttactacccaagtggcaaagcgaactaaagcgattggtgatgaaacgcaacagcataaaatgcagatggcagagctgacacgcacattaggccgaattcgtcttgaagaaaaagaaattcccgattttgtaaaacaagatccgatccgtattttagagctagaaagagccattactgaatattgtgctacggcaaaattggccgaaatcgaatctcatcatttagccagtgaagggcattccccatcgggaaactatgccttgatgcagcagcaagcggagcagaaactggcggaattgaaaacactctatcgctttgaacccaccagtgctcagatgcgcaagtggcgcaaaaaagacaacagctttattgatgaagtgcgttgggcggatttagataactttttggtggagcattacaccgagctcaaaggattggatgaacagattaaacaacactatgcgcagtttatgtctgccttcaaccagctcggccttgacccgcttctgtttggtatggataaccaagatgaggttcagcaagcgtatttgttagcattaactagccaatttttagtggtggttacgcaagtcaatcatgatgaaaaatcgcttgagatcctaaaaaaagatctcagttttgattcaccgaaaaacctcatggccctcgcgtcaacaggcttttccctgcaggcaaatcaagccattaacaaccatatccaagggtttagcaccgcttttctctctacaagtaatcctagtgatatggtggcgtttgcgaccgcaatcgctaactgggatacgttcacgggggatgaacgtattcaggagaaagcatggtttaagagatggattgaacccgctcaatcgagttttggtgcactgcaaaaagcggtcgccaatcaagccaaagagagttggcaagcggtgatggagttgctgtttccttatcagaatcagcccaaaggagggacgcccagtttgttggctaaccttcgtttactgttggtggaaagcctagttcgagaagaggcggtgctgcaacataaccccaagtatgcggctgagcttaagcaatttgagactaagctgaatgccattttgcaagagatgaatgatgctctggaactcaaacccggtaatgtgagcccgaaaaaccatcaaattgcgaccgcgcaatccgcacaacgtaagctagggcaattactcagtagtgagctgccgatgatgctgacgctcaaaaaccaagctgcgatgaacacttttcagcagtcggtaaatgagaaactgagcgcgctatcgaaaaacgtcaaaaccagtagcgcgtcggtgagtcagaaactgggtggattagggggcttgctgtttgcgttgaacctatggaataccatgacggttttggagaatatccgctataaggtcgcacaataccccagttggaatccttttaagaacccggcgttgggcgaagccatttatgccactggcaacactattgtagtcgccggtgccattagtgctgggcgagcttgggtgacgattgctgagcaagggttgttagatcgtacactgaaaaacgccttaaataccacgaaagttttgggcacaaaagatgccctaaaaacctttgctaaatcgatcgccttggtggctaccgtgggcatgattgccagcgcattagaaacatgggaaagctggggtaagtttaatgacagcagtaaaaccgatcttgaacgcttcggttatttgttaaaagctggagcaacgggagcacagggaattattttttatattcagtttttcacactcttaggtagtggaattggtggaccctccatagctgcgatttctgcaggttggatgctcgccggttttgctgtgattggtattgtctatttgatcggggtgattttgaccaatgtgtttaaacgctcagagttagaaatttggttatcaaaatcgacgtgggggaaagagagtgctcattggccagtgggcaaagaattgaccgagttagagcaccttctccatcgtccgagtcttcggttgagtcaagttacgcaacgtaaagcagcgcaatggatggattcaggttctttacaatggcagttggaactcacgttacccgattatcttaaggggcagacgataggcttacaaatcacccgtttgccagcgcagccggcatattatcaaccgcaaagggaggcggtaacaccaatactcatcaatgaacaacagggcaaatggagtattgaagataatcagccagtgtatcgtattacactgggtggcagtgagaaggatactgtcggagtttgcgttgcactgcccctgcgttggggcaaggagctgagcctcaaattctatgccagtggaactcgcgcgggggaattggatttacaatctgcagaggcgaatgatattgccacaagaaatctcgttgtaggaaaaggttaaatgttaattgataaaaatgagttagagcagttaaaggtaaaattacacagcagtgaggttatttatcaatgggatagtgtggcttacggagagagaagatctgaaatatttcgcgtttttggggcaatctctgctggtattgttcccctttggccatttattttttttgcagatattcaatttaatagtaaagagttttggggatttatctgctttagtctggcgggcatggctgctgccagatatctttttatgcccgaccaccgttattgctacagtttaacgcaagcggggatttattatacggatcaagaagtgatcccagatgcggcctacacttttgtgcgtggttttgcttgggtggggattgcggtctgtttgttagccttagccgtcgttggcccgttagcgtttgtcggtgcgggcggttttgccctgctggcctttggtttgaccaacttccaccccaccgtacataagaaagaggtttactttgctgaccaattgattgtttttgatcccatcaaagaaaagatggtggatttaaatacagatagcacagatgaaccatggtttgacagacggctattttttagttcacttgatgagaagacgcattttattgagctcgtgaagagtattcataataatgtcgactatcttccgttacagcgagttaacgatcagtacaagcatccaatctttaatcaagaattaaaagaggaatagctcagaactacttacgctcggcgtcgcattgcggcgcttttgtttttctctgatttgcacttacactcatcgcgtcaagccaataagaaataaggatagattatggtcacaacagggtatgccgtcgtgctgtgcggctggttgatttatttagccgtacaagtgattcgtcagcggcgtaaacatcaggtgctgtttgccgatggtggtgtggatgctttagttcgggcgcgcagtgcgcagagtaatgcgacggaatacattcccattttcctaatcctactcggtttagctgaaatgaatggggttaatgtgtggtggattcacgcactcggcgtggccttcgtggtagggcgggtgttacacgctgattcgatgtttaaagccaccattcctaatcgtgtgcgcggtatgcagctcacttttggctgcttagcggtactgatggtgttaaacctatgggtattgccttatagcaagttcttctatccccttcctacttgaagctgcagcggtgttggcttcgctcgttcaccccaatcacatagtttgtctatgctcatggggatgaactcatttgccgcctacctgcaactccaagttgtttggggataagtactatttccggtaaacagtaaagggagccatggctccctttgtggtttcacgtttattgctatcgaaataacaggtgcttaagtggtgtacgttctaagcctttaacgagtagataagtggtgagcaaagtgccaaatagaaccagtgtgtctttttctaatccagcaagccctaaaaatctggcaaggttcatcatcatgatcaccactaacaagtgactgacgtaaaagccgaggatgctttgtgacagtgaaaatccccaaggcttccggcctagatcgggtttagcgagtaggaaaagaaacagcccaatcgcccacaaagtggtgccaaacagataatcattggtgttaaacacctgcccatactgatgtaagccataggcttcgacgaagtgaaaagccattcccagcatcgccaataacaacgcagagcgcgattgccacaggatgtgcctttcacgaatcagataaccgaccacgacaaacaaggtgctgaaaaatgggccgttacgagtatagatgggcgcgctcatgccagtgacgacggcgctgcttcctgcaaattcaccgtagaggtataacccgatggcaatcggtagcatccagtgtgttttttgttggcggatcaacagtgccatgatggcaaccgcaatcatcagtgcgggtaaaaaccaaaggtgtaccagtccgccttcaaacagtgagttaagcgggtgttgcagcaaaaatccccaatagccagagcgttcggcaaggtagccttgattgaccatcacttcgagattgaagggcattaataggctaattacactccaaatcacccatatcctcagtaatggcgagcagtaattacgcaaggtttgcattgggttgtggctgagtttgggttgaattaaatagcctgaaataaggaaaaacagtggcacagcaaagcgggtggattggttaaataaataagctacccacggttcatcatcgaggaaccaataagtggtaaacagttggcaatgcaaagcaataatggccagcatggcgatcactcgcccaagttcaaggctggcgattttctgatggtttgacataacgacactcggcaaaatgaaaaggccgacattacgttaatcaaatggtcattcttttgatttccatcgcctttttttgctgtcaaaaaaggagatcgccaatttgcgatccagtgctcatctgtggtgattagatcacaccaaaactagaaagcaggaaaataccaagcgtacaggtaaagagtgaaaacacggtggtcagggcgataatattggcagccagtgtcgcatttccacccatggctcttgccatcacataactggctgccgcggtgggcgcggaggtcatcaaaaagagtaggccgagatctaagcctcgaaagccaagtagccaagcgccaccggtaatcagtaaaggtgagagaattagcttataaccggttgcaaaccaggcagaatggcgatcgtctttcaacgagttgagattcagcgagccgcccgtacaaagtagggccagtggcaaggtcatattggcaaagtagtggccagcatcagtgacaattttagggatcggtacactggcgagataacatagaaaaccaagcacaatcgagatgattaacgggtttttggtgagtgttttaaacatcaattttcccgcttgccaaccattactttctccgcgtggtgtgagagcaatcaccgcctgaatgttgaacaaaaccgtggtcgaggcgacgtagatagccgcaagggcaacccccgcgttgccataagtgttggctacataagccaatccaataatcgcggtgttggctcgaaagccaccttgcgtgatcactccccaatcatgaggtctgtcgatcagttttcgagtgctaaagagagtgaagagaaaaaacagcatattggcaattaagctgtataccactaaggaagtgcttgaggaaaaatcgtgctttgaactgacgatgctcaaaaaaagcatcgctggaagagtgacctgaaaaacaatccgcgacgcgacttcaataaaattctcattgatcaggttaatccgtttaaaaagcacccccaaaccgagcataaggcagatggggcctgtgatggtggcggaaaactgtagttgagcaatgatgtctgtcatatcaatcccttggatatacgctcgcaagctttgcattcttccacagatcgcggtgaagacaaattggaatttgtggcaattctctgtgagcgatttttgcgcatctagtatccaagtggtaaataagttttaaacgcttgtataactttcctgattgcaaagtgttccaacaatgaatttcaaatcatttcaatatgttaaatttgtaatctcgcttttgataagcttaacaattttgcaatgataattatcttttctgtttaaatctgtgggatcatggcgtcgcctaaaggccctcataaggaaaataataatgaacagaaacgatagtgtccctttgcccaccaatacccgagaatggttccttcatcgtaacagcctgattgttttggcggatgttgcactctttctcgcgctctaccattttctcccctttgaacacaatgtggtgttggggatcagtatgctcgccttcattgcggtgctttggttaaccgaagcgctgcacgtgacggtcaccgtgattcttgtccccgtgatggcagtttttttcggtattttcgaaacccaagcggcgctgaataactttgccaactcgatcattttcctatttttaggtggttttgcactggcagcagccatgcaccatcaaggactggataaagtgattgccgataaagtcctcgcaatggcgcaaggcaaaatgagtgtggcggtgtttatgctgtttggtgtgaccgcgctgctctcgatgtggatcagtaataccgccacagccgccatgatgttgcctctcgtgttgggggtattaagtaaagtcgatgcagataaacaacgcagcacttacgtgtttgttctgttgggcgtcgcttacagcgcaagtattggcggtatcgcgactttggttggtagtcctccgaatgcgattgcggcggctgaggtcggcctctcgtttactgactggatgaagtttggtttaccgacggcgatgatgatgttgccaatggcgattgcaatcctttatttcctgttaaagccgactctcaatggcatgtttgaattggaccgtgccccggtcaattgggacaaaggtaaagtcgttacccttggcatctttggtttaaccgtatttttatggattttcagtagcccaattaacgctgcactgggtggtttcaaaagctttgatacgctggtggcgctaggggcgattttaatgctcagttttgcacgtgttgtgcattggaaagagatccagaaaaccgctgattggggtgtattgctgctgtttggtggtggcctttgtctgagtaacgtgctgaaacagaccggaaccagtgtatttttagccaacgctctgagcgatatggtttcccatatggggatcttcgtggtgattctagtggtggcaacctttgtggtgtttttaactgagtttgcgagtaacaccgctagtgcggctctgctgatccctgtttttgccaccgtagcagaagcgtttggcatgtcacctgtgctcttatcggtattgattgcggttgcggcctcctgcgcctttatgctgccagtggcaaccccgccgaatgctattgtgtttgcctccggtcatatcaagcagagcgagatgatgcgcgttgggctttatctcaatattgcgtgtattggactgctcaccgcgattgcgatgctgttttggcagtaagtcattgtttatagagcgataaaaaacgaggcctttgaggcctcgtttagttttgtattccgctttgcgtagagcaatcagcagaaaaagagtatttattgttgattaacaaaggctttaaagcgagctttggtctcagcatccgctttgttataccaaaagtgcagcatttcttcggctgcagccatggccgtcgcattggaaatctcttgctgggcgataggctgaaccgccattgaactggttaaggccgccacaccccctttcttattatattcagcggtttcaaactcaaagttacgcccaatctgcatgccttctttgataaggcgatcttggcgcaattctacagctttaccttgttgatcaagtagttgccactgcatggttttgatggctttggtcgcctgaggagcatctcgatacttaggcatatcaaaacggagttcttggttggcagcgtcaaaagttgcaatcaccacttcactatcgatgatgatgcgatcattgccttgactgaaataaggcgagtaacgaaagacaatttgctgttcaccatcctctaattctagctttttcgtggcgtcaaaaaagccgcctgagagtttagggctactgccatttacgaccaatagatcaatcgtatctgggatctccatagtgactttggcacttgctgaagcagcaaaacagagggcaagcaaacaagtcagacgctgcataggtttcatttttcaatcctttttgtgtatttcgttctgtgacgagcgctgcaaagggtgcgcttttgatagcgaaaaggcaaggtttgactctcacaaagtgaagcaaattcactgaaacttaacagaaaaatggagttggatgcatttcgtacaatataaggtaaatgtgctgctaattagcaggctgatagcgtaaatcaatccataatgccaatttgttttgtcaaaattctgaattcttgactcaagattgcttaatttctgcaactcctcgcgggtttcggaaaattagcgacttgtgactcgaaaagtgattaattttttttcgcaaacaaaaaagtctctctgatactgacgttcgaggctgtcatggatttcatgcgtagattggcagcttgtgtaaaaagtgaaacatctaaggaagagagagaaaacttatgaatcgaatgactttgtgcgccgcaagtatcgcttgtgctttagcgagtaccgcgatggcagcaccctcggctcctagtgttgacgtgtatgggtcgaacaatctgcaattttcgaaaattgaactcgcgatggaaaccaccgcaggttacaaccaaatggttaaataccatgaggaagcaccgatcacgctcaagttcaaccaatggagcggtgtgacgggcaacacttataaaatctattttgatggggttgaagttgccaccggtccaatcagtggtagccaaactaccgcccagtttacttatcctaagggtggcgtttatcaattggtgattgaagcgtgtgatgccactggttgtactaagagtgcaccaagcgaaatcactattgcggataccgatggttcacacctcaagccattgaaaatgaacgttgaccctaacaataagtcttacaccatcccacaaaatacggtgattgggacttattttgttgagtggagtatttatgatcgtaagtttacggtggataacatcccagggcagaacctaacgcatattttgtatggttttattccgatctgtggtccaaacgaatcgttgaaatcggttggcggtaacagttttaacgctctgcaaactgcgtgtaaaggtgtgccagattttgaagtggtcattcacgatccatgggctgcttatcaaaagagtttccctcaagcgggtcatcagtacagttcaccgatcaaaggtaactacgccatgttgatggcgctgaaaaaaacctatcctgatctgaaaatcatcccatcgatcggtggctggacactctctgatcccttcttcagctttaccgataaagcgaagcgcgatgtgtttgtcgcttctgtgaaacgtttcctgaaaacatggaaattctacgatggcgtggatattgactgggaatacccgggcggcggcggtcaagcggctgatcttggcgatccggtaaaagatggcccagcttacgtagccttgatggcagaactgcgcgctatgcttgatgagcttgaagcggaaacgggtcgtaaatatgaactgacgtcggctatcggtgttggtcatgacaagattgaagatgtgaactatggccaagccgttcagtacatggattatatcttcgcaatgacttatgacttctacggcggctggaataacgtactgggccaccaaacggcgctgtactgtggttcatttatgcgccctggccaatgtgacggtaaaggcgtggatgaaaatggcgagccgtacaaaggcccagcttacacgaccgataacggtattcaactgctgctcgcccaaggtgttccaccgagcaagctggtagtgggtgcggctatgtatggccgtggttgggaaggtgtgacgccggcttcactgaaagatcctaacgacccaatgaccggcgttggtaatggcaagttgaaaggcacgacagcacaaggtgtttgggaagcgggtgtcattgactataaaggcgttaaaaacttcatgctgggtgccaataaaactggcgtgaatggttttgaatatggctacgatgagcaagcggaagcaccttgggtttggaaccgtactacaggtcagctcgtcacttttgatgatgatcgctctgtgaaagcaaaaggggcttacgtacgtaaccttggcttagcgggtctgttctcatgggaaatcgatgcagacaatggtgacatcctgaatgcaatgcatgaaggtttagcgggtggcacaacgacaccgccagtaaacaaagcaccggttgcgaatgctggagcggacatcacggttacggggccagccgccgtatctttggatggcagcgcttcaaaagacagtgatggaagtattgcaagttacttgtgggagcaaaccgcaggtcctgctgtgaccttgactggggcaaacagtgctaaagcgagttttaacgctgcagaagtgactgagaagcagacgtttactttcaaactgaccgtgacagacaacaaaggtgctacggcaaccgatactgtggtggtcaccgtcaatccgaagtccaccacacctgtgaacacggcacctgttgcggcactttctgctcctgcatcagtcaaagccggagcaacagtggtggtcgatgcttccgcgtcgagtgatgctgaccaagatccgttgagctttacttgggatctacctgttggtgtcaatgcaacggtacaaggagcaaaagtgacctttgtggcaggagagtatacgcaagacaccacattggatttcacggtaacggtgagtgatgggaaagccacgagtaaagcttcagcctccgtattggttgagaaaaaggcaggaacaggtggtgatgcttgtaccaacttgtggaatgccgaaagcatctacactggcggtcagcaagtgacttgggcaggaaaaacgtgggaagccaaatggtggacccgcggtgaagacccaagcaaatcaggtcagtggggggtatggaaagacctcggtgccgcgagttgttctactcattaatcggctgcatctgagctggcctcagacgtaacgattctcaacagataagagaggctctgcacaggcagagcctctttctattggtgtattctcgccatacattcgtcgtaaagggaatggccattctcttggtggataagggacgacctcttccccaaaatacaaacagcggcaaagcaaaagaggcgtcgctgcgttaaacaggctttgtttttggactgagtcagccttatttttctggttaatttgcccaatttctctctcattctcactcattgggaatgcaatcctttaattcttctctatttctcgatatacaagaatcaagatttgaggtgcccaccattaaaggctaaaaagcacacatgaacgaaacaaagatttcagcaaaccaagttaatgaaaaatcactgcaattgctgatgcaagtcgcagtaaacccagaacctgtctctgcgaaaggactcagtgaacaactgcaagtaccgctcagtagcctatatcgacatttgaagctgctgaaagaatggaacttgattgaagagagtccgcacgacaaaaccttgatcatcggtccagcggcattgctgctgatgagaagttacgaaaccagccaacataacctcgatgcggttgaagctgtgttaagtcgtctacaaaaacagactggggaaatggccgcgtatatggtgcctgtcggttatcgagccctatgcgttagccaaagagaaagtatgcaggcgcttcgatgcagcttcgtccagggtcaaagtcaaccactgcttcgaggtgcctcatctaaagtaatgttggcgtacatgcctgctgctcgttgtgaaaagatcctgcgctattttggcgaagatccgacgttagacaagtggcagagcgagtttgaaaaaatacgtcgtcatggatatgccgtgagtacctctgaaattgatcccggtgtttcggggatcagtgctccggtgatgaaagggagtaagttgattggtgcaatttcggtgatggctccagcccaccgagtcgaaagcaacaagcaacggataattttacatgtattgcaagccgcacgggcgttgccaccagaaaggtaattgatcatgcttagcttattcaaacgctaccgtttacatcgtacatccagtcatccaacgtctacgtttggctttatgaccgtgtgtcagcgcgtaaagccgatgtcgctggtagagtttgagtttgcgcagcaaagcttggatgtcgcttcagattggttgtatcagcagcaatctacgccgaaatacgccgatgccagtcattatgtgttggatggccaaactcaggctaaataccaacaagccttgaatcaatccgtggcgttgggagttattcctgttgcttttgctaactgccatgaaattctcttgcacagtttgcctgcgttaacgcaagacggtgccagtgtaggaatggtgcatatcggacatggctttgaacttaagcaaacactggatctgcaagtgggcagcgcttttcactttgctttatcgcgctttgcacaagctaagctgttttgtattgggattgatacagagcacacccacgcccagaccttagagtatgccgaggatctggggtgcgattgggtcagtcatgaagagtgcggttttttaaatcgcactcaactcaaagcccaactgagtggttatatcgaacactgtgagcagttggtgatcaatattgaccttgcttctttagtccctggaaacggtttggaaacccataaggttctggacaatcaagtggtattacgtgtcctgcgacaaatgatactgtctggcaaagttcgttacatccagttggttggcgcaaaagataagctaatttactcaaagcaggccaaagaaattgtcgatgaactgatgaatttggctccacacttggtgcatgcagcatagcgctttcttcttggcgtgattgatgcgttcaaccgaatcatagagtgtatctaagttcatagggatgaactcacttcccgcctaccagtaaccccaagtcgttggtttataacactcatcttaatgtgaaagttgcttgaggttactgcgggtctggcttgcggagcggagtagctctttactgtgctcacttatcgttgcgctatccgttaatagttcacgggcatggttgtccaacaaacgcagttgctcgagcagttgttcaactaaacgattctgctgctcgctatcatgcactgcattttggttggtgctattggcttgattaacatcgataatcgctttatcgaccaaatttgaaccgctttcaatcgccgctacgcaatttctcgccgctaccaagctctcttccatgtagccaatcaggtttcttgagtaacccgagagctgagttaatagcgtttcaacttgattggttgaagcggacgttttttcagccaagtggcgcacctcatcggctacgacggcaaaaccgcggccattttctcctgctctggctgcctcaatggcggcattcagtgccaaaaggttggtttgctcggcgatactgcggatcatttgtaagatatcggtcactttttcgacttgtgtattcaattctgtcgcggtttttgtggtgatttctgctttttcgaccagttgttgattttgggtttgcgcctcgcggagctgagctttgctgtcttcactgctggtgacagcctgttttaaagactcggaggcggcataaatactctctgtcaccgctttgatgctgtcttggctttgatgaccgatagcgactgaattggaaatttcactctgttgattatgtatgttgtgctctaaacgaccaatttgttgctcaactttgtggctgacatccgtgacttccacgattcggtctttgataggtgcaaaggtgctttccacttttgcgataaaatcatcaatggcattagccagttgaccgagctcattgtccttacgaaagttgattcgtgagcttaggtcacaactaccgcttgccagagcatgacaaagcacctttaaatcatttaaaggtgcgatcaatgtacgttgtaatagccagtaaatggctattaaggtcactaagagaaagccaatactgagcataaacgcttgattgcgtaattgtgatgcgacttgttgaacttgatcgaacccccattctgtaacgagatagccgactaaatctgcatttttcccagctttgagcggcacgataattaggagcccttcatggccatcggtatttttgcgaacagcttgatcggacggtggttgagttacccattgattcaggctggtggccgtatcgctagtatttttggcgttatacagcacttgccccttggcgttgaaggtatacacatttttgagttgaactggatttgcgttgagttcaatggccacccgctccgaaattgcgctggttttattaaaacgaacggcagtcgcaatattatcagccagagaaagtgacgttttctcgaaagtttcagcactgatggtgttcatctcttttacgcttttcgtccaagtcaaataagtcagggacaacagcgcaagggtgcaaagaatagaaacactcagcaaaagaatacgactaatgcttaacttcataagctcacctaaccaatgtgtatgagtcttatcccttatcgagttgaagtcgcagtgagattgtctgctacttcaagcttgggatttcggtggagtattacaatgcgtcaacattaatgccgactgtgatagcaccaatagcttcgcctgaactgggatctaccacggtataactcacttgagcttgaaatacctgtgtggattcatcctcttcaatgtcactgatatcaaatgctccaacgccttttgagtaggtgttttgccatttggcttcatcaccctgccaatagtcagaggtgacttcgctctgcgcaacattcaggcctttattatccattacaaatacttcggtaatcttgccgttactggcgttttgaatctccatcagcttttgtgaggctggcgtattcaatacggactggatcattggggtgtcactttgacccacctcagcacgccactgtttatccaattggtcaatttcactttgtgtgaggttagcatttttcgcattttgtagttttattgcttcgataatcagcggatcggcagagatttgctttaattcagtttgaacgtattgagtgagctcggcttggtagtcgttggccataaccggaaggctagcaagaatgaagagtgccagagatttgtgcataaaaactccttatctacttgatgcatagtgccaagtagggtggtggtattaaaaaaggttctctacctctacatgacatgaatcggccgtggaatacacgtttctcgtcgtattaaagtgatcccgtgcagagcactgctctcacttgccaccggccagtaaactcaagtcgtttcggtatccaaccagttgattaaagagcgacagctagagaaaaagtagtacaagttattagagtgtgcctagtgagatagttaaaaagttgcataactctttagtctcgttctttgtattgtcatgttttagcaacagaaatttcaccgagcagtcatcttgggcagctactcttgcgcaacatctaattaacctgaatgctcaggatataaacataaagtcaaggagcccccaatgtggaagcgtgatgagcaagaatcccagtttagtgaaatgattgaagcgcaactgtctagacgccattttttggcgggcagtgcggcagtgagtgccggcgcgtttttagccttaaatccggttgcgagtgcggtggctgcgcctgccacatcaaacctactgaatttctcagcaatccctgtgtcaacagaagataaagtgattgtgcctaaaggctataaagccactccactcatgtcttggggcgatcctatttttgcgaatgcgccagaatttgaccaaagcggcaagcaagactcaaaagcacaagagaagcagtttggcgataatacggatggcatgagctttttcccgatcagcgaagatcgcggtgtgctcgcgatcaacaatgaatacaccaattacgagtatctgtttgatcatcaaggtaaagcgatgacggcggatgacgtacgtaaagcgcaagcggcagtcggtgtcaccattgttgaagtggtacgtaaaaatggtcagtggatggtagaccgtcaaggtgaacgtaatcgtcggatcaccgcttatacaccaatgatgatgaccggtcctgctgcaggccatgatctgctgaaaacggctgaagatcctagcggattaaaagtgctgggtactttcaataactgtgcgaatggtgaaactccttggggcacttacctcacttgtgaagaaaacttcgatgatttctttggtgcggaccaagaaggcagtgtcgatgctgatcagaagcgttacggaattgctgctgaacctagtgattaccaatggcataagcacgatgcgcgtttcgacataaccaagaaccctaaagagccaaaccgctttggttgggttgtggaaattgatccacataatccgaactctacaccactgaaacgtaccgctcttggtcgttttaaacatgaaaatgcggcactggtgattaataatgatggccatgtggtggtttatcttggtgatgatgaacgcggcgaacatctgtataaattcgtttccaagcatcgctatcaagccggtaatgatcagcaaaaccgtaatctgctggaagagggcaccttgtatgtcgctaagttcgatatcaatgaaaacgaactgaaaggcagcggacgctggatggagctgagctttggcaagaatggcctcactcctgaaaacggatttaaagatcaagccgaagtgctgatttttgctcgtcgtgcggcgacccaagtgggcgcaacgaccatggatcgaccagaatgggtggccgtgcatcctgataaaaagcatgtgttctgtacgctcaccaacaacaaaaaccgtggcaaagaaggtcaacctgttggtggcccgaatccacgcgagaagaataactacgggcagatcgttcgttggatgccagcacagggtgatcacaccagtgatgtgttcgcttgggacctctacttaattgcaggtaatccaaccgttcacaaaggcaccctgtacgcaggtagcgaaaacatttcggctgacaatatgtttaacagccctgatgggattggttttgacactgcaggtcgcttgtggatccaaaccgatggtaactactctaaccaaggtgattttgctgggcaggggaataaccaaatgctgtgtggtgacccaatcacaggtgaagtgaaacgcttcttaacaggtcctattgcgtgtgagatcacgggattaaccttcagccctgatcacaaaaccatgtttgttggtgttcagcatccgggtgaagaggctgctccatcgcatttcccttacggtggtacaagcaaacctcgttcaaccatcatgatgatcacccgtgaagacggcggtgtcatcggcgcataaagcgttatcaattgcccttttcatcccaagaagaaccagcctcttcttgggatgtttttttaggccgccatcatatgtgtggctaactcctttccattgccgcgtacccgatcaatggtggattggaaggcagcagaaatgctgagtaaacgcgagtcaggatggtcagcaaggtagatcgatttctctttgctttccgtgagcttgtcccaactgaagttaatatcgcgggcaaagtgaatcgccaccgccagtttgggggagatttcggcttcacggggttcatcaaaatgtttaatggcatcaaccatttccgaagggaatttccactcttttgccaacatcgcaccaatgcgaggcgctgaaatacctaagacctcttcttgagcgctgagcggatccatgccttgggcgattttctgttggatcagtgaggcctcggtgggcatcaaagtatgaatcatgagttcgccaatgttatgcagcacgcctgtggtaaacgtttctgacttatccaaaccgacttgttcggcaatcttgctggcaattaacgctgtttcaaaggtattggtccagtaatcattcagatcgagagtctcaatttttggaaaagtactggagaggacggaagcaacaacaagagtacgaaccgactcaatgccgactcggatgatggcatcgtttacggtagcgatatgtccgttaccaccaaaataagcagaattagccatgcggagcaaacgcgccgtcaggatttgatccagcgtgatttttttgctgagctgatgaaaatccacatcaggctgattggccatatccagcaattcttgcagaactttagacagtcttggtagctcatttaaacggttgagcattgtgtttttcaccatgttcattctccttatctggtgactaatccaaactataggcaaagctttttctactatccaacctaggcatgaaaaatttagttacattattgttatataggggttaataaatttagtggcaaaccgaaggggaaaatgaacgtttttttccagcaaattgacacgatattggcattaccggacagaggttttctacaatgcgcatactgtgttcgggtggagtatggttatgaaagcacgcatcatgagctgcaaacgtgccttgattttactgctgacgtttgtccttctattaattcctttaaccctgttgtcgctgcagctggattttacgcaacctgtaagtgattcagttggccgtgtcatgacgtacttaacgcattctgcaggcaaagagggctttctattcacattgttttttttggtgtgctgggttgggtggcgttgccacattcctcgtcatcaatggctgaataaatccattcaattaatgctgttacttggcttggccatggtgctaaaaatggggatgaaagcggttactcaagagccgaggccatacactgaactgatgacccaatccttactgctgcctaatgctggccatttctataagttagcgcaacccaagcaagaagccttaatgttggcgatggaagagaaagtgagcccttggcgggtgatgcactggcaaggggaaacggatttttctttcccatctgggcacacggtgtttgccatggtctgtttgctctattttggtagcttattagcggaaaaaaagcactatctcagtctcggtgcgctgctgatttgggtgagcggagtggcgtatagtcgattgtggcttggtatgcaccatccggtggatctgcttggtgcggctttgctggtcggcgtattgtacttattggttccgcagcaatatccattgcaacacccacgttttaagccgtggttacgacgttggcatctggtataaaaaatgggcatttgatgcccatttttggttttcacaatcattaagcggaaagtttaagcgcgcttttcatgctctgcttggcatacggctgccgtgaagagtacgtcggtcgagctgttcagggctgtttcggctgagtcttgaatcacgccgataatgaaacctaccgcaacaacctgcatcgcgatgtcattggaaatcccaaacaaaccacacgcgagtggaataaggagcaatgaaccgcccgctactccagaagcaccacaagccgagaccgctgcaaccacactgagaagtagtgctgtcatcagatccacttcaatacccatggtgtgtaccgcagcaagagtcagtactgtgatagtaattgctgcgcctgccatgttgatagtcgctcccagtgggatagagactgagtaagtatcttcatcgagtttgagtttttcacacagtgccatgttgaccggaatattggcagcacttgaacgcgtgaaaaatgcagtaaccccactttcacgtaggcattgtaaaaccagagggaaagggttacggcgaattttgtagtagacaatcattgggttgacgaccagagcgataaaggccattgcgccaagtagaaccgccagcaactgcgcataaccagcaagtgcatcaaagcctgtggtggcaaacgttgaagccactaagccaaaaataccgaagggtgcgagacgaatgataaaacgcacgatttgggagatgccgtggctaaggtcttcaaataccgctttggtggtcgatgaagaatggtgcagtgccaaacctaaacccacgccccaagctaaaatgccgatgtagttcgcattcatcaaagcgctgactgggttatcgaccagcttgaacaacaaggtgttgagtacttcggcaatgccttgtggcggtgttgcgccttcagcgccggttgcaagtacgagcgtggtcggaaataggaaacttaaaataactgcggtcagtgctgctgaaaaggtgccaaataggtacaacacaacgattggacgcatgtaggtgtgttggtttttcttctggttggcgattgaagatgccaccaaaataaacaccagcactggagcaacggctttcagtgcgcctacgaataaattaccaattaatcccactttttgagcgtattctggtgaaaaagtagccatcgctgcacctaataggatgccggctaaaatttgtaagaccagatttccacgcaccaaacgggctagaaacgagttgttctgcatagttatccctgcgaatcataaaaaatttgaattattgtagcttcagtcattaatcctgaagggctccaatattaaccgcacaagataatgtgtctaccgataattgatatttgccgtgataagttgtgtattttgagaggaagtaagtaatttgttgcttaacgttgataatgcagagattccttatcgtttttgtcgtctgggtataacaagggcaacaaaaagggtgaatccatcacccttaatttttgagatattcacttcctacttgaagcgacaaaactttggactgcaatcaggtctaaggtttgttgttgagcgagataggcgtccaagaggcttagtgtgagctgtgttcagccataccggacatcacttttttcaccggtgccgtaatcatttgcttctcaccgtttttaaacgtgatttctacttcgatgttctcaccctcttgcagtggctttttcaattcaagcaacatgatgtgaaaactgcccggtttgagcactaaagtcccttgagcggggatcacaaactcaggaacttggcgcattttcatcacatcgccttctttaatgacgtcatgcagctccactttggcagccacttcgctgctggcggaaacaatgtagcgctccacatcactgtggttcatgacttcaccaaaaaaggcgctattgactgcggcaggaggagtcgcgcgcgcataagcttggtgaaccatgatgtctgattgagctaaagctgatgtgctaagcagtaggctagaaagaagcaaggtattcagtttcattaaattatcctttttattgaatgactttctttatggcatccacgatgggtgtggggtcttgggtatgcggcactttattgatcaaggtgccatccggctgcaagaaatagaaataagagctgtgatctaaggtgtatttcagctccgaattgggtaattcggttttacgaaaaatcacaccgtacttttgcgcaatctggttggtggttgcaacggagccagacaaaccttcgatcattggatgaaagtagtgggcgtattgtgcggcgagtttggcatcatctcgctccggatcaagggagataaacatagggcgtaactgcgctttcgttttatcatcgacttggtttaaggctgcggagagcatagctaaagaggttgggcagacatctggacaacgtgtaaagccaaaatagacaattcgaattcgtgggtcggcttgatcgaaaatggcgacagcttgctgattgtctcccgataaggtcagtggggtagtcacctgtgcggctaatttctgttggctatccaaataggctttgatactaaatcctagggtaaacgccaccactaatatcaatgaccaattcttactcatcgttccatcctaattgctgggtaaaccgtctgtttgccatcgctaagctcaccaatccaagtcatcgcatccgaagtacaaacgggcagaataatgtcggcactgtataggccatcaccgttggaggataaagaaaacttggcactgcccatattcatctcaagcccctctaaagtgaggatcaaattttgtgcatccgtattgggccagtgtacggtgagccgattggcaactaatgggtgggctttatcttgagctagggtcatggtgacacccgcttgctcacagctttgctgtgatagttgacagtaatcgttaagatcaggttgaggcgactggaaccaagcaacaaggtcgctggcaaaaaagccagccccaagagccagcaggatcgcaatccctttcagtgcgttcatcacatcgtattccgaagttgcgtgagtggggaagatgttagcatgctctctatccgtttcgagattgaatactgaggaaatgtgccgtggctcttagaaaaatcaaggcgatattgtctttctacttgcagaaaccgcagtactcgtgaggaaacttcaccaccgcattgtgcggtggtgagccagtatcaaagcggttggctacttttcggcgtatttttctaaaccgagaactaaagcgaccgcggctagcatgagcaccagcgctaacaaccactgagatggctgtgacgtaagcgtttcaaattcaaacggtgataggttgcgttgcagcagtggtacttgctctccgctggaattgacccgccaagagagcgtttctttccatggccaaattttaggcagagtgccgagcatcaatccggttaggaaggtcagagtcacatcgcggtaacggcgtaaaagccatgacagaatatgcgaaaaactgagcaatccaatcacacatccggttaagaaaatcagcagaatgtccagttggaaggttttcactgcgcccaaaacaggcgcatacataccgatcagcagtaagatgaagctgccggaaatgccaggcaggatcatggcacaaatcgcaatcgcaccagaaatcagcacattgatgtaagtgggctcaaggtgtagtggtttaagcacggtaatgccgtaggcgaaaatggctccggcaatcagccacaggagacgagaaagctttttttgttcgatttggcgcagcatatgccataccgacaccaaaatcaggccgaagaagaatgaccaaataggaataggatgcgtgactaatagccaagagataagtttggctaaggttgcgatgctggtaaaaatgccaccgaatagcgtgatcaaaaaaaggccgttgatgtgacgaaatactcctgccaagccttgcgctttccataccttgagtaagctaggattgatgcggcgaatgctttcaagcagagtatcgtaaatgccagtaataaaggcgatggtgccgcccgatacacccggtaccacatcagcggcgcccatagccagaccttttaaataggtgctcaagtagttcattgtttttcctgccaattgaataaggccgtcattatacctgttctttgttaacttgcagccagacgcgatgtgtctcccgcatgctcaacaataaggttcatattcatattgcgttttgttgcaaattgcaatttgcaaattgcaacaaatgatgagatgagtgagaattttctgacaaagtatcacaaaaatcaggggttaattagttggcacgcttcgtgcattagtttaggtgacccttgttaagccgagggtcacctagccaactgacgttgttagtgaatagtattgttcacatcatatataagccaatcgcggttcttgcgattggctatttttttgtcttttgggtatgatcgcccgctattttcactgcttttttgttgataattagcattaaatggaaatttgtccgtgcaatatcattgctttatgtggccttgtggccgtttattagaggataactatcgctgatgttgtgttctggtgtcacctaacgggtcaagacacccgcttatcaaggagagatgagcctgaataataaagaggtactatgaatcagatcatttcaattggagcattagagtcttttcttattgctatcagtgtcctgtttttaggtcactttattaatgccaaactgcccattttaaccaagttcaacattccagagccgattgtgggtgggcttatcgtcgcctgtgtgattactgcgttgcactttcacggtattgatatggaattttcactgccgctgcaaaatgtcttcatgttgatgttctttagtacggtgggccttgcggccaactacacccaactgattaagggtggcgcgaaggtgtttctgtttttagccgtggcttcggtgttcatcattattcaaaacggtgtgggcgtttcgcttgcagcaggtttaggcttagatcctttactgggcttgatcgcaggctccatcacactctctggaggccatggcacgggagcggcttgggcaaacacgtttgccgaaaattatggccttgccaatacgttagaaatcgcgatggcatctgccacttttggtttgatcatcggtgggattatcggtagtccagtcgcgcagaaactggttgataaacatggtattgaatctgagtatgggcgcggcacacaaacccactctcgttttcctgaactggtcacttataacgaatatgaagaagataaagtcaccgccaaaaaggtgattgaaatcttgtttatcttgctcatatgcgttaccggagcaaaatacctagaagcttgggttaaaacctttgaaattcgttggttgatgatccccgatttcgtttacgccctgtttattggtgtctttatcaccaatctgctcgaagtcactaagctgcgtaaggtggatgcggagacggtggatattttaggcacggtttctttgtcgctgtttctcgctatggctctgatgagcctgaaattgtggaatatcttcgatttagcactaccgtttttggtgatcctcgctattcaatcggtcgtgctgggcgtcttttgctacttcgtcaccttcaaagtgatgggggctaattatgatgcagcggtgatttcggctgggcattgtggttttggtttgggggcaacgcctaccgcggtgatgaatatgggatcggtcgtaaaacgctttggcccttcaccacaagcgtttatggtggtgccgatcgtcggtgctttctttatcgacatcgttaacctaatcatcttgcaggggtacatttcatttttgggataataccgagctagccctccacttcacgcacaagaccccgagccgcgatgatcgtggctcggggtttttaatcccaatttgttacgcctttttctcggcattaagagtcagtttggtgccgttaaacttaagctgtgcgagcaagtttttggcgttatttcgcccctcttcattgaactctaaaccataacgagcatggtgcagtgagcgctgtaagttacagatttttccggtcaaaggcgggaaggtttttgtgcccctcaagtctgaaaaaatctctaacgcgaccaaatccccgacttggtacgttttgcctaaaggcggcgtgatgaaacggcaaccactgcgtgataaatcgcgcagttcacaatccccacgatgctcatcaaacagtactttgccggctaaatttagctcaaatctcggctctttacgtaattgagagacttgcatggtattgggaatggagagaaaagccatgggaaccggctcttgtaagatgtgcatcagttggctgcggaaatggatcagcgctccttcaccgcgtggtgaaatcgcgcgaatattcatccaaaacccttcttggaagaaatattgcagatcatcagccgatattttgggcatttccaccagtaaaaacttatccgtatgagtaccaataaacggagtgcggcagacgaattttgttccgacaggggtcgtaatgcttaaagtcagctcactactgtgttcaaccatggccagcgcatccgtgctgttgatggtcgacaccgttttactgcgtggagtctctgtttggccatcattattatcaattttttcagcgggccgtgaattcatttaacttctccgtgttgcgatacgacgtcgatggggtcgtagagtccattgaattctatggtgagataagtgtagattcaattcagcgagtcaccaactaatttgatctatctatcagaaaaggagtaagcatggcaaatacagtgcaacatgatgccaataaccactgttatcgcgtggctttggaaggggaatatcaagccgtagtgaaatatcagcagcagggaacggtgctgcatattacctcaacccgtgtaccggatgagctgcaaggtaagggatacggcaaagtgatgatggaaagtgtgttgcctgaaattgaacgtgcgggtttaacgattgtgcccgtctgtagttatgtcgcacattatcttgagcgtcatcctgagtggcagcatttgcgtcatcgtccctagtgaaagggtcatgctatacccaaacaacttggagttgcaggtaggcggcaagtgagtgaatcctcatgagcataggcaaactatgtgattggggtgaacgagcgtagccaacaccgctgcagcttcaagtaggaagggtataaagagcatcgctggctttaaatgatttagacgtcctagtcatattgaggtagcttattgttgaaactcaacatattgataaggaaaggcgatgcatttgccgcattttgctctgagctcagtgctctcgctaacgttgtgtgcgataccgaatcttggttttgcaagctccaaccagactgaagattccacgcaggctcggccgacttggttgagggatattgcgttgtcccccgatggtcaaaagatagcgtttacttatgcaggtcaaatttggctggtgccggctcaaggcggtgatgccgtggcgctcaccgaaagcggtgtgtacagcgaaacgccgatttggtcacctgacagccaatcgatcgcttttacggctgatcgatatggtcttggtgatgtttttattctctcgatccaaggtggtgagagtcggcgcttgacctaccacggagcgaaagatattccgtatgcgttttcggctgatggtcagcagctctatttctcttctcgccgactgggcgatgataaagccaatgcgaacgttaaacagggcagctttatggctcagctttactcggtgcctgcagcgggaggacgtgagcaacgcgttttacctattgccatcagtgatttagccatatcgccttcccatagtgacatcctgtataccaatcaaccctctgatgaacagccgtggcgtaaaggtgcgctatccgatgctacacgtgacatttggcaatggtccccgctcacgggcaaacatacccaaatcaccacttttcgtggcgaagaccgcaaccctgtgtggagtgcagatggctcctctatgtactatctgtctgaacaagcgggcagtttcaacgtctggcagcagcgatttgatggttcagaacccgtacaaatcaccgaccaccaaaagctgcctgttcgtttcttaagtgccagcttacaaggcgatttggcctacggttttgatggcgaaatttggcgactgaaagccggagctaagcaagcagaaaaagtgccggtctccattcgtcgcagcgcgatgcctgatggccgtcataatgtgaattttaaccttgaagccacggaaatggtggtcgcgccgaatgccgctgaagtggcgattgtggcacgtggcgatgtgtatgtggtctctttgctttccggtttaacgcaacgaatcaccgatacaccagaagcggagcgcgatgtttccttttccagtgatgggtatcgtttgatctacgcttctgagcgtgagggcagttggaatctttatcaaagttatgtgaatgatggtgggaaaagcttctcctcctcattggatattatcgaagagccggtgctgacgacggagcaagatgtcattcagccactctattctcctaatcttaaacggattgtttatcgcgagaatcgtaatacgctcaaagtgtatgacatcgaacaagataaaacctataccttgctggatgctcatgccctctactcgtatttcgacaaagatctgagttaccagtggtcgccagatagtgagtatatcgtcactcgcgatcgggcgatgtcgaatggcgacattcagctacttaaatttgatggaagtgaagcgcctatcaatttgagccaaagtggtttttctgagtttgccccacaatttagtgccgatggacagtgggtttactggctaaccgatgcgaaaggtttgcgcgatattgatgatatggtggtgcagtatgatgtgtacggtgttgcgctcaatcgcgaagccaaattcaatttcaataaaacccaagagcagttgtggcttgaagaggaaatcgctgcggagaaaaaccttgggcctggccaaaacccaccagcagagttaacggtggtggaaaataaagggcttaagcagcgcactatgcgtatgactcctacctcactcaatattattttcaagcacttaacgcacgataaccaagcactgatcatcgcttatcagttgggagactcagtacaaatttcagaaatcaatctgcgcagtggggagatgacggcgctgtttaaccgcttgagtgaagatgcggctttacttgcgatggcttctgatgatgcgagccttctaatcatgggggagcacggtatcgagaatctgaatgtcttgacgggtgagagcaagtttgttcgttatgaagccaaggctaatttcgattttcgtgcagaaatcgcctacttgtttgatcatgtctggcgacttactcaaaccaaattttatgacccgcaaatgcatggtgtagattggcaacagtacggtgatttgtatcgtaaacatctgccgagcatccgtacctacagcgattttgccgagttactgagtgaaatggtcggggatttgaatgtctcccatacaggagccttctttatggctggtaactccagttgggaggagcccgcatccttagggctttactatgatgatcgttaccgaggtaagggcgtgcgtgtgaaatcactgctacccggaggccctgcagatacttatcaatctccgatcaaggcaggagcgattatttactccgtaaacgggaaagaaattagcgatcaacaggatatttatccgttcctgaattttacccaaggtaaattaactcgtttaagtgtgctggtaccgggggaggagaaagcgcagaactttacgttagtgccgatcactcttgaagaggaaagtgagctgctttatgagcagtgggttgaacagcgccgagccttagtggagacgctctccgatggacgccttggctatgtgcatcttgccgcgatggatgctgccagttttgagcagatgcaaaatgacatgtttggccttgaaaaagacaaactcggcttagtggtcgacgtgcgttttaatgctggaggttggctgcatgatcaagtgatggagatattgtctggaacgcgacattcagtcatgcagacacgtgatggttatgtagtctcctctttccctgaacgtcgctgggcgaaaccgagcattatgctcgccaacgcagacagttattcagacggttcgatcgtaccgtatttctatcaaaaagaagggctaggaaagctagtgggcgaaagggttcccggtactggcacggcagtgatttgggagcagcaacaagagcccggattgatttacggagtgccgcaactcggtatcaaggatgagcaaggtcgttggtttgaaaaccaagaaatcatcccagatattttggtttataacgatccggaatcggttgtcgccggcgaggatcgccagttggctgccgccgtagaagccctgctgctcgagatctcttcaaaataaacagtaagccgacaaagccaacaaaaaagccgctcgattgagcggctttggcgatgactctatccccttcctacttgaagctgcagcggtgttggctacgttcgttccccccaatcacagtgtgtatctatgctcatggggatgaacgctctgccgcctacctgcaactccaagtcgtttgggtatacaggcgatcagtgatcgaggtagaggtagttctgccaacttttcatgcggataagtacttttcgcatgatagaaacatgttcaaagctgtcagagtacaccgcgacttcaaccgcggaacccataggcagatggtactgcgataaatcatcagtaatgcgcagcgttacaaaaacgcgtccagaggttctgagcgcgtctgtcccaagtaaagcaccacgggcttggatttggctttctccgatcgcgggtagcacttcaatcacctctcctttaaataccttacctggcagtgcgcggaacataaattcagcggcaaatcccggttgtagacgttgtagagagttttggcggaaagccgcagtgtagattttctcttccgtatgcacaaaagtcatgacaggagccagaggcaaagggacagacatcatgcccggacgcaaagccaactgagtaacatagccatccgttggggcacgcacgatggtttgctccaaatcgaattccgctttacgcagttccgctaagagctgagcgaccgtggtattttcaccaccgacttccgaatctaaagcgatttgggcttgctcttgttttgactgtgcaacctccaaggcggcttgcgcggctttgtaagtttggcgagtggtatccatttgctgttcagtaaatgcgccacgttgataaccacgttgataacgatcatattcacgttgcgctttgtctcgctctgcgatggctttgagtacagccgcttgcgcctcttttaaagtagactctaaccccaaggccccttgactcgcttctttgactttggcttttaagcgagcaacgtcagcctcgaaggggataggatcaatacggaacagaacatcaccttgtgtcagtggctggtttggtttcacaggaacttccaccacccgtcctcgtactccagacacaatcggagtagtcgaatagacttggcttcccaactgagtaaaagggtggttgtagttcatcagcaagatcagggttccaatcagtatcacgccgccgagcactgcggtgggcactgtccacttattgagtggaattttgaaaaccttaaaaactgcaacacacagggcggtgtaagtcaggatcagcagtaaatccattattgcttctcctctgatgttgatgccgcaggggtagatttaggtactgagagagaagaagtttttaacgtctctagttcggtacgcaattgttttacttcatcaatcaaaacgtcgactcgatggtgaatatcatgttgctcggcttccaatttctgaaatccccagccacgttctttgcgccataatgttgcccaaatccacaaaaatggccaaagggcgtgcaaagtgaataaacttacccagcctgcataatgaatggcatcttggtgtgggtgttcgcgttctttggcaatttcgtaagggatgtcgtggataacaataattccgtagaaaatcactagggcgacgaagatcagcaacccgagtgcaaaataatcaagaaacatgaaatagtcctttagaggaagttaagcacaatggccaagtggccagaaaccactagacaccaatccataatagaagttcgatcacccgtcatataatattcagacgcgatcacatcgtacaaatgctgctcagcctactcaacacacacttggttacggccattggctttggcgcgatacaaagctttgtcagcgcggtagaacgtacgttgggtattttccccctcgcgatgcaaggtgataccgatactgaccgtcagtccccgttcgccaagtacgtcttgccatgggaaatcaaaaatacgttggcgataggtttcggcatgcatttgtgccatatcactggtgacgttttccaaaatcaccagaaattcctcgccaccgaaacgtacgcaggaggcaccacggaatttaaagtaactcgccagttcactggatacattgacaatcgctttatcccctaccaaatgactcaattcatcattgatcgatttaaagtggtcaatatcaacgactaagaaagcaaacggggtttcgtgcagcagcagatctttcagcttcacgtccaaccaacggcggttatgcagttttgtcagtggatcggtgaacacatcttgctgtagttgcaacaccgtattcttctggctttcggtggtttcttttagctcacgattttctaattccgacaaaatcagtttaagttgtagctcaaagcgcgataggcggcgtagctgaattgggcctaattcactgatggggatccgcttcatcaaatcgctttcgatgcgaaatgctttcttttcgtaaaccagtgcggttttgtacattccttcgagttcacacacttcgctgaacgcttcatagaggcgtttttcaaggaaaggggaatgaatgttttgtaagcgcttttcagtgctacccagcagcatggtggcaaaatgcgccttacctgctttagagaggcaatgcgctaactcgatgcgtagcatgcttgatagccaatccgatggcgtcagcgatgacgaatactgtgcattggcgagtgtcatcatcgccttttgcactttgccttgttgcagataaagcttggcttgatagagcatgatctgcccagtcagcagtttatcgctgaccagaatgctcaactcatcacactcttttatcagatcattggccgctgcataacgaccaaggctgatgtagcaagccagcatatacagcttgtaacgcaggcgcagtgagcggctagaaatcgcatgatctatgctgtcaattttttggtagtagcgtaacgcacggctgtgatcgccataagcatcacataaattgcccattccgagcactgcaagtacgtagtcatcaatcatgccatgctcaacggcgatgttggatatcgcaacgtattcagacagtgccgcgacatattcaccatggtcgagtaaacgctcactcaaactgtgtttgaccgagagcattaattccagatccgtcggtaactctaatagggaaagagcggcgcgcagctcttcaatactggtttgccactgtttcatttcgcggcggtattcggcgctgatgatgtagctttgtgcacgctcttgggcggtggttgccacgtgctgtctgacatggttccagaaaatgatcgcctcttcaccagcgacagcggccgcatccagtcccgcttctttgatcttattgagcagggtttccatacgacttttcctgtgcttggctaccaatcaactgttccagcgtaaacgggaaggacagaatatcttgcagcatgattttggggagtggtccatctaatcccttacggtgccaaggataaatttcaatcattttggccatcacttggaatatttcgagcgcagcatcacctttttcggccagcaatagccccaagcggtcgctgctgatccgtgacagtaaatcttgcggagcgcagagtgagtgaatcacttcggtgcacacatcaatgtatttggcgttgggatgctggatgacgacaacggcatgattggattttttcagctcggttttgaacagtaccaattgttcccaccaataggtttccgataccacgttggagagatgtttttctgggtcaaactcgtgttgaccacgaattcggttgatcagtttgcgcgctcgctgctcaagttggcgtttcgatgagcgggctttgtccatgcccacgcgcagagtttgttctcgcagcatcatcaccgtgtagcgacggtattttttaaacgcggttaaggccgcctgagggtcgccattttcttctgcaacgcgggattgttgataacagatctgcgaaagaagctcgccgttatcgaatgaactggccgctttttccgcactgctgagtagctcggcagccaccgagaaatttttacgcagcagttctagacgagcgcggctgataaacgagtgtgctttcatccaagtgagattattttcaaccgccagttcatgggctttgcgagtggcttcttcagcatcttcaagccgctctaagccaagcagagccagcccacggaagtcccacacttcggcttgccatgtcacattgctgttgttttgcagcacctcttcagcgccatcgagtacggtcagcatatccacgtactgattgagatggtacagatcccatgcccacaaaattcgcgctttgccttccagccaatcaatgcgggtgttattggcaactttgacggccagttcgtgggtggaacatgcgagtttgtattcgcccgtgatccgccagatgttaccaaggccaatcaggcactcaatctcaatctctggttcatccacgagtgcggattgctctaaggcattaatccaaaattgttgggcggtgtagtatttggcttgtccccaatgatgtaaggcatggatatgcagaatctcaggcaggaaatggtccgtctcaagattgagctgattttggtaagcctctttgatgtacttaaaccctgtgcgatagtccattttgcaccagaggcagcgggacataatgatcaaagattcgataatcgctgaggtaaagtgaatttgccaagctcggattaagcactgttccgcttggacgaataccttctcaggctcagattcgatgcgtgatctgagctgctctatttctagttcaagaagatattggcttttgtccaaaatacagtcgtccttaggcgatttcatgctcgacatggcttacccattatagggagaagacgccattaaacacgatttcatgtgaaaaaacggacacttttatcaagtcattcgataataattagtgttatctcacactcttcctctaagcaatttaggacaaaagttcctttaatgttagaggatgctgcgataaacctaggttttgtgccgcagtaaatccatgtttatcttggtagcataaattgtgccatgcacggaatatgtccagcagaggctggatcccgcccggccgtagtttacgacgtggctcattgatgaaggactcgaacaagagctggaatcgattctgatagtattcgatttgtcttatggaggcgtgctgtaaccagtgttgtgggtcagggttgctgcccgctaaataacaaatccctttggctttggtgcctgaatgagcgatagcccaacgatcacgccaccaccccatgtgcacaatatcggttttctccaatgggctttgtgcctgccaatccggatcttcctctacgtacataaggtcaacattttgacatcggattcgggacaagctgacgcttaacgccgcagaacgtaatagaggatcttgcggcatgaagattgaaactcgtttgcctgggtcgcacatatccagcacatgcagataatgggcgtaggaggtgtaaggcggccggatcactgcgccttttgaggggtagtgaaactgtgccaagttgcccatcggatcttcgacgttggcacgcgccaaaatcagttggtagcggttatcaatccgttcccgtaacaaggttaacgctttatggggtgtggcctgcgcttctgcggcataaccttgcggcacaaaacgtgctggcgtttggtaaggatcgtggtctaggctacccgtcggctgttcatcggcagagtagttaagatgttggcacagaatgtaacccgtttgcgcatcaccggtagcaatccagtaaacgccattatggctgtgtgcctgcaagggttggtaatgcgaggcaaattgatacgctttggcatggtttacccagcgtgcatcaatcattgccaatttgcgacgacaacggctggcgatatggtcgagatggtcgtaaaaggttttcggattgattgacagcttgcggcaaatttcgcgcacggaataacctgtaaacagtaacccgagcagagattcttggaagttgagcttatgattggcacctgaccatttatccacaaacgtcgagtggcaggttttgcaacgataacgctggcgatcgccactgtaaccaaaggcgtgataaagctgtttgtgagtatggacggataatcccgtgttcgggcatgccggattatggcaagccggtaggccatcactgtgcaattggcgtaagcggtgcagttcgttcaccacatcgcggttattaagtaagggggggaaagctccacattcacgacaaaccatcgctggccgttttgggtttacgcgttgcaaaacgtaatgttttgcttcactcaatccaaagttgtcacacgccaatgttttacaaaagttgagttgtaaaccttctgcgtccggtggtagttggtcgttaggcacgatctccccctcggggtactcgagaccgtcaggctgagtggcctgacggtaataacaagatagattagatgttgatggcagtttcaagcgcaactttcatcatgtcattaaatgacttttgacgatcttctgagctgagtttttcgccacgtagaatgtgatccgataccgtcagaatcgtcagagcgcgtgcgccgagatcagccgctacaccgtagatacccgccgcttccatatccacacctaaaatgccgagttttttcatcttttcgaaaatctcaggctcaggggtgtagaacagatcggcagaaaatacgttacccacttttactggcacttgctgagcacgagcttggttaaccgccgtttccagcaagtcgtagtcggcgatggccgcaaaatcatggccgctgaagcggatgcggttcacttttgagtcagttgatgcacccataccgatcaccacgtccatcagtttgacgtcatcacgtactgcaccacagctgccgatacgaatgatgtttttcacaccatattctgcaatcaattcatgtacataaatgctgcaagaagggatgcccatgccatgacccatcacagagacttttttgcctttgtatgtgcctgtaaagccaaacatactacgtacatcgcacacttgcttgacgtcttccaagaaggtttctgcaatgtatttcgcacgtagtggatcgcccggcatcaatacggtttcagcaaaatcaccaggttgagcgttaatgtgtggggttgccatggttactctccaattcaatttcgccaacagacaaagatactaattacggatcctgttggctcaaggcttatctgttgtgccaatactagccagtatccacaaggctacttgagagaagtgtcacaaaatactctcttttaaaatcgaaataggctattgataacgaaatctgttgaaactgataaggcaaacgttgagctaatcgtttggttggtggggttggaaaattctgtacaaaaaaaatatttgtacagtacaaaatcacgtgctatagatcttgtacagaaattttcattgtatagataagtgttggagactcgtatgcagaccacgccactcaaaattgggatcagtgcttgtctacttggagcaaaagtacgcttcgatggcgggcataaaattagccacttcgtgaccaatgagctcgatcgttacgcggagtttgtttctgtttgtccagaaatgggaatggggctacctgttccgcgtcccacattacgacttatctcggaaaatgaacggattgccttggtggaaaccaaagatagctcgcgtgatcacaccgcagcgttagagagttactcacagcagaaagttgctgagttacaacatgctgagttgtgtggatacatcgtctgcgcaaaatcacccagttgtggtatggagcgtgtcaaagtctacaagcacaatggcaccgaaaaagacggcgttggcgtctatacccgaattttgatggaaaaaatgccgtggctaccgattgaagaagatggtcgattgaatgatccggtcttgcgggaaaattacatcacccgagttttctgtttgcatgatttttacaccagcatgggcgatgcgccgagcgcgaaaaaaatcgtcgaatttcactctcgctacaaattaaccctgatggcacataacccacaggcgtatcgcgtgttagggcgcttagtggcgaatgtgaaacagtatccactggattcttttatccaagagtaccgcttaggtttgatgcaagctctggctcaccgtgctagccgcaaaaataacacgaatgtgctgatgcatttgcaaggttatttcaagcgctcgctgaacaaattacaaaaagccgaactggctcaagtgatcgagagctatcgggtgggtgagctgccactgttagcgcccatcacgctactcaaacattatctcgctctgtttcctgatgcttatctcgctcagcagcgctacctaaacccttatcctcaggagttgaaactacgttatggtttgtgatgaaaaacgttacgcgataagagaagtcgcggaaatcactggggttaaaccggtcaccttacgtgcgtggcaacgtcggtataatctggtgcaacccgatcgtaccgagaaagggcatcgcctgtttactgatcaggatattgagatgatccgtcagatccagagttggttggcgaaaggggtcgcgattgggaaagtgggcgcgttactacaaagtggggtgtctgagagtgagtctatcccgcaacccgtgggtcagctcgaagagtgcgaaacacttcttacggcgctggcagcgctacaacgttccaaagcggagcagattattgcgaccgtgcttaaagagtatccgctcagcgtgatgcaagcacagtttgtacaaccagtcacagaagcccttgagcgagtgaaaggccctttgcgttcactacagattggcctgtttcgcacgctcatgctcagcaagttagcttttattcttgatgccgaaaacaaagcggcggtgaaaggcaaatgcttatgcattagtttggatgaagctggatcgctgaatgcttggttatgggctctggcgtgggctgaaaatggtcaccaagtgacgctgttggaagccgtcgatgatattcgtggtttgctagagaatccgggattagcgcaataccagattctggctctgcacgcccatcgagcactacctgcggctcaacagtcagctttagcgagcctccaacagcagtttggcgagcagtgtgtactatcgaatgtgctacaacagctacaatcttagggaattggtatgagactggtttggtttcgtcgtgatctgcgcagctttgataatacagcgctcaccgccgcgttaaacagtggcgatccggttgcggcgatgtatatcgctactccagagcagtggcatcagcaccatctagcgcctattcaagccgatttgatttggcgacgtttggcagagttgcaacaagagcttgctgcgcttaacgtgccacttttttatcagcaagtcgcggattttcaagcggcggctgtggcggttagccagttggcgaaaacacttaatgccacacaagttctcgccaatcgtgattacgaattggacgagcagcaacgtgatcaattggcacagcaattactgagcgaacaagggataatatggtctgcttttgatgataaatgcgtattacctcccggttcggtgcgcacgaaacagggcgaattttttaaagtgttcacccctttcaagcgcgcatggctcactctatttcagccgcctgtgattggaaaaaatcgtcccgtagcgctttggaacgtaccgagtgcgttggccgaattggtttggcatccagaacaagcattcgattaccccagaatagacagcacgccatgggctgcggactttgagactgtgcgcgctcaattgcgtgatttttgccgtgaacgagtgcaggactaccatcaagcgcgtgattttccggctagggaaggcaccagttcgctctcaccctacttggcgattggtgtgttatcggcgcgtcaatgcgtggctcgcttgtatcacgagtcatcaatgggcgaactcagtgaaggggcacaagtctggttgagcgaactcatctggcgtgagttttaccagcatttggttgcaattgagcctaatctttcgaaaagtcgtgactttgtggagtggggggcgcgtttggagtggtggaatgataacgaaaagttccagctctggtgtgaaggcaagacagggtatccgatcgtcgatgcggcaatgcgccaactgaaccaaaccggatggatgcacaatcggttacggatgatcgtggcgagctttcttaccaaagatctacacatcgactggcgctggggagagcgctatttcatgagtcgcctgattgatggtgattatgcggccaacaatggtggttggcagtggtgtgcatccactgggtgtgatggacagccctattttcggatttttaatccggtcagtcagggggagaaatttgacccgaatggcgacttcatccgccgttgggtgccggagctgcgttcagtttcttcggcttatattcaccaaccttggacttatccggctgtcaatagcgtgttatatcctgcgcgactagttgatcataagcaggaaagagaagtaaccttacgtctgtataaaacagcgaagggataaccaaaaagatgtggtggaaagtttgggtaatcggttgtgcattggcggtcagttggagtatcaatgccgccgtgtttgatctacctatcgaaggcagtagcatagtcggtaacacgcaatatcataaagttgagaaaggcgagactttagccgacattgcaaaaaaatacgatattggcttcctagcattaatggctgccaatcgtggagtcgaccctttcttaccccaagaaggttttgtcatctctatccctgcaaagatcattttgccgaaagtggcctatgaaggcattgtgattaaccttgctgagttacgcctttactatttccgtcctaatgaaggtaaagtgcatatcttccccgtcggcattgggcgtatcggccgcgatacgcctgtgatgcaaacgtcaatcagcagcaagcgcaagtacccaacttggacgccgccagcatcgattcgcaaagaatacaaagctaaagggattgatttgccgccagtcgtgcccgcaggcccagaaaacccgctcggtgattacgcgatgcgtttggcttatggttctggagaatatctgattcatggaaccaacaaagattttggcgtaggcatgagggtgagtgctggttgcattcgtatggatccgaaagacattgagtggctttaccaacaagttgaacgtggagaaaaagttcggattatcaacgaaccgatcaaagttgcgcttgaacctgatcgtagtgtgtttattgaagtgcatgagccgcttacccgcagcaatggcgtgaagaaaaacttggtggtaccagaagagctgagttggtggctgcaagagcataaaatctctgatgcaaaagcgcgcgccgcagttttagcacaaaatggggttccggtcgaaattgctccaccacagtgggaaactatcgcccagtaacctcgttattttggttaccgttcgtggtatgagagaaaaaaagagccagcaaatgctggctctttcaatttatatcactcaaagattacttagtgtaagactgagcaatattgtcgatacgttcgttagcgcgtgcagcttcttcttgagcggctttcgctgcttcagcagcttgatccacttttgatgccagtgcagcaacttgcgaattcagttcgctgacctgagtgctgatttcgttcatttttgcagtggtagcttcatcaggaccagaggcgcaacccgctagtagaagtacggaagacgctgctgctgcgattaacatcttgttcatagagaactccttaacttggtaagtcggtgttattgacgtcctatacttatcgaaaattaaaatatggacggaattattgtagtcgcaatttcgcgcaaaactagccctcaaaagctaaaaaaatccaagattttgacaacgaatcaattaattgtccgacatcttaattattagattatgaataatgcgttttctattcgataaaccgatatcccctttctacttgaagtcgcaacgatattggctaagttcgttcgctccaatcacagagtttgtctatgctcatgggggatgatgagagccatccttggctctcagcaaaggccagccgatggatgtgcaaattttttccagacaaatttgtcactcacttgctgcctacctgcaacaccaagtagtttgggtatacccatacttgccttatggattttgggattattttgtcggtcagctatctatggtgcgtcgatttgcgctatcataatggcctttttcgtgatctgctttacagttttaagcacaaccaaagatggagagtactttgcaattcaaagatttaggcttagataatcgcttattgaaaaatctagcgcattacaatttcaaacaagcgactgagatccaacaacaggcgataccgctcactattgcgggacgtgatttgttggcctcatctaagacaggttcgggcaaaacgttggcattcgtgctgcctatgctgcataaatctttaaaaaccaaagccttttcagctaaagatccacgtggcttgattttggttccaacccgtgagttggcaaagcaggtgtatggtgagctgcgctccatgttgggtggtttaagttatacggcaaccttgatcacgggtggtgaaaactttaatgaccaagtgaaagcgttagcgcgtggacctcgctttattgtcgcgacacccggacgtttagccgatcatcttgaccaccgttcactctttttggaaggcctagaaacgctagtgctggatgaagcggatcgtatgttggatttaggctttgccaaagagctgcgccgtatccataacgcggcaaagcaccgtcgtcgccaaaccttgatgttctctgccacattagatcatgctgatgtgaatgatatggcgatggagctgcttaatgaaccgaaacgtatcgcgatcggggtgggtagcgaagagcacaaagacattactcagcatttctacttgtgtgaccatctagatcacaaggaagcgctgcttgatcgtattttggccgatgctgagtaccgtcaagtgatcatctttacagcaacgcgtgccgataccgatcgcctgactgagaagctcaatcaaaacaacctcaaagcagttgcgctcagtggtaacctcaatcaaacgcagcgtaacaccatcatggggcaatttgagcgtgcggtatttaagattcttgtgacgacggatgttgcttcacgtggccttgatattcccgcggtgactcacgtgatcaactttgatatgccaaagcataccgaagagtatgttcaccgtgttggtcgtactggtcgtgccggaaataaaggggatgccatgtctcttgttgggccaaaggactgggagagttttaagcgagtggaagcttttttacagcaagagatccaatttgaggttttagctggtttagaaggtaagtttaaagggttgaaaccgcgtcaagcgaagcctaaagccgcgccaactcagcgggtcaacaaagcgaaagcgccaagcaaatcgaaaaaagcggcgccgcgtgacaagagcttctaccaaaatgtggcggtgggtgactcggtctttatcccgaaaaagaaagtcgcgcctaagccagaagtggatctggaagacgacatcgactaagccatgctgtacaacttagcgtgcaactgctgattttcaatcaagaaaccgtctgtgaagggcggtttttttatgcccaataaatggggtttcgtggtgtatatcaaggaatagaatttttgctctaaaataacacaaatgataattgatcttatttagatttgtgttagagtggcgaccgatttttatttgttatagttgtcacattttcgatgaaactgctcaatgtattgctgttaacgacatctctgtcggttttttatacttatgcagagacggattatcaatggttacgcgatgactcgcgttcggaacctgcggtgaagcagtttttggctgagcataatcgaaaaaccgatcattggtttgcacctgccaagccactggtgcaagagttggtcaatgaatggcaacaaacttcacagcataaagcgcctccgcctgcgcttatctacgcaaaccagcagtacaacgacattcaatggaatggtcatcggcacatcgtcaagataggtgcacaaggccaaattgagccgctgctgaatcttagcgcgcgtgcagagccgtttgattattaccaattggcttcttggtcacttgatcgctcagtccaatcggtagcgttggcagaagatacgcggggtgacgagcagtttaagctgacgatcgtgcgtttagccgatcgcaccgagcagatcgtttcagaaacagcgagcacttactttgcttgggcggccgatggcaaaagcctctactacttatctgatctcaacgggtctacccaactgcagcgttttgagctagaaacgggtcaatcaacgaggcttgcagagtggcgttcggcagagtggctgttctcgctctattctgccagcaatccacgctatctcgtggtacagcaaaataatgaaaactcgactcagcagcgcttgctggatacccaaaccggtgagctgatgccatggctacgcacgactgagccggggctggaatattatgccgatgtgctgggtgagaccctttacatcaatagtaaccatcagggggcatttcgtctctatcgtcagccgttacacactaaacaggactggcaaagcgtcactacacataaagaaatcggctcactgagcaacttttatctgtttgatgctgggattgtgttggtggagaaccaaactctggcaccgaaagtttgggttctcgatagccaaggcgaagtgcgtactcactttgaactgcgcgatttaggtcaagtggcgtggatctctcgcaatggtgatgctgtcagtaatcggctgcgtgtacgtaccatgtcaatgacggagcctgctagctggcatgagttggatgtggcgcagttacagtggcaacagttaagccaagatcactacgcagactttgacccgaaacagtatcaaacccaaacggtatgggtgacgcaaggtgccatccaagttccggtgacactggcttaccgctctgacaagctgactcccaacagcagtgtggtgctgtatggctatggcgcttatggcgtgacgatgaagccctatttcatgccacaaatagtcagcttgcttgatcgaggcatgatttacgcgatcgctcatgttcgtggtggtggataccttggcgaggcttggcatcaagctggcgctggactcaataaacaaaacggcattgatgatttcctcgcagccgctcgatatctcacccattttcagcaaggtgagcgcgccatttatacgatcggcggaagtgccggcggcaccttggttgctgcggcgctcaatcagcagcccaacctatttgctggagcggtgctgcaagtgccgtttgtcgatgtgttagccagtatgagtgataccagtcaagccttgacggcgcagcagtatcaagaatggggtaatcctcaacagccagagcagcgtcaagtgatgcaagcttatgatccactcagcaatctacgtgctgctccttaccctccgacgttggttaatgtcggttggtgggacaatcgagtgccctattgggaaggggctcgctatttggcacgtttgagtgatgtctcacaaggggctggtccttaccttttatcaaccgattttcaggcgggtcacgccagtgatcggcgtcaagcgcttgaaaagcaggcgcgtgaatatgcgttctttctcaccttagataaaaccagaaaagcggggcagtaatgaagctttctccagtatcagctgcggtacttagcgtactcgcggcagggttcgctcatgccgaaactgagcctagccactacgaagaagtggtggtgacggccaatcgcattgagcagcctttgtcagaagtggcgggctcagtggcagtgcttgaaggggaaacccttgaaaagcaaggcaagaccgagttgtacgatgcattgaatcaagagccgggtgtcagcgtgactggcggagcgggacgcccacaaaatattacgattcgtggcatgaccggcaaccggatagcgattgttcgtgatggcattcaaagtgcggatggttatggcgctgcagatattaacgacaagtatggccgtaacacatttagcctgagcaatgtgaaacagatccaagtggtgaagggcgcgagttcaaccctatacggttctggtgcgattggtggcgtcgtgatcatcgaaagtaaagcgccggaagattatttgtaccaccgtgattattacgtggatgccgcattgacctactcaggcatcagcaaccgctaccaaggtaaccacgcgttagccatgcgtcacggtgatggcgaggcgctgctcacgatcgactactggcaaggtgaagagacacgtaactttaatcaagatctgtataaccgcgaagtggatggttacaaccttgggttctcccatcattattggttaaacgatgcgctgcgtttaaaaacgcacttagagtattttgatgattatgccaagcgtcgcgaaggcacctcttctatccaaaaagatgacaagtgggatctggtcagcttttacgagtatcaacgcagccaaacgcgtctggccagcgttggtgccgattacacggctaatctaagttggatggatacgctggaaggaaaattctactggcgcagtacagaaaacatcacacagacgaaccgtttgatggcgaatgatcggtctggcgctggcatcctctcctatcgtcgtgaactgcgtgatgaagggttcaatgatgaggcgttaggagccacgctcaatgcgcaaaaagagtggcaacaaggtgagtggctgcatcagtttgcttacggtatgagcgttgatggtcatgattaccagcgtccgaaatcgattcgacggatggaatcttcaggtgacgatttacaagccgatgagccgtttgctcctgcgcgtgagtaccgttttggcgtctacggacaagacaatctcctcttaggcgattggacgctggctgcgggtttgcgttttgatgcgcaaaaattgagccctaaaaataccgatcgtattcatggctacaaagtggtgaccatggggagcagtgagtggtcacccagtgcctcaatctcttatcaatggcatccagaatggaatacttacctgagctacaaccacggcttccgtgcgccaagttatgacaaagcgtatggcgcaagcgatcacagttttgtcccgctaacgccatttattatcaagcccaacaataagttacgcgctgaaaccagcgacagtttcgagttgggcagcaaatacgacaatggtcagacgcaattttacgtggccgtgttttattccatcttcgataactttattgatgtcaaacaagtcggttatgacaacgccacagggtcggtgattcagcagtaccaaaatatcgcgggcgtcaaaacctacggggctgaaatgtcggtaatgcatcgtctagatgatcgttggagtgtcgaaaataagctcggatacgtggatggtaaagatggtgaaaaccaatacgtgcgcaccttaaccccactagaagggagtgtgcagctcaactaccaaagagagcgatgggacgcttacagccgcctgaactgggcgagtgccatgagccgagtgccgacttgcaccacagagcaaggcaaagaaactgaatgtgccacgaccacaggttgggtgagttgggacatcggcctcaactaccaatggaacgcacagctgagtgccagtttcaacgtggttaacctgctcgatcgagaatacacgcgctatcaagatgtcgctggtgtgacgccaagtgacaccctctattccacggagccgggacgctatttcaccgtgcacgctaagtatgtgttctaggaatttaagatgaaatcaacgttgaccttaattatagccagtctattagcccctttagcctcagcggcgcagtgggattatccggccaccagcgataaagtgctgaacgaggcgcaggcactggcgtttgtcgaaaagtactatccacaagtgggccagccagcactgcattatcgcaaaaccagcctgcttggtacccattacaattttgacttgacccaaaatggtgaagtgcaggcacaaaaaacggtggttatctctaccgataagcagggcaatgtcactcgagtgtttaaaagcctcaatgataccgtgctggttaacggcgtgccgagtgtcgccgctgaattggttgccccacagcgtttaaccgctcttcaaccgcctgaattaacgacggggagcccgattaacgttgacgtttcgatttttgaccctgacttgcgcaccatggatgggttggcggcccctgcgacgccttgggcaacaatagaggattatcccaaccctgcgcagtatgtacgaaccgaagtgtcattgttgcaatcgggtggccgctattatcttgctaacgagcgggtaaagatggtcgatgcacaagccatcttagaaaaagaagcaaatagcagtacctatgttgagagtggtgtttcccttgcacctgctgatagcgtcatcatgagctggagttcgatcgctgagttacaagccgtaaaaatggaagatgacggttttaaacagatcatggcgtttgcgcatctggataattcgctacgctatttgaattcgctcggttatgacctgttcaataaagccgatggctcaggcatcgaaccagtactgtttgatgccgccgcgctctcaaccaacaactcctcatactatgtgggccctaatgtcattttatttggtgaaggcgtctctcacgatgcgctggatgccgatatcatctggcatgaacttggtcatgctattcactaccacatggttccggactgggcgtacggccatactggcgcgttaggcgaagggtttggcgactattgggcgggagcgcacagctaccgtaaccagtatgaacaaggcaaagcgtttgaaattgacaccctgttcaactgggatggttattttggaaccacaatttccactcgcagtttggctaacctcgcggcgcgttattactctgcaggggattatcgtgcccatgagcgtgaagcgggtcatttaggtgatgaactctggtcgacccctttgtttcaaagcttgaagcaggcggttgagcaatatggggtcagcgcctttgatgagttcaacactgtagtgttggagtccatgtttggcgtagggcgtggggtattgatgcacgaccttgcacaaaacatgctgtatgtggccaacgcactgtatccagataaagactataagctgatcttacagcgcaatttgcagcatcacggtttgctgcaagcaccgttccaagcggcgtttgctaaaaagtaccttgacccgctcgcaactcaaaacctttacgtcaacgcgacagagcgctcggcaacgacgcaagccacggtggtgatggctgggcaaactcatacttttagccaagacaatctggctaatgtggtgtggcgattgcctgcaccaaccgattaccaatgtggtgtagcgacctcggttaaggtcgattttaactaccagtatgcccacttcttaggccagcaaacttggcaggcggagttacctgtcgtgtttggtcttcctaagatggcacaaacctttacgaccttgaactcaaccttgcgtgatgcgcagttgagcagtgatggcaaactcgcttcaggttttaaaagctacaacttctttgtggaaggcgccgcacgcatcgtgggcgatgattttgcgctgcgcgtgaaacttagccacagcaatatgcaggatttgcgtatcaccttgatttccccacaaggtacccgagttgagatcctcaataaccaaaccacgccggttgcgcagctggatgactattgggtattagcgcatcaaaaggcgctgcaagtgctacgcggtgaacggttagatggcaattggcgcttggagatcctcgataatgtcgtgggcaatgtgggtactttacatttatggggagtcggtgaagtgacccactacacctgtgataaagaagtcaaagatcaaacaagcacgaccaatagtgaagaagacgtcgcggcgggcagtggttctctcactttaggcttgctgcttctgctgagcgctttctctcgtcgtcgttgggctaacaaggggactcaatcatgaaatatcactactctttgatcagtatggcgctactgatggctggttgtggcggtgaagatgctgtgctggagacgagtctgcctgaatacgttttatcgggctcgttgagcgcgcaaaacgtcgcactgaacagcaaaatctgcttagaccgtaaccaaaacttcacttgtgatagcggcgaatttaccacccaagcggacagcaatggtcgttttacgctaagaagcttggataaatcactctattcattgcctattttggctgaagtgagccgtgccagtgctgcgcgctcggcagacaatgattcagccaatattgtgcttgccgctccggggttaaaccgagcgggggatcgactcatcaacggtgtgagcaccctgtttgcggcgttaatggtggctggttacaccgaagccgacgcaattaaactctttctcgcccagctcgaacagcgtggcatctccgctccccgggatctgcagacgctatttacgcaaaattcattagcccagcttgaagccaatatgctggagattttgccactcatcgccacagaaaagcgcacgcaagtgctagccgccttggcgcaaacctttggcgatgaacatcctggcatagtccacaacgctttgagtgaggtgcagcttacggagtacgtgacacagttggcgaaacgcgttcctcgccaagtgccgctaaacgatactgggctggtcactttttatgaagaagggggtgttgtcggttatatccccaacagtgattatccagagcaggatgccgagtatggtcgtgatgctctatcgggcaagtcagccttcacgatgcgcaaactcgatgcggcgggtaacccactgagcgacagcgcaagtgagtggtcttgtgtacgcgatgaagtaaccggattggtgtgggaagtgaaaagtgcagatacgacctcgcttaatcacaaagaacgcctgtttgcccttgagatccctgggcgttttagtccttatgctgaggatgtggaagaagccacctgccatagtgctggtgatgaagtctgtacgacggcgcaatacattacacatctaaaccaaactgcgcgttgtgggatccgtcattggcgattaccaaccagcctagagttgttcaacctgtttgattttggcgagactggcgaagaggcgcaggcattgagcgtgagctattttccgcagcagagccagaacgaagattactctggccatacttggacttctgccgtgagttatatgaattattcgttattaatggctaatggctcccactcctacagatttattagtcacttaggcttagctaagggtgaagtcagcgtgatcgaaatctatgaccagaataaagaagcggattcgggtagctccttgctgcttccagtgcgtatggttgccaacccagtggagaatcaagaatgaaaaccctctcgactatggccactctgttggcgttgagcttaccggtaatggcgcaagagtgtgcaagtgatattatgcgcaccgcacccaacttacgttatgtgtacagcacccaaggaacagtaaaagacctgcacacagggttaacgtggatgcgctgcacctttggcaaagagtggaatgctgagcaaggacgttgtacaggacaggcgcaacctctgcgctggcaagcggcactgcaagaagtgcaagcgatcaatcacccgggtagccgtcaccgtttacaccagtttgcgggtgttaaacagtggcgcatgccaaacatcaaagagctaagcagtttgaccgaacaagcctgctttgcgccagcggcgaatgagacggcgtttgcctctggcttagtgaccgaggtgggcaactatgccgcttatttatggagtaataccacgcgtattgagcgtgaagaagcttggacgtgggatgccattaacggcgagatttatgcgtactcgattcacgctcatgaaatggggttgctccttgtggcggatgagtaataggcatgcttatttctgctgtccccatcttgcttgaagggcagtggtgttagctctaaaaataagcggcacgaaaaagacaaaggtctggcttagccagaccttttttatgtcataaagagcaccgagtcatttacacgcgaaaatactggagctgctggtgttgctgctcggcaaggtcggacagctcatggcttgctgctgctgattgagtaatgccagtcacattttggctaaccagttcataaatattgctgaggttgcggttgatgtctttggtcacttggctttgttcttcggaagcggttgccacttgcgcgttgatctgacccaaggcactgatcgaatgattgatttcagtgagagatgcactgactttggctgctaaagattggttttgctcaagcaggcttaagcttgaatgcatactgctgttagcggtattggattggttttgcagctcttcaataatggcttggatctcttgagtcgaggtctgtgtacgcgcggctaacatacgcacttcatcggctactacagcaaatccgcgtccgctttctcccgcgcgagccgcttcaatcgcggcattcagtgccagaaggtttgtctgctcagaaatactacggatcacttctgttacattaccaatgcgttcagattgctccttcagttgattgaccacttgtgcggcttctctgagttggtcagccattttcgcggttgcgcggtggctctcttcaaacatccgtaagctttgagatgccagttggttggcttgttgtgctgcgccatccgcactgtgtgcatgatcagtcacactttgtgcggtgctttgcagctggttgacggctgaagccacttgttcaacttcctgtttctcttgatcggagttgacactggcttgagtcatcaccgtcgctaattcggttgaggcagaagcgacatcggtactgatgcgcactaagctctctaccgtttggcgcagttgagtcaccgtggcgttgacatcacgggccagaagggtgatttcgttattgccctcttcttgggctttaaccagtaaattaccttttgcgatttcacgtaccgtttgttgcaactgacgaattggggtgacaatgatgcccgccagtagccaactacttagcgcagcgaccagtaaaataccgattaaagcaaacgtggattgagacatgactgaatcgtgctcatgctcactctcatcaatggtcgtcatagccacttggtttaagcgattggatagcacatcgatggctttaatcatctcattgcccaccttgcgatattctgcggtggcctgttcatactgggcggtaaatcgctcgtctttctcttggtcactgtgttcgatgttcagtaatgggatcatggtttgaatcgagtaatccacataacgctgcatagcttgtgtaagccctgcgacttcatttttcagttcgggattatccgcaaggctgcgtaagagcgccaagttttcggtttgtttttctttaagaacgttaggaagggcggtcacttcagcgggacggaacagactataaatggcgctgatgcgcatcgcatacgtgttatcaatcagagtggtgagattatctttatcggtgatgagttgttcagtagagacggtaacttggtggaaggcggtttttaagctggaggtactgaaggtaatgccaatgatcagtaacaacagagtgaaaaataccggtactacaacctgcagcttgatagacaagccgctgagtaactggcgcatggtgatcctcttctaaaagttattaagaataattatcgttatttaaaataaatgccctccgataataagcatcaatgatgagattgcaatcgcttgcaaaccaagattgatgactaaacattgactctggtcacatttttatcctgatgttgctgatggaagaaatagttagcttttggggtgaattttttgttgcaaccttgataaccgcttgggtgaaaacgctatgtctgtggattttatgaacaataagcgaaaggtgtcatagagggttcaattaagtgaaacataattgtcatattcaccgcctaaagtgagcctcgttcaagtgaaacacaacggcaacccagccacttataggaaattcgtgatgaaaaagacagtaatcggtgctatcgctcttatgggcgcacttgcagtaactccagtgatggcgaaagagacaatctcagcagtgggctcaagcagtgttactccgctgatggaagtgttttctgaaacttacgccaaaatgaatcctgaagttttcattgaagtacaaggcccaggctcttctgcgggtatcaaagccgcgaaaaacggcagcgcggacatcggtatgtcatcgcgcaatctgaaagattctgaaaaagaagcgactctggttgaagaagcgatcgcgcttgacggtatcgcagtcgtggttcacccaagcaatgcggtgaaaggtctgacagcagaacaagtttctgaaatctacaaaggcgaaatcaccaactggaaacaagttggtggtgaagataagccaatcgttgctatcactcgtgacaccgcttcgggtactcgtggtgcattcgaagacatcatggaactgaaaaagaaagtggcggataaagaagtctctgctatttctcaacgtgctcaagtcgcgaacggtaacggcgcactgaaaactatggtcgcttctaacccttatgcgattggttatatttcactcggtaccgttgatacttcagttcacgcactggctgtgaacggtgttgaagcgagcgtagataacgtgaaaaacggtacttacaaagtttctcgtccattccttgtgctctacaaacaagataagccatctgctgaagcgaagaaattcctagattggatgctgtcagctgacgcacaaaagattgtcgctgataaaggctacatcacagttaactaacacgctttactcctttgcccgacccaaattgggtcgggtactttgtttacatcgaccttagttcgataggtgattttatgaccatcgcaacaaatagtgacaagcttatggataatacctctatgcgtagtttgcgtgagcaacgacgtgttgactggaaagaacgtatctttcacggtttgtttatgaccagtgccgtaatcggcattttatctctagccatcattgcttacttcattgttcgtgaaagtatccctgctttccaagaagcgggagtcactggcatagtgcttgggcaagactggttaccacctgccctatacggtgtcgcgaccatgattgtcgcttctgtcgtctcaacctttggggctgtgattgtgggggttccggttggtgttctcacggctatttttatcgctgaagtggctcccaaacgggtggcggatgtgatacgccctgcagttgaattgctcgccggtattccttctgtggtctatggcttctttggcttggtgatcatcgttccgctgattcaagatgtctttgatgtacctgcgggtaacacgattctggcaggtatcatagtgttgggcgtcatgatccttcccaccgtgattacggtctctgaaacttcgattcgcgcggtaccgcgtgcttacaaagaaggttcactcgcactgggtgcttcaagcatctacaccatcttcaaactgctggttcctgctgcgcgctccgggatcatgacgggcgttatcttgggtattggtcgcgctctgggtgaaaccatggcgatcatcatggtgatgggcaatgctcctgcgatgccagaaggcctacttgattcggcgcgtaccctgacagccaacattgcgattgaaatgtcttacgccagtggcattcatgctaacgcactctacgccacaggtgtggtactgctggtgttcatcatgatgctgaacggtgcgttgctgtatttaaaccgtgagaaagcgaggtaatgacgatggatcgcgtaaaactgaaacaagcgcgtgtgctcaaagacaatatcttgcgcacgtttatttggatttctgcggcgctgaccgtcggcttcttgttttggatcatctggtacatcttgtccaacggtctgcaacacgttaactggaaattcattactgacaattacacccacacgggcgatgaacacggtattttcccgatgattgtctcgaccgtgtatatggttgtcgcttcgatcgcggtcgccgcgcctatcggtatcatgacagcgatttacttgacggaatacgccaaagtcggcagccgtttggtcaaaatcatccgcttctgtaccgagtcactggcggggatcccttcgatcatttttggtctgttcggtatgaccttcttcgtggcgattttgggcttaggcttctcgattctttctggtgcattaactctcagtatcttgatcctgccagtcattattcgtaccacggaagaagccttaatggcggtaccacaaacctaccgtgaaggctcgtatggcgtgggtgcttcaaaaatttacaccatccgccggctaattttgccaagtgctatgccggggattttaacttctgtcattttgagtattggccgtgtcattggtgaatctgccccagtatttttaaccgcgggtatggtggcgcgtattccagattctctgctcgattctggacgcaccttgaccgttcacttgtacaaactgaccacagagctgttcaccattgaagaatggaaccaagcttatggcaccgccactgtgctgattgttgtggttttgctgatcaacatgatcaccaagctcatcgccaaacgattcaatactgcgacctattaagtcattgacagaatttagagataacacaatgaaaacgaccaaattcaacattgaaaacctcgacctgttttacggtgagaaccaagccctgaaatcgattaatctgccgattcctacgcgtcaagtgacagcactgattggcccctctggttgcggtaaatcaaccctgttgcgctgcctgaatcgtatgaatgatctcattgagggagtcacaattaccggtaagctgaccatggatggccaagatgtgtatggcaatatcgatgtgtctgatctgcgtatccgcgttggtatggtgttccaaaaacccaacccattcccaatgagtatttatgaaaacgtggcctatggtctgcgtgcgcaaggtatcaaggacaaaaagcatcttgatgaagtggttgaacgttcactgcgtggcgcagcgctgtgggatgaggtaaaagatcgtcttaaatctcatgcctttggtttatcaggtggccagcagcagcgtctttgtatcgcgcgcaccatcgccatggaacccgatgtgatcttgatggatgagccgacttcggcacttgacccgattgcgacccacaaaattgaagagctgatggaagatctgaagaagaactacaccatcgttatcgtgactcactcaatgcagcaagcgcgccgtatttcagaccgtactgcattcttcttaatgggtgagttggttgaacacgatgacactcaagtcattttcagtaacccacgcgatgatcgtacccgtggttatgtgaatggtgattttggttaatgaatactggcaaattataactataagcgatggtaaactttgcccctcacgatgaggggcttttttgtaggaatttcatttcatacatgtttttatctgccagatggatcaactggctcaaattggtgctgtcgagtggataagtactgaccccgacgctggtgttgagcttggctcgtaaatcgccacttaattcaaattcatggtcgaaacactgtttgatcatgcgctgcatcatcatctgctcggtcgaattgatgctgcttaggatgatggcaaattcatctccccccatccgaaacacacgataatcgaatgaaggaatcgagttgtttaagcgataagcaacctgtttgagtaccgcatcgcccatttgatggccgtaggtatcattaatttgtttaaaaccattcagatcgagcaaaaagagagagaatccaccgctgcggcggtggcgttctaattcggcgaacatggctgtgcggttttccagccctgttaatgggtccgttaaggccaagactctatggtgcgtggcctctttatgcaaaataaaactcaccagtcccacacagctaaacgtcaacaaaattaacgcaaactggatgcgactgaggtaattcagtttctctttttgctctacatacaaaggactttgcattccaaatgtgcggtttatgaactgaataaaaatctccagctcttgttgggcggcaacaataaaagtttgtaagctttctggatttttggccgcaagcagtagcggttcaagttgtttaaagcgcgcaaacgcggcttggaagaattcgcgagtgctgggcatgcctataatgccgtcggcttctgggctattgaggatcagatcaaaacggctccaagtcagctcatatttcaccatcacatcgcgctggttgctctccgactccaataggtagggggagagtgccagcatctcagtaaactctttattgagctggaataagaaccagatcgcttggttagtatgcgaagagtaagacttagataaatcgcgagtactgttgatcaaatacaaattggccaaaatcagaatcgccgacatgaagatcagcagtgttttggcatgtaagatcagcgggtggagcgttttctgagtttgtgtattcatggcttcttatgaatcaaaatttgacttatctgccaaaccatatgggtgtaataaacggagttcttcagttttggattttgatctaagttgtacaccaaccaaaaagggcctttgtgacgaattttcatctcattaccgtccatgtagtacgccacaatcggttcataatattgaatatccgctatcgaaatattagcagcgtagtcattcaatgccataaaagtcaccgatttgacgtgatcttgctgtagatactcaagcaaatcgctcactttaaaacccgtgaagcgatgtgaaccatgaatccatggcagttcagtggtaaaagaaactgcaggcagttcagtggctagctcttgcaatgaaaataccttaggcggcgcgtctgcgatttgtatcgtgatgttcgatgccaaagcgagagagctgcaccacaaggtcaagatcagcaatatccatctcattattggttattccgcactgttatccccttcctcgttgaagctgcagcggtgttggctgcgtctgtttccaagtcgtgtggatatcgattgtgttctacttctcaacctaaagttgcagggctattgattacaacttgacggctaatcatcattatttggttgaattataggcggagtcagatgatatgaaaatcactgatattaataagattgatgataaaaaggctcaaaaatgagatttggtataagaaaagcgccatactgatggcgcttcttaatagggagacagattagaacagcagatgtgcgactgcggcaatcaccggcagagtgatcagggtgcgcaaaatgaaaatgacaaacagctcgacaatattgactgggatgcggctaccgagcagtagtgcaccgacttcagacatatagataagctgagtcacagacatcgctgcaatgacaaagcgtgtcatttcgttatcgatagaggccgctaaaatggccggaataaacatatccgcaaagccaaccacaatggtttttgaagccgcggtagcctctggtacgcccagcagctctaaaaacggaatgaaaggttggccaagcagggagaataccgaagtatattcagcaatcaccaaggcaatagtgccaagccccatcacgacaggcagtacgccaaacaccatatcgacggcgttacgtatgccttcgccgatcaccgattggacggatttaacttttgccgctttggttaaagccagctccatgccccaagaaaacgcgctgtgaccttctgggatcgcatcggcatcaggatgaggtttgctgccatcgatataagtatcttttttccatgacaaaggaggaaggcgagggataactaccgctgccaccaatcccgctaaacagactgcaccatagaaaggtaggaataggtgttcaagctcgacttgggcgatcaccactaagctaaaagtaatcgacaccgcagagaaggttgtgcccactaccgctgcttcacgttgggtgtagaatttttcttcgtattgtttactggtgagtaggatgcctacgctaccatcgcccagccatgaagccatacagtcgattgcgctgcgacccggtagattgaataaagggcgcatcactttgctcagtaagctgccaaacaactctaacaagccaaagttaagcagcaaaggtaacagtaagcctgcgaaaataaacacggaaaatagcgttgggagcaggccttgcaagaccagcccacccgtattttcttcccaaatcgcttttggaccgatttggaaaaatgtcatgatcacggcagctccgccaatcacacgcacggttaaccaaagccaagaaggattaaacaaactgtttaagaaagggcgagacatgacccaacttggtttaaagactttgcagataacagaggcaaccgacataaaggcgatgattgccgtaacgacagtcaccagagtatctccaaacagcgcttgaacggacttggccaacaccgccactggaatggttaacgatccatcgtaactgatgggagccataaagaggaaaagcccgatcagagaagggatcaggaacatccacagattacctgtgccagccttcgctggtggctctaaggtttgcgcgttatcttgcattatttatctctattcatgctgcgtcattcagacacactgttcagtcgaaattcgccacaccttggcataaaaattcactgcatttccgtatttaatcagcgggcgcaagaatatctatttttgacaccctacgcaatactattcatttattttgggtatgcattcaaattaatttcctgatgtttcagtctttgatggttttttgtatatttattgttaaagtgtcattgttgatgaataagatcgcaaagcgattgcttggtcattgtgtggcgtaaagcatattgttagccacgagtgtggtagtcagcactgctgtagcttcgattaagaagagaataaaaataaaaaagcctccttgctctcggaggcttaggttgaagtatggtctttcgcttcgactcgatgcggtaatatcaagccgtttacgtcaatcactcggtgggttgggcttcaatttccgttaatgctgcgctgagagcgccttcaaaaacgggatagacattctgctcgccgaccagtttgactatgcctgctttgaccaatttttgtgagactcgactattagcacctgaaatcaaaaccttaatcccacgtttgtggaagctttgaatcatctcttccagcgtttgaatacccgttatatccataaaaggcacccattttaaacgcaagattaagatctgaggggtttcttgaatactgcccatcacacgttcaaacgtttctgctgcagcaaagaagaaggggccttccagcgcgtacaccgccagttcacgaggcagtgtacttctgccgtgttgtgccagttcgtagctcatctcttgcgagccgttggcctttacttcaacgctcgatgccatgcgttttacaaagtgcaacatcgcaatgatcacaccgatattgactgccacgaccagatcggcaaacacggtcaaaccgaaggtgagcagtagaatcgccacatcagcacgcggtgcgcgcttagccagttggacaaagtgcggcgcttcactcatattccaagccaccacaaatagaatcgcgctcaacgtcgcgagaggaatattcaccgccaaaggtgcgagtacgagcagaataatgaccagcgtcagcgcgtgcatgactccagcgattgggctattgccgccattacgaatgttggtcgcggttcgcgcgatcgcacccgttgcagcaataccaccaaatagaggggccacaatattcgcaatcccttgtccaaccaactcttggttcgagttgtgtttggtgccagccatgccatcagcaactacggcggagagtaaggattcaattgcacctaacatcgcaattgcaaaggcaggaccaatcagttgaatcatttggcttaggctaagatccggtagcgcaaactcaggtaagccttgtggaataccgccaaacgctgacccaatggttctgacgccttcaaaccccaccacatattgcagcgacgtgaccaccaccagggctaaaagcggccccggaatttttgagagtttgggaatttttggcccaaaaatcactaaagccagagacagtaaagccagcagtgttgttgtgagatggaattgtgggaaagcatgaaaaatcgccaccagtttttgatgaaagtgctcacctttaatttcaggaaggccaaagaagtcacgccattgccccacccaaatgatcaccccaatgcctgaagtaaaaccgacgataaccgggtcaggaatatagcgaatgatgctacctaatcgtgcgagccccaataccacgagaataaagcctgccatgatggtggcaatttgtaatccagccacgccgtgttcggctacgatgcctgcaagaataacaataaacgcgccggttgggccggcgatttgtacgcgtgaaccaccaaacagggaaacaataatccctgcgatgatagcggtataaattccttgttctggttttactcccgatgcaatggcaaacgccatggctaacggcagtgccaccaccccaactatcaaccccgctgtaatattgttgacccattgtttgggttgcaactgaccggctttataggattcatagatggcaaacatagttgatcaccttaacaaaaatagggaaatgaaaacgccgaggattctacgctcattttataggctgtaaagggcggcttcagttgactgacctatcgctaggcgggcagagtcaaaaaattaatcttttaatttcattgagttaacttcatgtaacgtcacattttcccaacattaacggaaaagactgcgattaattagaatttcatgcggaaaaacagagcaccgatgattttcaagatatgcacttaattgagagattgtaggttgagtatagataacaaattacctatgattccttcggttgattgttttttgttcgaagatggagtttgacatgattaacaagaagttccttaaaacaaaagatgaagtggaagtcacttttgaatgcgatgccccgcaagcggcctctgaagtagcgattgtggccgattttttaggttggcagcctgagccaatgaaaaaagtggccaaatcaagcacgttcaaatttaaaactcgtttgccgaaagatcgtgaatttcagttccgttatttgctcgataaacaagagtgggtcaatgatccccatgccgatcagtatattgctaacggttttggtgaagaaaactgtttgttaaccacctatcagtgatttgggtagcattttttgacgaaagctcaaaaaatcacaaacaactaagttgctgccagcacacaaaatcctctatttttgaaaggcacaaatgtgccttttttgctttaaattgacgaaagcgtaggtgacaaaccgcgctgaaacccttactcttggccgagttttgacttttttccacaggtaaactggtgatatctaaatctattattttgcgattttctgagctttcaatgcgaaagaaagcgacactagtaggtttgccgcttttggctgtggccgcgatatcttcttcgctaaacagtcccacgcggcaacaacgtattgagttgtctcttccagaatctccgctcgtacagttctcttcagcagaacatactgtagaagtggtcaaagtgggccatccggattatgaatatgaaatcaagccgggtgataacctaagtactatctttaatcagcttggttttgcttataccgagctaatgaaagtcatggaaactgacttaaactacctcgctcttgatacgttacggccgggtaacgtgctgcgtttttggaaaggcagcgataacaccttggccaaaatggagctggaatttagcctcgttgaccgcgccgtttatacgcgtttaaacgatggtagctacgaatttgaagagcgtaaaattcctggtacgtggaaggttgagccgctgattggtgaagtggacggtagcttttctctctcggctaatcgtgctggccttggtgccgccgatgttgatcaaatcgtcactctgctgaaagacaaaattaattttggccgtgatttgcgtcgtggcgatcgctttgaagtcgtactatcgcgtcagctcgtcggagaaaagctcaccggtaattctgaaattcaggcgattaaaatcttcaaccgtggcaaagagattaccgcgtatctgcaccaagacggtcagtattacgataagaatggtgatagcttgcaacgcgctttccaacgttatccggtggacagcaagtggcgtatttcatcaaactttgacccgagacgtctgcatccagtgaccaagcgcgtagcgccgcataacggtacagactttgcgatgccaattggtactcctgtgtatacctcaggtgatggtgttgtggtcatgacacgtaatcacccttatgcgggcaactatgtggtgattcagcacggtaacacttacatgacgcgctatctgcacttgagcaagattttggtcaagaaagggcagaaagtatcgcgtggtcagcgcataggattatcgggtaataccggccgtgtgaccggtcctcatctgcactatgagttaatcgtgcgtggtcgtcctgtcaacgccatgaaagccaatatcccgatggcaagttcagtgccgaagaaggagatggcgcagtttattgccaagcgcaaagagcttgaccagatgttagctcgccaagaaagcatgctagcagcgcaataaatcgagtatgagtacaaagccccgtcacggggctttgttgtttttagtggtaccgatttcttgagtattgccttatttttgattgaggcaagcgttgagaatatgggcttttaccgtttaggctacattcgtttcttttctccagcgttcaatcatcacactcggtaaatcaggtcgactgaagtaatacccttgaatttgctcacagcccatttgatagagtttatccagtgcttgttggttctctaccccctcagcgacgagatcgagtttaagctggttagcaagctgaataatcaaccacacgatactctcagaggtttggttggtaagtaggttacgcacaaatgcagcatcaatcttgatgcaatcaatcggataactgtgaatgtagttaaggctcgaataacctgtcccaaaatcatccaaggcaattttaaaacccaattcacgcaatatggtgagaatactgcatacttctgcggccttagagagtaaaaccgtttctgtcagctcaatagtgaactcgtcggcttgaaaaccataggctttaatggtttttaatagatgctcaaggtaacgattggaatgcgtcagctcatcggcggagcagttgatgcttaagcgaattttttggtcaataccttgttctaattcttgtttcgcgatgcaggccaattcgagaatacgttcgccaaattcgacaatcaggccagattgctctgctgcttcaatgaattccaatggcgttaccacaccgagcgtactgctattccaacgcgttaagatctcaaaatagtcccaatttctttgatgttttttcacgatcggttgcacgaccacatacagctcagtttgatggataggcttactcaattcactacgcagagcttcgatgatttgtgtacgccgatagtattgattgctgagtaagttgtcgtagaaacgaatgcgtgtgttatggttccgtttacactcttttaaagcgagacttgcattgaacagtaattgatcggcattgagcttttcaccactgtatttggtaataccaatactgacactgattttgagtcgacgatcttgatcgatataatcttgcgccagcttgttgagtatggtttggcagatcttcatcggctcacgatctgtggttaaaaaagcaaattcatcagcggcgattcgaaaggcgtatccttcttcggggacggcttgttttatcgcatccgcgacaaatttcagcacaagatctcccaaatagtgcccatgcagatcgtttatcgaacgaaattcatcaatatcaagaaaggccagagtgaaatgatgtctatcttcttgaacgagagccgtcagtttctcggctaaatcattacgattcattaaacccgttaagttgtcgtgagatatttcatgacgtaattgattgattaggctctgagagcgtacctccatctgtttacattccagatcatgagcgatcatctgagccaaaatctggtgaactaacacgagattagcaaagtcgtctaactgacgcgtaaaagtcgagatcaaaacgccgtagttttcgccatttgaaaaataaatcgggatacccagatacgcctcaatatggttctcaactaaataagcatcgttaggaaaaagttccgcgactttgcttgcaaataggcaataaggttgtctttgtaatccgacttgctcacaaggtgtgccttgtagttcgtaatacagctctaaactgctgggttcgacactggcacaacttaagttatgagctttgtagcgcattttatctagctcaatgaccattgagctgtggctattgaaggtgcggtggagaaactgagtgatttgtgagagcaactccaacccccccagctgactgaagtgatgtatggaatctaggctcagtttttctgttatcagttgagtcttggtcattttctgatctctctagccgttactgacaaaatggacctcgtcaacgcgagataaccttatatgcatactgttactattgatgaggtcgaggagattttccagccgtttgatagagagaatgacagcttgttcatgcttatatttttaattcaagcgtttagttgagagaaaaaattcgattatgtgcatagaactttattatttaattgataaataagttatctagatggctttagcgacagccagcttttgcttcaaatgatcaaggaataactgagtacgggtatgttggtactccaatttggggtaatacgcgtatacggtcgcttgatctatagtgacatcaggcaataggcgaaccaaattgccctgttttagctcttctttgatcataatatgcccagtgacaataatccccatgccggctttccctgcataaaacaaggcttcagggttggtggtggcgaaattgcccgttaacgttaggcgtttgccttgcgctgtttttacttcgcgaaatgtttgctccccccagcacagcacattgtgctcagttaactcctgtagcgtttgtggaacgccatgtttagccaaatagctcggagaggcataaaacgccgcttgatactcaaataggggagtggctttgaagctaagcgaattgagctgctcaatttcacggctgatgaacagatcgagatgcagttcaggtaattgtcccggtgtggtggtgatgagctgaacgcggatatcgggatagcgttgtaaaaactcatcgaggtactgcatcaaaaatttagagccgaccgctaaggttgcaccgatacgcagcaagcctgcgggcgtttggttgacggagcgtgtttcatcgaccacggattgccagctttctaactgtgctttggctcgttgataaaaaagcgctccggcttcggtctgcgtaactgaacgtgtcgtgcgtttcagcagttgaactccaatacgctcctcaagccagtgaatacgcttactgaccgccgaactggtggtgttgagtttgcgtgctgcgccattgaaactgccttcttcaacgactttgatgtaggtttttgcgctctgtagccagtccatctcgtgcccttatttattcttggttggaactaatttatttccaatttgcgagattatcaaatgagagttgccaatatagactctctgccatgaacgcacaaacctctactcgttttcgccgcacccccatgctacttgcgatgatgatcatcgcgactggccaagtgggtgtgagcatttatttgccctcactgcctctgattagccgtgatttacaggtcgatcaagcgagtgcgcagatgctcgtcacgctctttttactgggttttggtggctcacagctattttatggcgcactgtccgatgccgtaggccgacgcccgacgtttttgcttgggcaaggtatctatttgctaggtactgtgctctgcgtgatgatgtcggatcattttcaagctcttgaatttggacgcttattgcaaggattaggggcgggcagtgcttcggtacttgggcgtagtgtgttgcgagacagctatgatggtttccatctgaccaaagctctctcatatctctcaatcaccgcgtcaatcatgccaattattgcaccagtccttggcggatggctggcgtaccatttaagctggcagtcggtgtttatttttgtgctgctctatattggagcgatttttacgctcgggttgatgatcctgccagaaacgctgccttacccaaaacggcgagttcaatggcgtggtattgtgattaactacgctaaactgcttactaatcaacaagtcaccagtagtgcaagttacaactggttaagttatttagccagcttggtcaccttatccattttgccctttctgctccaaaaacagctaggtatgaccgcagccgattacggctcgacccttattattccctcttcaggtttattattgggcagcgtgcttgtaaacatgctgacttctcgtttttcggtgcgtcaattgctggggtgtgcgattagcttgatggtatttgcgggcctttggctgctgctgaccgaattctccgtgtttaacctgatttgggcttttacttggctgagcatcgcgcagggcatctcttttccattggctacaacgcttttgttatcacctcataaatcacaagcgggggcggtttctgcgctttctggttcgattcagatggggatcgcaggtttactgggaggatatttggtggagcattgggtgactagccaaaatgcaatgggtgtgttttatattctggtcggcatcacgatgttgagtgtgttgatcgcaacgaaaaaagcgcactcgcagcctagcgctgcgcaagtaccgatgtaagtaagctgagtttaccgtctaagtacagtgttaaatctagtttaacggctccactcttctggatgcgataagcgtgttttatccgcgaaagtcatagcgcgaatatctttgggattgtagatagcacaagactcaagagataaacatccgcagccaatgcagccgcttaagtcctctttcaatgcgtttaattgttggatccgatgatcgagaaaatggtgccaatgagaagccatttgctgccaatcttgacgagtgggcgcttcatgttttggtaaatgtgccagagcttcggcaatctcttctaaggtcagtccgaccatttgtgcggccttaatcaccgcgatcctgcgcagtacactacgatcgtaacgccgttgattgccttgattacgccaactatggatcaatcctttctgttcataaaaatgcaacgctgagaccttcacccctgctctttgcgccacatcgcctactgtcatctccatatgatttgtctcccatcgaccgaacgagccttctatttcctgcccacttgaagttgcagccgtgcgggttgcaacgctaagtggtttgggtacacccgttttattaaaaaaacgctttacctaaagttaacttgaggtattaccgtagcacccagttggcctcaattggaatattaacatggaaaaaaataatacaacgcgtgcgggatactaccttacaggactgttttttgatggtatttcgtcaggactatttatgatggcattaccttggatgatgctctcaacaccaaatcagggcgcttttgtggcgatagtggctttagtttgtacggtgctctcttttcttcttaccccatttttctcaaccttaattgatcgcagctctcgaaaacagcttctggtgttggtgcaggctttacaggccggaaccgctgtagtggtggcgttgtgttatggcgtgggttatgactcaatgggattattagcagccgctcagctcgtattctggacatcgagtaacttggcatggtcagctaacaatgcgtttacccaagagcactttcaaccccacgaatacgcgtccatttcaggtaaacaagaagtgattatgcaagcgaccacgctgggatctggcgcattgggggttgtactgcttgaaatgtggggcatgtttgagtttgcatgctttgcggctttagcttctgggatcgcaatgagcagttatttgttggcaccttatcgtcgtcaattacgacaaactcactcggcctcttttttcgaacaaatcaaagagagccgagaggtgtttactctacgcccacagttttacgcgtttctcatgctctcgacgttaacctacccaatcttaacgtttctgagcaagttggtgccgatctggtttgccgagatgaatatttcaggtgattggtttgcgggttataacatcgctttcggtatgggctctttagtcactggcctgtttgtgagtcggttgcttgggatcagtacgcatccaaagatcatcatcggagccatgctattggcaacgatggcattgattgggatgagtttgtcggcatcgccgcagtcactgattctctgtacttttttctttggtacttttaacgccttaaatcggattgcccgcacgaattggatgcactatagcgtcaacattgatcagcgtgggcgtgccgatggtgggttacaaatgttttcgactttagtgcaaagtgtcagttatgtcgccattgctttcctaagccattttgggctaactcagttaggttttatgttggcggcgatggtgatggttgctgccgtttttatgatggtgcgacttaatggtcgtatgaagctaagcgcggtgcttgcctaagctaagagggcaatccaaagtggttaggaaaaggtttctctctccatcgagattcactgccgctcaggtggagaagtgtatataatcgccgctcatttttatggggaagtgctttctacggggaaacatcatgcaacagagtcaatttgaagccttaattaaacttttatgtgagcaagcgacgttaccgcaagccctagaactgctaaaaagcagcgaagacgaggcgattgctgaagcggcgcaatcgctttcaggtcagtttgctttggctgaagtcgaaggtgagcaacgtatttaccatgtgaccacggaagtggatgagcagggcgaagaacaagaatacgtcgaacacatcatgaacgaaggtgacgacgtggtgaaatttgtcgcttggttctttgatggctttttcgatatcaagcaaaaagacgtttaccaagcggcaggtaaaacgtacaaacaaccaaaacgccattaatttgtaataaaactacaaaaaaacgtgaccatactcttgttttgttgtttttcgctgttatattgagcgcaaaatgtcactcaacaacaaagaggcatgtgttatgaataatgaactcggttctgtttacctaggccaaatgatcgctaaacaagcgatgcatcaagctcagtttggtaaaagcaaaacgaaaaagcgctctttattacagagaatgcgtcaaaagtttagccaataagcttatgtgattaagcttttgtgtttgaatgttcagccgaaagcgggaaaacgctagactaagaatgatatcgccccacaaatgtgtggggcgatttttttacgtcacattcagtgaagtcgctaagtttactgagcttgagataagtgaaccgtttcttctttttcacccgcttttggatcggcaaaacgtgcttcatcaaaggcgttttcagatttcgccacaatacaagagacacaggcatcaccagtgatattcactgcagtgcggatcatatccagtagacggtcgacacccatgatcagcgcaatcccttccagtggcagacccacttggttaagtaccatggcgagcataactaagccaacgccaggcacacccgcagtaccgacagaagccagtgtcgcggtcaggatcaccatcaggtaatcggtcatggtgaggtcgatgttaaaggcttgcgcaataaatgcggtcgcgacaccttgcatgatcgcagtgccatccatgttcaccgttgcaccgagtggtacggtgaaggaagccactttgttatcgacgcccaaacggtttttcaccgtttccatggtgacaggaatggtggcattggatgacgcagtcgaaaatgcaaacataatcgcatcttccattttgcggaaaaacaccattggattcaggcctgcaaaggttttcagcatcaacccataggtgacgaaggcatgcagtaacaaagtccccgccagcaccacaaagtattcagctaaattcaaaattgcccccagtccgagtccggtgaagagcttggccatcaagaaaaatacgccgtaaggagctaagtgcatcagcatcgcaaccagcttcatgatcacttcattgagatcattgaacacctgagcaatgcgctctccgggtttgccagcagcactgattgccacaccaaacagaacggcaaagataatgatctgcaaggtattgccttgcgccattgcactgattgggttggttgggaacatatccacaatcactttacccagagacggggcttccgccgaggtaaaattgctggcggcggttaaatctgcccctgctcccggttgaaataagctgcccatagtgagtgcaagagtgatggcaatcgcggtggtggcgagataaaaacctaaggttttactgcccattctgcccaatgtggagagatctttgagtgagctcgtaccacataccagtgaaacaaacaccagtggcacgactaacattttcaagctggcgataaaaatcttgccgccaacatcaaacagtccattaacgatatatgcgtctacaaatccatttcctgcaaacagggcgcgaatcgcaaatccagtcaaaataccggctaccataccaaggatgaccttagcggtgagcgataacggttttttggtattcatccagaacactccttatagtttttcgctctgacatcattgcaaagcgagccggaggttagcaggcgtaatcaaaaactcgaaaataaaaagcaaatctcgctgtttggttgtgatctttatcacttaaatggctggtttttgtcgtatttggtaacaaagttttagctttaaatcttgtctttattatcaaatgcaacatataagtttgcatatgcaacaaaaatcgccattctcaacgggtgaaaatggcgggggtgaagagggttaatgcggttgcggttggcgtgaaagtcgggcgttacgtagagaaaaaccggtaaccaacatggtacctgccaagactagtaaagtaccgaacagggtgttgagccctatcggttcatcgaggatccagtagccccacaagatgccaaaaacggggatgaggaaggtaacggaaagtgtggatgccgcaccaatggctttcaccaaacggaaatagattaagtaagccaacccagtacaaatgaccccaagcaatatcaccgctccccattctaagctggaaggcgtttcacgtagaggaacaaaccacatcagtggagcaacccataaacacgcggcccacatactgccatgggcattttcaaacgcggagagctggggtgcttgtttggtgtagttggtggctaagccgtaactggctgctgcgagcgcggcgcataccatcggtagcgcagcgtgatgtcctatcgccaccatatcccatcctacaataaccgccacaccgcttacgcctagcagaagcccagccaccgctttacgggagagaggagtaccatgccagagaaagccaatcactgctccccaaatgggcgctgtggagttgagtatggagagtgttgaaacatttagagttaacgccgcataagcaaacagtaaaaagggaacggcggtattgattaagcccaaaatcaaaaaatgtggccaatgctggcgtattggcagtgatcgcctgagtagctgcgccactaaaaagagactgagtgcggcaaatcctacgcgagcttctatcaggtaagcgggaccaaagctgtgggcagcaatacgcataaaaagaaatgatccgccccaaatcgcagccaaacagagcagttgcagcaagttcaccaacgacatacttctccctccttcaatctaaagagcactcactctcggctacaaagcgaaaatatgcaatcagcaaatcgattagattgccagaaatggcctgtgttctgttaagtgggcagtttatgcggccaattggactaatgcctgaagttatgctgtctgagtcatctgtcagttgaattccctctgcatttgcttttcaatagcccggtgaatagcaaaaggaatctttctcgtggctcgtcctaaaattccgcgccgaattgagtgtcatccgccagcatcgtgttttaaacccaacggtgttcctatcagacagctcgctcgtgttgagttagccccagatgaactggaagcgttgcgattagttgatcagcttggcttgcagcaacagcaggctgcattgcaaatgcaggtatcaagacaaaccttagccaatttggtcaaagcagcacgttttaaggtggtcgattgcctgcttcatcaaaaagcgctttatattcaagctattgataataagtcatcggattaagctattaaaccaattgggataaacagcctgcgaaacgccagagtgagtgatagattgtgtgtcacagaaccgctgtgaccaaccactttctccttctatccatgcgttgagagtggttcttttgccaagcgcattattcacctggctcccccgaatagaggcttatcacctcattcggggatttttttatgctgaaattgattgtggcgaatgaagtagtcaatttgacgggcggttttatggctgtaaaccaatccagtatggctttgatgcaagagaagatgatcagtcattcctgagatttgagtctcggcaaccgtgaccgtgccatcacacattcctgagccaccgagtaagattgggcgaaatccgaaacgcaatgttcctgcaatgcaacccagccgttgtggcaattcccagctatcttgatgcaattgcaagccatacagatgtgcgttacctaacatagctcctagccctaactgctggatcttagggacaatcgatgcccctttaaggggggaggccaaagcaaccacatgagaaatcacattgggtgaagggtgacgagaacgtaggtaatgtttgatcatcaatccacccaaactatgtcctaccaacacgttgatgcgatcttgtgctagtgcgctgtctatggtctgaaatactttttcatcatcgatggctaaagtgttgtagctgatcacttctgtctgatatccgagtttattgagacgttgcgcgagaggttgcataaccaaaccatgcatatacaaaccgtgcagtattacaatcttcatcagtcgcagaacctttgccgagggtaaggcctattatctaaccatgcttgaataggaataaaaaggtaggagctcatttttcgtctgcccccttcctacatggagcagccgtgttggctacgttcggtcaacccaatcacatggtttaaatatgttaatgaggatgaacgcacttgtctcctacctgtaactccaagtcgtttggctaaaggcctagagaaagttcaccatgatgattgcttattcaaaaaatcagaacaagacttgatgtaaatcgtcgcatttttatctgttttatgttgcaagtatgtttcttgtatattgggtgtttgatattcatataataaaagtactaattactgttttctaatatgtagattaagggagatataatatatctactaactatttgtaaccgaattattgatgagcgaataattttaatgaatctattccagtgttatgatggtaaatcaaacacagcaaaatagagaatattcgtggacgtaaatatcaaatcaccaagaatacccattaatgatactgttgccttacagcagttagagagaatatcaacgaagtgggtcacgcatatactttggcatttagactcttctgagtccgctcgttttggtgaacttcaatattcattgaatggcatttcagcaaaaatgttaagccacagattgaagatgcttgaagagattggctgggtatggcgtgagcagcagcctaccatacccgtgacggtttattacggtttgaccaaatcgggtcgagtcgtggcgaacggattatatcggtggatagatcatgtcgtcgaaaatgaacgagaaccacttttagaaagtaattaagtaacgaattcactcactttagcctgcaatctcatttgcaggctttttatttatctaagttagactgttttaaccatgtcatgaaatattcaaatcaatgtcatgaattaaattatgataaatagacgtattgataaaatttgatcaccattcagtgatttatttaattccattatgttgttttttatttctggtacaaagtcacacaatctagattgtgatcctatgtcgtttttatttataacagcaacacttattcatcacgtatgtgtatcaaatgaagttatcaagaatgttatttttatcgtttgttgttctattttttttaggtatttctttactctattttacctattcaagcacaccgcgtactaatttgcctgatgagcggcaggagcacgtcatcgctccgaaaccggcacctgagattgagttatcgattcacgaacaccctgctgttgagcttgagtcaacggaaaatcgggttgtgaatgaacaggaagaggtgcaagagcaaggtgaagctcctcgcgtgatcgagccacaaaacctagagcaagtctggctgcccatcaatcctacgcctgaactggcagacctgaagccgaagagccaagccgtcactgatattcaagcgattgagtttgaaaatatcgatcagtttcgcgtgttaatggcgggggattcagccactttgccgctgccaaatggagagagtattcgagttctgattgatgaggcgcaaactcaagctcaaggcatacaaacatgggccggaaactttgagacgcagggtggcacttttccggtgacattcacttttggccaacattccatcatgggttttattggtcatccccaaggttctatcaaaatagaaggggtcggacaccaagcatgggtgtaccaagtccctgatagccatggtttcgagcacgatacgcaatcgcacgatcgcgctcattaacctcgcgcttatcgcgcatttacacaaaaactaggagttatcatgaaaaaggcgtcattggcactggccgtaagtgtcggactttgctcacccgcaatttgggctacgaccgaaattgatgtattaggcttatacaccccagatactgcgaaagggtttaagcaagagcatgtcgctcaaatgcagcacagtgtgaacgtagcgaacaaagtccttaaagacagtggtctggatatcaaggttaatttagccgcaaccaaagaagtgcaatacgacacacaaccgggattgaagaaatctcagagtgaagtgcttgatgctgcaactccatttaatcggatcgacccagcttttgcggatgttgaagcttaccgtcaacaagttggggcggatatggtggctatttttcgttaccttgatgttaacaattcgcccgactacgaacgtcaaccgaatggttcttattcgataagctgtggtttggcttggattgtggccccttcagcgtggaaatatccacaaaatgcaaagaaaagcatgtatagccacagctatttaaatgagtgtggcgcggaaacctttatccatgaattagggcataactttggtttgaaccacgctcatgagcagtaccgagagttacctcatcataataatggcacagaagtcgatgcttatggttatgggattaaagggcaatttgccaccatcatggcatacccgcacttatttggcgtggggcgcagttataagttctctagccccaatttacagtgtgaaggtgctccttgtggtgtgaaagattatgctaactcagtacgtgcgataggcctcacggctccacatattgcgcaagtctatacgggtacaaagcctccggttgatgatggaaatcctggggatacagaaccgacagacaatacgaataacgtttttacgataaaaggcccgcttgcactaccggatatgaagatcctgactttgccgatcgtagtaagtgctcagcaatccagcacggcgcaggttgcgattgatattacccatgaataccgtggcgatctgagcattaggctgtttgctccagatggaagctattgggtattgaagcaagcaaaccgttatgatcgtggccaaagctataacgtgcaattcacgctaaatgatgttgatccgtctgctgctgaaggagagtggcgtcttgagatccaagatcacttcggtggcaaattgggcaccttgaaccagttccaaatcaccttcccgtaagtgtttagttttttagccacgcaagcaagtctgaaaatagatgacttcgttactggctaagcgataaaccgtcgcaggtttgccgcctttacctttgctagaggcggcaattttattggtactgacaattaccccggtatcgatcagccgacgttttaccgtcatgcgattgacgtccactccaaatttggcgtaagcctcaataatgtccgccaccaaaaactccagctcaagtgagaacagcactacagaagtgtactcaaccgctgcgcgcagttttttccatgcatgctgaatttgcgccacatgatcaaacgccagaacttgtttaccttgcaaaatcgtctctagtgcaaaccaattaacacggctcttatccatctcagcctcttcaatctgcgtgacgttggaatgattgagcagggcatagtgagaaatactgatgctccaaccgcttggatcgcgtttaggattaccgtccaccaaaggatcactgatgaagttggggtaagtatggattttctggcggcagatgcgccgacgcgcggaatcaaaatctttgtcagcgggttcgccaccttgtgcgctgagatcctcatcaaacacccaaccaccgggaatcgcccaaagaccgcaatcagggcggtttggattgctgcgtttgaccaacaaggtctcaatgcccttgggggcaaggcgcaaacagatcatatcaatggtgacaatcatacaaggttcctacattagggtgcggctattctaggtaactgaatggtaagggtcaaatgtaaataacaaaatgtgattaactgaatgttgggcagtttatagcagactgaataccatatacccttcctacttgaagctgcagcggtgttggcagcattcactcaccccaatcacatcgtgtacctatgctcatggggattcactcatttgccgcctacctgcaactccaagcagtttgggtatagaaggcgtgctggctgtgctttaaccgaagattccttctctttattgtgggtttgtcacaaaagttgacaaacatagagggctccattatcgtgcctgcaaaagttagcaacaaaatgttactaacatccgaagtgtactgaaggacggcaatcatgaatccacgcctgttttctccccacatcattcgtagcctgctcgatcttgatgcttataaaatcaatatgatgcaagcgatacaccatttttatccggatgtgtcggtgcgctatgaattgattgtacgcagtgaagaggatgccagcggacttcttgatgccatccgtcaagagatagctcatcttggcacattgcgtttttcggatgccgatattcattatttgactcagcatgcgccacatctcaaggcgaccttcttgcaatcgttgcgttatttccattttgtgcctcaagagcaagtagaaatggggattgtcaaacaaggcggaaaacagcaactgcggatcagtattcgtggcagttggcgtgacacgattttgtatgaaaccttagtcatggcgatcgtatctgaagtacgcagccgtcagcgttgggctgaggtgcctgctgatttaccactgaaggtgctcaaaaccaagcttgaccaattaaaagcggagattgagcgtcgtgggatcaacaacttttctttgaccgaaatggggacccgccgccgcttttctagccaagtacagcgtgatgtgttggcttgtcttaagcaagagatcccacaatgggtgctgggtaccagcaactaccatttcgctcgtgaatttgatttaaagccgattggcaccatcgcccatgaatggtttatggggcatcaagctttggttaatgagcgcgattcacaacaagtggcgctagagcgctggttgacggcgtttgatggtatgctcgccattgccccgaccgatactttaaccatcgatgcctttttaaatgatttcaaccgtcatctggcaaacgcttatgatggagtgcgccatgattcgggctgcccattccgttggggcgataaaatgattgcccactaccagcagttgggtattgatcctaccaccaagcttttcattttctcggatggtttagatttcgatcaagctctggaactgtgtgaatattttgctggacgggtgaagatttctttcgggatcggcacctttttaaccaatgatttagcaaattggcgcaacgcggcgggtgtggagtatcgcccactctcgattgtgattaagcttgctgagtgtcaaggtcgcccggtggcgaaaatcagcgatcaaccggaaaaagccatgtgtgaagatccaatctttttggccaatctcaaacggcgctttaacatcgaattggatgtggatgcgcttatccaagagctgcgtcatcaaaagcgttcaccacgacactatatttcagcggcctaatcgccgcgaagccattggaggcgacttgctatgcccaataccccacttaaggttggcgttatcggttatggatactctgcaaaaacgtttcatttgccgtttattgacacgttagaatcgctcaccttaagcgcgatcagctccagccagcagcaagtggtacaagaagattggccacagatcgcctactttgattcggcgcagcggctcatcactgaaagtgatgtcgacttggtgattatcaccgcgccaaataatgtgcattttcctctggcgaaactcgctttagagcatggtaagcacgtgattgtcgaaaagccgtttgtgacgcagattgaacaaggccgcaccttaattgaacttgcgaggcagcaagggctgctattgagtgtcttccacaatcgtcgttgggacggggattttttgacggtcaaaaagctgattgagcaaggacaactcggtgacgtgaaggtattcgaatcgcactttgatcgctatcgtcctgtagttcgtcagcgttggcgggaacaagcgcaagaagggggaggcattttgtttgatttagccccccacttactggatcaagccctagtgttgtttggtcttccgcagtcgttatccgcagattgccggatgatgcgaccagacgccaccaccctagattactttgatctgcaattgtattacccacagcatgtggtgcgcttacacgcgaacttgtatagcccagagcctaatgtgcgttatcaagtcctcggcagcctaggtaaatacgtgaagtatggattagatccgcaggaagatcgtttgaaagccggagagcgtcctactcaccctcagtggtcgcaggaaatgcccgaacaatatggcatcttgtatcacgcagaggggaatgaaaacgtcatcactgagcttgggggctatcagcactatttcacacaagtggttgaggcaatccgaaatggtgcatccaatcccgtgagtgcagagtcggcgctgcaatcgatccaactgattgagctagcgttagaaagtagcgccaaaggccaacgcttagcggtgactctctaacgttaaagcactcacgctttaggctaagcagcggagctatttgttcgctgcttggcgcatttcttcataaccaccaccgttatgcactcgagtatagccttgttcaatcaaatatttctgagcgataccagagcgattgccactgcggcagtagagcacgataggacgctctttctcgatggcgttaaacgcggtttctacctcgctcagtggccagtttagcgccgtatcgaggtgtccttgcgcatattcttcgacggttcgaacatcaatcaagagcgcaccttcattgaccatctgccatgcgagctctgcgcgctcggaagcttgagctccagagctaaaccaagcactcaataaggccaataacgcttttaatccattttgtcgcataacgagttccttcattatattttgcttgtggcaaagtttaatggtatcgagggttgtttttcaaatgccaaaacttgctctaatggcatcggtttggcgtaaaaatagccttgaatccaaaacacatttcgttctgctaagtaatcaacttggtattggtgctcaaccccttccgcgatgacttcaatgtttcctccttgagcggaagcgatgatcgaatctaatacactgatttttacatcgtgggtgttgatggtatcgacgaacattttgtcgattttgatgctactgatttgtaagttttgtagataagcaaagccaccgtagccagtaccaaaatcatcaattttaaactgatacccttttttcaagaggtaaaacacttcctcttgcgcttgagtcatggccttgatcggaactcgttcggtaagttcaaatttaaggcgctcactgtatggccaatgtagctcttccaataaatgggtcagatggtgttgctcaaggtggtcggcgactacattaatgctgacccagcgtggtgcggggatctgcgcgagatcgcgatggacttgttgaataagttggttggtgatcttgacgaccaagccagaatcttctgctgcagaaatgaataggctggggggtacaagttggtggcctttttgccagcgtagtagcacttcgtaacctacgacctcttgcgttcttgaatcgacaatgggctgataatagggaataaactcttcatctctgatgcctttttcaatcaagccttcaatagaattacgatagttacgtaaaatcaaatagcttgctgagagaaacacgccaagcagtactgcgagagggatcccccaagtgaaaacctgttgccgtgccaaagtgagtaaagtctcaccagcaagcagggtttgttcactatggaaaggagcgttacccgaatgctggcgaatagaaagcggattggattcccctagtatggcgatgttgccacgctgaatggccaactcattgagcataggatccaaaaacttaaagtgtaagtaaaaacagtcaccacaaggttcacgcaataagtcttgcgcccaacttccatccaccacccaaaagacacggcctcttggttcgctatattggatcaacaattctcgtgaagccgtttgggttttaggtgttgcagagagagtgaagcccgtcggttcagcggcggatgaatcttctgcaagagcaatgggataacctatggtggaacagccatcaccttgtgcattttcaatgccgatcaaacgaacaaatcggttgtaaaactgtgggtcacggattagctgtagatcatggttattacaagtaaacgtcagtgactggacttggtgcgtgatcatactgtctaaagccagattgcgttgttctaggtactgattaatctcagcaaatttctgattaagcagatgttgtgcgacaagaggagcccagagcggctgagccaataaaaaaataatcaagggtgagagtagaatggcaaacgcgattctcatcggtgcttttgaaatcacagtcttttccttagccattgtagagcgtcagcgtggcaaataagtccaaactatgtaacacaatgaaatgcaaagcaatgcattgatagattttgtttatgaaagccgtccttggctctcactgaaggccgaaggctgtgcaaatgtgtgcctgataaatgggtcactcacttgccgcctgccacagtagctcctagtgattgggggatagcagatcaatgacttcatttaggctagtgcaaataggatgaccaagagcgatcacctcggggctcggtttgactaaatcagggatctggaaagcgtgcatttgcgctgccatagcggctttgatgccattattcgagtcttcaaacgcaaggcactgctgaggttcgacacctaagcgctctgccgcgagtaaatagatctctggatgaggtttaccctgagtcacttcacagcccgtggtgatgttcgcaaaatagtgatctaaaccagccaactgcaacttgataagtgccacttctttttgggtagaggtcgcgacagctactgggattgaacgggctttcagccactcaagaagtgcgatcaccccatctttatgtggtatggcttcatgcatgaccactgcgttataacgctgccgccactcgttatgtaaccttggcaaatcttcaccgtaagcttggctcaaaatgccattaatggttttggcattacagccaatcaccgagagatagacctcttgccgaaaaggcaatccacaagcggtacacgcttcttgaaacactcgcatacagacccgttcggtatcgagtagtagaccatccatatcaaaaatagcggcttgaaagttcatcgttcccacctaccacaaaaaagtgagcggctattgtcccatactttcctgatgcaagagaacccaaaacttagaactgtagtggttggatcagtagataagggtattttagatcagtaaattagcgagagagttgcggcaatttccgctaaactatgttgcaaaacaatgacaatttagtgtcagcaggtgaatgaagtgaaagcagtgtggataaggcagtggttccccggactctaccaatttaaagattatcaacggggatggttaaccgatgatgtacgagccgccttttctgttgtggctgtagcgctgcctgtagcgatcgcttatgcgcaattaaccggtgtgcctgctattgtcggactttattcgtgtgttttgcctatgttggtctatgcgctgatgggcacctcacgccaattgattgtggggccagatgccgccacttgcgcggtgattgcggccgtggttacccctcttgctgccggagataccaccaagcactggcaactggtgatgaccatgaccgccatgaccggtttttggtgcatattggcgagtcggctcaaactgggcattttcgccgattttctctcaaggccgattttgttaggtctgcttaatggggtggcgctgacgattattgttggtcagtttgccaaagtattggggctcaagtatgaaaaacgttatctgcttgaacggattgttgaagcgccagagctgctgtactccttgcattggcaaaccttgggtttgagtgcgctcactttagcgatttacttagtgatcaagcgctggcagccgagatggcctgcggcgatgtttgcaatcatggtcgcggccttgctggtgtgggcactgaatcttgaaagtgtgggcgtacaagtggtgggggttatccaaggcggtttacctgagttccaagctccggcttttgatttagggatcagccgtgaactcgttatgcctgcgctcaacttagcgatggtgagctttgtgagtatgatgctcaccgctcgcagctttgcggctaaaaatggctacgatattgatgcggataaagagttccgagcgcttggtgtcgcgaatgtcgcagccgccttttcgcaaggctttgcgatcagtggtgccgattcccgtaccgcagtcaatgacgccaatggtggtaaatcgcaactggtttcggtcatcgcagccttgtttattgcgctggtggcggtttttgcttatcagcctttgcaatttatccctgtcgcggctttgggcgtggtgctgatcatcgcctcattgtctctgctcgatttaaaaggcgtttggaatttaagaaagcgcgataaagatgcgttttacctcgcactcatcacctttatcgcagtgttagtgattggggtgatcccagggatcactttggcggtactgctgggtttattccaatttctcaaattggtgatgcgccccactgatcaaatgatgggattggatgaggaaggaacgctgcgcacactcgatggttcagagaaagcaaaaccgatccccggcatggtgattttccgtttcaattcaccgctgacctattttaacgcgccctattttaagcggcgtattctcgatcagacggagcgtgaaggcgcccaagtgggttgtgtgatcattgatgccgtggccagttttacccacttagatctgagtgtgatggcgatgctggctgacttacatggcatcctgaaaaaacgcggtatccgtctcattctagcggggcgtaagcgcagtttacgccattggtgtgatctcaccgggatcaataccgctgaagggggaatcgtgctgcgtgccgatatgtatttagccatcaaactgagtggttgttacctaagtgcgatggaagaaggccatgtccctgtggtgcagaaggaaccagatatcagcgtgttgctaaaaccaaccacgaccgaagtggcttaagaatggttaggggctcaaattgggccccttttctttttcggttaaaaatccgcatcgacttggaaagtcatgggctgcttagtgtagggatgagcaaaactcagttgttcggcatgcaaaaacaaacgtttgtcttgcaagccatacaaatcgtcaccgacaatcggcgcatttaagccaagatgatgggcgcaatgtactcgcaattgatgggtacgtcctgtatgtgggtagaggtaaacacgagttcggttttgctccacttgcacggtttcccaatgagtgagtgcaggcttaccttgctgccagcacactttttgtcttggtctatcatccagatcgccacacaaaggcaactggatctcaccttgtgtttcgcttaattttccttcgataagtgcgacatagcgcttttggacggcacgagaaataaactgcttttgcaactgtttgttagcacgtcgcgtcagcgcaaacaccaaaagtccagaagtagacatatcgagacgatgtagggcaaataccccttctgcttgggtaaattgagcctttaagcgcgtcaacacagaatcatgcacatgcacaccggggacagagagaaattcagcaggcttattgaccactacgatggcgtcatcttgatacacaatggtgatgtcttgaccttgcgccggattgctgagcagtggattatcttccagcggcatcccttctaacatgtgcgccaaaatcggttggcatttactctgacatgcaggatagaacttcttatgctgacgaatttccgatttgggggagcgcccccaccagaactctgccaatgcaatgggtcgcagctgatgttggaacgcatagtgtaatagttttggagccgcgcactcgcctgaacctgcgggtggaagcggatttttggtcacggaaaatagctcaaccaaatccttttcaacgccacggatattggtaaaacgataggcggagaacagttttttctgcagcgccgcagagcgctgtttacgttgctgtttcagttgctcaatgcgcatgagtttatgatctaacctatgctgtaaagccgcaatacgctgttcccactcttgtttgaggcactgtaactgacgcttttgttgcacactttcttccgctaggcgagccaacagagtgtgtttttctttttctggtagctcttctgcttgtaagcgctgctgttttcgaaagtgacgctgcttgttgtgcaatatacgccgctggctcagctcatgctcggcttgtaactgagattgcttaagggcactagcgagttccgcaagctccggatcagtttcttgctctcgcacttgttggttaatggccgcaatctgatcgccatccactctgaaaaaagacgcatcagcaaagcgatcaaacacaggaggaacaaatcccggcagccgattttgttcagccagttgaccagagaacgccgctaaataacccaaggttccagagcgatgctgcacaaccagtactccaaacattttgccgtgagcttgtgggtcggtttccgttaaaccaaaagggtgataccaatcggtttgagtgagcaaatgttgctgtagctcatcggccgcaatttcagacagtgggtgtggctgataacaaaatggaaaagtaaagcgctcgggtagcgcgatatgagcgatgacagaagtgaaacgagtgaagcaatcgggcagtgcagacatacaaatgacagagtgggtaaagcaaagacgcatcttacctgcttgggtgaaacttgtcagtctatgtttctattggtgattgttgacctataccgtgcctacttgaagttgcagcgatatgggttacgttcgctcaccccaatcacatagtttatttatgctcatgatgatgaacttacttgccacctttctgcaacaccaagtagtttggttatcgctctttcaacttacaacagttcaatgtagggatatttgttcaccctaattaatggtcgatgttacatttcaaaaacatatcatttccaaatgttgtatttgcctgttatatcatcaatatgagtgaattctggccaaatgttcgtgataaagggttattgactctaatgtatggtctaggattcgcttaagtaaaaattgcttaataagaatgaactaattaatcctattaaactctgcgactaagttatgaggctgaaagggtattaatttaatagatttctcaattaggagataatgaaataacactattaactttattcacttttaatattcactttaaatgaagaagaaacgcaaaaatgaattgttttatattttcctgacgtttctatgacaatttttcctttcaggtaagatcttgcccgcctagcagggaggtgttgtttttgggcaatatattgcccagtcatgaggttgataagcaaaaatgacctcccaaagtatggaacattaattgctttaacacattttactaaccgatgaggacagaatatgggtaacggaatcgtagtagggcatttaggtacagatcatgatggtttcccgccaacgccagtgaccgcaggctcagcaactgtgcgttatgatgggattccagctgctcggcttggggaccccttggcccctcacgataaaccaaagcatccctcgcatggccgagcgattgctgcgggttctgggacggtgatgattgatggaaaacccgcagcaagggttggagatgcggtcgattgtggtggcgtattacagggagcaagcagtgtcaacattggttaagactctgattttcatcgtaactcttctgtttataggacgtagttttagcgaagaaaaaaactacgatatgcagcagttgagtgctcagcaagcctacgaaaatggtcgtttgctacgtgcgcaatttaagaacttagcggctcgcgaatatttgaaatacgcggcagaccttggtgagcctaatgcggcttatctttacgcgatggaagtggccaactaccgaactaccattcgaaccccgcctgaaagccagcactatttattgctcgccgctcaaggtggaagccgtcaagcgatgcgagtgttgtatcaaaacggtgagtggctcagagctgcagaacgcagtttatggcaacaaacttattacgatactttgattgaattaggctctcgtgaaccgagtcaggccgcttatgagctcgcgctgttccatcaaaaggataaccccaagcttgcccagcattatttaacgattgcagttgaatttgaacaccccgcagctctgatgcttatggcgcaacagattgagcaaggagagggcagttatcccatgcctggtagccgagcaaccgaagctcgaaaaacgtatctgaaagcggcgcaaacgggctatatccctgcgataagaaactatattcaacttcttgaaaataaaggtaaataccaagatgcctattattggcgccagcaggcagtacagcgtggcgatctcacttctttggtggcgatgggcggtattctcagtggacagagtgagttttatcgttttgtcgagcctgatcttaagcaggccaaggcttacttcaatcgatatttagaagtggcaggcagcgatcgcttgagtcatgtctaccaaaatagccaaaagcaactgctcgatatttcaatgcaattaaatgggcatgagaaagaaattgcagagaaaatagagcttcaactcgaaaattatcagccttttttcaaccatgatgcttactgggataattagttccctgttaagtattatttaagtatggttattggatatattttggggtaaaagatcacgcttcgggttttttttcgattacttttttgtctccatgaatagaatgccatctcatatttattgggtattagatcaccgcaaacaatatttataccagataactgatacatggcagcaaaaagctgctaatgataagtttgcataataagcccatttttcatcaatatatcaaaatacaacaacactctgtgacatggcttagtgtgggatttattttctcacagtgtcacggaagtgattgactctatttcatattttgaaatgagagcccttagttatcactaaggataagttcaagattcttggttgattgaatgatttcaatcaactgtttcattgacaacgtttggcataggtattggagacgtaatatgtctaaagaaggaagtgtagctcccaaagagcggattaatatcaagtatattccggcgacgggggatgcacaggctgaggttgagctaccactcaaaaccctagttgtaggtgatttcaaagggcatgcggagcaaaccccattggaagagcgtgcaacagtcacggtagataagaacaactttgaagccgtaatgcgcgagagcgagctgaaaatcaccgccacggtgaaaaacaagctgactgatgatgagaatgccgagcttcctgttgaactcaatttcaaatccttagccgacttcgctcctgatgcggtggcatcacaagttccagaactgaaaaaattgattgagttgcgtgaagcgttagttgcccttaaagggccgctaggcaacattcccgcatttcgtgagcgtttacagtcattactcaactcagaagagtcgagagaaaagctgttggcagaactgaatctgctcagtggtcaagaagagccacaagcgtaagcaaacgttattaatcaattaatcactcattaggaacttaatgatgtctacgactgaaaaggtattggaaaggccacagcttgctcaaggcagccttcttgatgaaattatggcgcaaacccgtatcgcaccaagcgaagagggttacgacatcgcgaaaaaaggtgttgcagcgtttatcgaaaatcttatgggttcacaacactctgctgagcctgtcaacaaatctctggttgaccaaatgttggttgaactggataaaaaaatcagtgcacagatggatgaaatcctgcacaactcacaattccaagcgatggaatcggcgtggcgcggtttgaagctgttcgtggatcgcactgattttcgtgaaaataacaaagtcgaaatccttcacgtaaccaaagatgaactgctggaagatttcgagtttgctccagaaacggctcagtccggtctttacaagcacgtttattctgccggttatggtcaatttggtggcgaacctgttggcgcgatcattggtaactatgcgtttaccccttcaacgccagatatgaagctgctgcaatacatgggcgcactgggtgccatggcgcatgctcctttcatttcaagcgtaggtcctgaattctttggtatcgactccttcgaagaactgcctaacattaaagatctcaagtcgacatttgaaagcccgaaatacaccaaatggcgttcactgcgtgaatcggaagatgctcgctatcttggtttgactgcgcctcgtttcctgctgcgtgttccttacgatccaatcgaaaatccagtgaagtcgttcaattatgcggaaaacgtcagtgcttcgcacgagcactacctgtggggtaacacggcatttgccttcgcaactcgtttgacggatagctttgctaaatatcgctggtgtccaaacattatcggtccacaaagtggtggtgcagttgaagatctgccggtgcatgtctttgaatctatgggtgcattgcaaagcaagatcccaaccgaagtcctgatcacggaccgtaaagaatttgaactggcggaagaaggttttattgctcttactatgcgtaaaggcagtgataacgcggcgttcttctctgcaaactccattcaaaaacctaaggttttcccaaataccaaagaaggcaaagaagcggaaaccaactacaagttgggtacccagttgccgtacatgatgatcatcaaccgtttggcgcactatgtgaaagttctgcaacgtgagcagatcggtgcttggaaagagcgtcaagatcttgagcgtgaactgaactcatggatcaaacaatacgttgctgatcaagagaacccacctgcagacgtacgtagccgtcgtccacttcgtgctgcgcgcattgaagtgatggatgtggaaggcaatccaggttggtatcaggtgtcgctctcggttcgtcctcactttaagtacatgggtgcgaactttgagttgtcattagttggacgtcttgatcaagcctgattatgacgtacatcgcacctgaagagagtgcatttggtgttggctttttcgaacgtttggaagccaacgccaaacctatgtcgctgacccgtgggccagacgcgtgggatgtactcgaatcgatcaaacggaatgtctctaacattctgaacactcgaattggtggagcgcaaagtgcccctcatctcgggttggtggattttaatgatgcaacgctggaaaccttagatctctccgtgcgaattaaattggcgattcaacagtgccttgagcgctatgagccgcgtttaactcgcgttctggtgagagcggatcaagatagctttaacccgctgactttaaggttccacattaccgcgaccatcaatagcgaagcgttacacgaaaaagtccagttcagtctgttattggatcaaagcagaaaatatcgagtgttttaacctctatgacgcaagacaagtatttcagggaagagctcgcttttttaaaagagcaggggaaagaatttaccgaaattcaccctcagctttcgcgttttcttcatggccgtacgaccgatcctgacgttgagcgtcttctggaaggttttgcatttcttaccgcgcgtttgcgcgaaaaggtggaggatgagttccctgaacttactcactccatcattaacatgctgtggccaaattatctgcgccctatcccgagcatgagtgtggtggcgtttgaacctgacaaaagtgtcagcgagaagcaagtcatcccacgtaatacccaattggatagcaagccagtctttggcacggcgtgtcatttcaacacttgccgtgatgtcgcgctgtatccgatgcagtgtcaaggtgttcatgccgagcacacacgtgaagccacgaccattcagatctcgttgcgcatgctgggcgatatgacagtaggcgacgctaagctcgataccgtacgtttttacttaggtggtgataaatacagctcgcagactctctatctttggttacaccattatctacaaaaaatgaccattgaagtgcaaggtgtcgagttcgcactgcctgctgatgcgttttcaaccgttggtttctcaagtgaccaagctttgctgccttatccaaagaatgtctatgacggttatcgtattttgcaagagtacctgtcgtttcctgaagcctttcacttctttgatgtaaaaggttttgccaaagctttaccgaaagcggtcagcggtgatttcaccttacgcatccatttttcgaaaacattgcctgctgatacgcgagtgcgtcaggacaattttcaactctattgcacaccggtcatcaatctgtttgagcatgatgccgatccgatcgatttgactgggcgtcgttcagagtatcgaatcgtcccgtccagtcgctatcctgcccactatgaaattttcagcgtggatcaagtggttggttggcaagatacccagtcagaaggcaaacggatccgcggagagaagcgtatctactcttcttttgaaagcttccaacatgaagtggaacgggttcgtcatcgtcaagcgctttactatcgcacacgagtcaaagagagcatccggggggatggttttgattcatttatctcttttgtgcgcggtgatgaaaccttatcaatgggcgtagatgaagccgtctcaatcaaactcacctgcaccaatcgcttgctgccattggaacttggggtgggggatatttgtgtggcgaccgacagctcacccccttttgccacatttaaaaatattacggtgccttcgcagtcactgcgcccggttctcgatggcagcttactgtggacgctgatctcgaatctatcgctgaactacctatcactgctttcaaaagatgcactgagctgtgtgctacgcgcttacgattttcgcgccttggtcgataggcaagctgaacgtgtcgcacggatgcgccttgatggcatagtcaaaatagaatctaaaccggttgataaaatcctacgtggtttgcctgtgcgtggtttgcaatcgactttgtatgtcgatcaagcgggatttggctcggaaggtgatttgttcctgtttggtacggtactcagtcatttctttgcactttacgccagcatcaactcatttcacgaattagtcgtggttaacatcagcaatcaagagaagtactcatggggcacacagagcggaatgcagccgttgatctgaattcagatccagcgcaagcctctccgttgagcttgccgggcaatgtacgggaatacaacttctaccaactggttgagctgttgcaaaaactggctgatatcaatcccgaatcggaagagtgggagcgcgattgccgcttggtgttcagtgctaacccgagccttggattttcgcccagtgatgtgatggcgcttgaagcgcgtgacgatgagcgttgggttatgttgaccaacttttttggcctttccggtgcacagtcacctctgccggggttcatccttgagcaattggtgacggaagagcctgggggatataagcagccgtttctcgattttttcaataaccgattgattaatttggtttatcgcgtttggcgtaaataccgttactacgtacgttttcagcccggtgcgcaggatgtgttctctgcacagctgtttgcgctggtggggttgggcgatcctgaccttcgcggtgaaacgccgatcaactggtgcaaaatgctggcttacgcgggcacgctggccggacgtagccgttcgccacaagttgtggccggcattattgctcactgttttgatttaccggatgtctccattcgccagtgggtcagacgtcgggtatcgattgatcggagtcagcaactggcgctgggcaagcagaatgcgcggttggggatggacacggtgattggcgagtccgttattgattgcagtggaaaatttattatctgtatcaaacggttatctcgcagtcgttttgctgattttttgccctccggtaaagagtatcagccactttgcaagctggtggagtttattttgcgcgaacagatggcgtatgacctcgagctggcgatggatgaacgagaagcgccgctgttttgtctggatactagacagaatatcgccctcggctggacttcgtttcttggccaagatgcagccaataaacatgtgttaattcaagtaaggcaataaccatgaactcagtgacattaccttcgttgaccctattagtcaccaatgctcagcacttagagtctggcttgtccgctcagcatacgtggacctcgtcaggtggggtgatcggctcatcgccgaatgcgcagtggcgtttggtcgatgcgcaaggcagtgtaaaacccatgcactgtgaagtgatgatggtagacggggcgtattgtttaaaagacagctgcggcagcacgtatgtcaacggggcagacatgccactgggcgttgggcaaatggcacgtctgactcacaaagatgaagtgagtgtggggccttaccgtttgcgagtgctgtttggtaacgccatcgaagtggaagaacaatatggatctttagatgcgctgtttgcctctaaggatgaggatctgctagcggatttgacgctcgacatcgaaccagaaaaacacgaattaccaaccaatacagacccattacaggcgctcgataacctgatgggtgcggcgggcagttcgacctccttactggatgatcctaaaagtgagcagccgttatccgcccaacctagcctcgtgccacaagataacttagtgctgcaaaatgccgattttacgccacaagcggacagtgagtatgagatgacctcatcgatccgccttaagaaaattcttggttttgcgaaggccacctttgctaagcaaaccaaatcagaagcaccgaacgtgacttctgccacccccacaatttctcaatataaaaccagcgaaagcaacgtatcagagggcttcacaatggatgaaaaagtactggatttgttagaagaggaagtcgcgaaaagtttccaaccgcagttggagaaaagcgcgtattccactatgcacacaagctcaaccagccaagctaaccacttggtgacaggtccgatcttggaagggctcggcgtagatctgagcgatgaaaatgatatgaatcgtatgcatcttttatcgcaagagttgggtgagtctttgcaagcttgtgtgcgcggtttactcgatttgcatcaacaagtgagtgaaagccgtttcggtactttgaaccgtaatctgcaacccattgaagataacccgctgcgtttaggtctctcctatgaagagacgatccgcactctgtacgatgccgacaagagcgtcgtgcacctttctgcccctgcggcgattgctgaaagcctaaaaaccgttcgcgatcataatgaagcgatgcagttcgccacgtcagaagccttgagccaaattctcaacgctttctcaccacaggtgatgctgcgccgtttccaccactacaagcgcaattctgataccacacaaacttcaacggatgcttgggcgtggaatatgtactgcagctactaccaagagctgacctctaaccgccaacgcggctttgagaagttgttctgggagatctttgagcaagcctacgatcgcaaaattcgcgagaagcaactggagctataaccgtgaacaaagtgctgtggatgctgtttgccttgacggtactgaccgcgtgcagttcgtcggataagtacgagcctgcgaaagagccgaccaaggtgacttttagcttagtcagcgatgaaggggtgaacccgaacatctggggtgaagcgtcaccgatagaaattcaagtttttgagctaaaggatgactcgatgtttatgtcgtccgactacgaccagatcaaaaccgattataaaaaagcgctgcgcagtaactttgttaaaaactacgactatgtactgactccagggcagttcaaattcgtcaacgctttcgaagtcgatgaggagaccaactacatcggcgtgatggctcattttgccgagcctgaactcagcgaatggaagaaagcggtcaaggtgatcaataaagggcgagagtatcacttgctgatgctgtttaaagactacgatgtgaaattggatagggtggaataacaaacgatgtttgcgcgtaaccgagtgatctggaatgaagggctatttattaagccgcaacatttccagcaacagcagagatatacggagtactgcctagacgagcgcctgagcaccgtgagccgttacttgtatgggatttccgagttgtcgctcaacccggaatacctctcgtttggccgtattgcgattgagcgtgcggtcggcgtgatgcccgatggcaccacctttcgtattcctcaagaagatcatcttcccgatgcgctcgaagtgaccgatgcgtcattggcaaaccagattgtctacttagccgtaccgctacgtagtgagtcgctgatggagattaactggccagaagagcgtggtacggggcgctatgtcagccgtcgtctcgaagtgcgtgatgtccatagcgtgcagggtgataccacgacgattgatgtttcccctgtgcgtttgcaactcatgcttgagcgagaggatcgcagtgcgtatgcctcaattgctattggccgtattttagaaaaacgtcctgatggcagcgtggtgctcgatccggatttcatcccttgtcacttgaatgtagtgggcatctctgcgctgcaccgctttattaatgagatgtcaggcctgatgcgtgagcgagcgaaaaatattgctcagcgcatcagctctccagcacaaggtggggttgctgatgtttcggactttatgctgctgcaagctttaaaccgtctgcaaccacaaatgaagcatttggcagagctgcgcagcttacacccagagcgtctgtttgaatgtctctcgtgtgtgtgtggtgagctggctacctttactgacgaaagtcgtctgccgcccagtttgccaagctataaccatgattcacccagccactctttccagccgctgatccgcagcttgcgtcagagcttgagcgtggtgctagagccgcgtgccgtctctatccaactggataaacgtaagtacggtttgatggttgcgccaatccatgatccgcaactgatggagagtgcagagtttatcatcgcggttaaagctcgcatgccgttggatgagctacgccgtctgtttactcagcaaaccaaagtggcatcggttgagaaaattcgtgaactcatctcactgcaactgccgggtattccattgacgccattacccgtcgcaccgcgccaattgccttaccacgctggctacacctactaccaactggataaaaccagcgctgcatgggcgatgttgactcattccagcggttttgcgttccacgttgctgcagcttttgacgatcttgagctgcaattctgggctatcaggagctaaccatgtcacagagtaaaaaagagacgccattagccagtttgttgttcgacgatgtggaaaaaattaaccacgaccaagactactggttccaattgcgtggggacaatccgaatgtgctgattgatgccgcgacacccttgtttgggctttctctgcgggttcgtaccctcaccgaatgcgacaacattgaacagatctaccgtcagacgattgaagagatcaaagcgattgaaattgagttgacggagcaaggttacgaacacgccattttgatggcctatcgctacatcttgtgcgcctttttggatgaatccgtgatgggaaccgagtggggcgcgtccagtttatgggccgagcactccatgctgtcacgcttccataatgaaacgtggggtggcgagaaagtgtttacgattttgagccgtcttgagggtgaaccacaccgttaccaagcgctattggcctttatttatcattgcctgattttgggctttgaaggcaaataccgtgtgatggaagggggacaagctgagcgcgaaaaagtgatcagccgcctgcatcaactgctgagcagcttggaagagagcgagccacaagacttaacccgtccgaccgatcatgtggtgcgtgcgaaatataccctaagcagacagatgcctgtttggtctgtgtttgctggctttatcgtgctttgggtaggtctatttctcggctacagctatgtactgcatagcaaatccagcgatgtgctcaatcaactcaatcaaatactttaaacataattaggctaggtggtacgttgtgatccgtattgaattacccactcttattgcaaaactgaatgcacaaagcaaattggctctggagcaagctgcctctctctgtattgagcgccaacaccctgaagtcactctagaatattatctggatgtgttactggataatcccctctctgatgtgcgtctcgtactcaagcaagcggggctggaagtcgatcaggtgaaacaggccatcgcatcaacctatagccgtgaacaggtcttggatacctatccagcgttttcgccactgctggtcgagttactgcaagaagcttggctgctttccagtaccgagttagagcaggctgagctgcgttcaggggcgattttcttagccgcgctgacccgtgcggaccgttatctgtcattcaaattgatcagtttgtttgaaggcatcaaccgcgaaaacctcaaaaaacactttgcgatgatcttaagtgattctgcagaaaccgcagtggctaaaacagacaaaaatgcggccaatccactgcaagccgccgcagaaacaccactcggacgcttttgcacgaatgtgactgagcaagcccgtaacggtgagcttgatcctgtcctgagccgtgaaaatgaactcaacttgatggtggatattctgtgccgtcgccgcaaaaacaacccgattgtggtgggtgaagcaggtgttggtaaaagtgccatgattgaaggtttggcgctgcgtgtggtggctggcaaagtgcccacccaactgcaaaatgtagaactctattcgttggatcttggtcgcttgcaagcgggtgcatcggtgaaaggcgagttcgaaaagcgcctaaaaggggtgattgatgcgattaagcaatcgcctaaaccgatcattttattcatcgatgaagcgcacaccttaattggttctggtaaccaagaagggggcagtgatgcggcaaacttgctcaagcctgcgctggcgcgtggtgagttaagcacagtggcggcgacgacgtggaaagagtacaaaaagtattttgaaaaagatcccgcgctgacgcgccgtttccaactggtcaaactcgatgaaccaacgatcgatcaagccgtcgatattctgcgcggtcttaacagtgtctatgaaaaggcacacaacgtactgatcactgatgatgcactaaaagctgccgctgaactgtcagcgcgttacatctcaggtcgtcaactgcccgataaagcgattgatgtgctggataccgcttgtgcgcggattgcgatcaatatgaccacgccacctaagcgtttagcgctacttgaaaccttgtgccatcagcgtcaactcgaaattgacatgctagagcgggcgcaattccttggccaagaggtcgatagcgagcgcctcgatgttttgcgtaatcaagagttggccgatgaagcggaaaaagccgcgttgacacagagttggcagcagcaaaaaagcttggtggagtcgatcatcgcactgcgtgctgagctgatggagttaagccaagcgcaagagcaagatcccgaccatttattggtggtgcgtacggcgctgcaagagcagtatcaagcactcgatgcgattgatcatgctgagcgcttgatgcacccgcaagtcgatgcggatcagattgctgaagtgatcgccgattggacgggcgtgcctgttgatcagatgaacaccgatgagctgcataaaatcacccatttgacctcgattttaggccaagcgatcaaaggccaagaaacggccatcgaacgtatccatcgtcacttactgacagcgcgtgccgatctgcgtcgtccgggacgtccgaaaggggcattcctgctggtggggccaagcggtgtaggtaaaaccgaaacggtagtgcaactggcagagcagctttacggtggtaaacagttcctcaccaccatcaacatgtcggaataccaagagaaacacaccgtttcccgcctgattggttcacctccgggttatgttggctacggtgaaggcggtgtgctgacggaggctatccgtaagatgccttattcggtggttctgcttgatgaagtcgaaaaagcccatccagaagttttaaatatcttctaccaaggctttgataaaggcgaaatcgccgatggtgaaggtcgtgtcatcgactgccaaaacatcgtgttcttcctgacatcgaacttaggctaccaaaccatagtcgattatgccgatgagcccgccaagcttgatgaagcgctttatcctgaattggccgctttctttaaacctgctctgctggcgcgtatggaagtgatcccttacctaccactgggtaaagaagtgttggcacagattgttcgcggcaagctggctcgtctcgagaaactgttcaagacacgttacaacgcagaagtggtgattgaagagagcttaattgacgaaatcttaagccgtgcgacacgcagcgaaaacggtgcgcgtatgctggaggcgatcattgaagggcaattgctgccgcccgtttcattggcgctgctgaataaactcgccgagagagcgcccgttgagcgcattcgtttagcggcagaagcgggtgaatttatcggagaggtagcgtaaccatgagtcaatggctggcgtttgcaacccaattggtgggagtaaggaagtcccaccagcttgcgctgcaatttgttgatctgctgactcaaggcttagatctgagtgatagccttttgttgttgccatcgtcggatgggcgtttacttgtgcctcatgatccacagcgtcagttcgcgtggtcagtgacggattttgatgtgccttttgcccatgttttgcagtcatccaatgcgatgcatttgaccgcggaagagttggtattttggcaatccaatcgcacttttagccagttaacctctcgcgtggggatgtttgattcggtatggatccaacccctgccgatggatactcgtcaagtacactcgatcttgctgttgatgggcgagagtcacggtatcgtgagcgcttttgaaaacgcggactttttgaagtttatcgaggttttttcccagcaatggtcactgctcaacgatatggaacgtgaagagcagcgccgcttggagctgaaacaatcgctgacggatattgaacgcgactcggcgcagcgctcactggccaatgcgttatcgcgtactttgattggtgaaagcgctgcgatgcaaaagctgcgtgagcagattgtctctgccgctaactctcagctctcggtcatggtgcaaggtgaaactggcacggggaaagagttagtcgccgcggccgtgcatgaactttcgtcacgtaagtctgcgccgtttgttgcgatcaactgtgcggcgatccctgagcatctactggaaagtgaactgtttggttactgcaaaggggcattttctggagcggacagcgataaacagggacttatcgcacaagcgaatggtggcacgctatttctggatgagatcggcgatatgccgctcaccttacaagccaaattattgcgtgtgcttgaatcgcgtacttttcgaccgctcggtggtaagcaggagctcagttccgatttccgtctggtatctgccacacacgtcaatctgctggatcaagtacgcaaaaaagaatttcgccaagatctctattaccgtctattccagtatccgatcaccttgccgcgtttggcggcacgcttggaagatattgagctgctcagtgagcactttgtgcgcgtgttcaacttgcaacataacacgcgcattcgtggtttgaactatcgagccatcgactgccttaagcagtacgacttcccgggaaatgtgcgtgagctgaaacatttgattgagtttggctgcgcgcaaacagcggatggtacgcaggtggaagctagttgctttgcccatcgtttacaaaccctaccctgtcttgcgcctgaagcgacgccggtagccgtttctgtcgaaactgagaacgtggatcttgaaccctcggttgcgctggctggagaaccgaattttgcggttatccatgatttgaaacaggcggtcagtcagtttgaagcgttgatcatcagtgagcgtttgaaccgctttgctggcgatcgcgcgaaagcggcgaaaagtctcggtatccctaagcgtaccttggcctacaagtgcctgaaattggagatcaaaaccccatgagaattaccgttttagtggtcagtttgatcttgggttgcgcgggctctgcgcatgttttagcagcatcgcaagatgcgggctcacaggttgagcaagctgagctgtgccgcgaaattcctgcgcgtttagagcgtttggcttgttttgaccgtgtctttgccacgccccttgagcaagtggctatcgcaccgtccaatccttatcccgcagagtggcaacgcgccatggcggcattgtctgagtcgcagtccgaagcgggttgggtattaggtacgcaaggtgaagggcggggcagcagcgcttggattgctttgcctgcgcaaaatcgcagctcaggggaaacatctccgccagtgctcttgctcagttgcattaataacctgagccgcattgagctggctttaccgaaagaagtggctgatgcacggattcaagtctctatccgacacgagacacagttctggcgcagtgacgatcacggcgtactgttttcctcggctcgcggcatgcctgcgatcgaaatgatgaaattggccgccagtgagtctcgcctgttgctgcgttctaatgcgccctttgctgacgggttacagtttgatactcgaggtgtcaatgaagcccttgatgctttgcgcgaacgctgtggttggtaaggagcccgtatggaaatgactgaataccgtcagtgtgtggccaaaccgatcagcagtagcaatcctgtcggagagcggctagtcgatcacccactgtttgattttattgaggatcagatgatgaaagtgggctctctctctcacgcttcagtgcagtgggatgaagtggagcacagcactctcaaactgcttggtgaacagagtaaagacatcaagcttttggtttacctgctgcagtgtctgcataaccaagttaccccgacgcgccttattacctcgtttgcggtgatgagtgagttcctcaatcaatattggaacgacagttatccagcgccgggcccacgtggcaatctgccgcgacgtaaatttttcagccagatggcgcaacgttttaccacggtgatcgaaaagttcgattttcatcatctggatgaagcggatcgccaagcgctacaagcggcggttgaagagtggcaacaagccgttgagaaacaagggctctcttctgagttggtggagtctgtggtggtgcgaattaccgcggagatcaaacgcgcagagcagcgccagcaagtgacggcgcaaagcagcgcggagcgtgaaacaccaagtgctgcaacgccttctcctgcggcgagtatggtggtggatcattcgagtgacaaagcagcgaaacaaaccctactcaaagtggcagattttcttgccgaacaagagtttggtatcgctctttcgattcgtctgcgccgctttgcggtgtggggcagcattacctcattgcccgatcataaacccgatggtgaaacactgctgcgtggaatgcaggcggatcgcgtcaaggattaccaagatcaacttcgtcaccccgatttagccttgtggcgcaaagtcgaacagagcttaaccatggctccttattggtttgaaggacagtggatgagttacaccattgcccagcaactcggcaaaagtgattggtgtcaggcgattgccgaagaaacacaacagtttttacgtcgtttgccttcgctgcttgagctcaaattcaaaggcggagagccgtttgtcagcgattcggtcaaagagtggctggcgagcgtaggtcagagccaaggtgctgcggggcaatcggtcggcggagattggcaagagaagcgtaaagaggcgtttcaactggctaaagaaggtggaatcgcggtggcactttccatgctcaatgatggcttggtcagtgcggtggagccgcgagacaaattttactggcgattgctatcggcagatctgctgcgggcaaatcatctcgatgcgatggctggtgaacagtatcaaactctgctcaatcaggtaacgacgctgtctgttcctgagtgggaaccgagtttagtggaacaaattcaaagatatacaacgtcagagtaaacaaggacacaattcatgtggaaattcattgttggaatagtaaggcggcttaaacccacggtggtggcagcacttcccattttgctattcactacgttcattttgctgaacgttgccatttggtgggcaggcccttggttagaagtggctggctataaaccgctggagtcgatcatggctcgagttgtggcaagcagtctgtttactctcggctgtttagccgtgtggggcatttggcagtggcgtaagttgcaagccttcaaatcggagcaaaagcgcgaagagcaactgcgccaagatccgatcaaggtgtatgagcagcgccaagaggttgaactgaatcaggtgatgctcaatatgaagcagagcctaaataaacacaactacttgtatgcactaccttggtatttggttctaggtttagaaaatgcgggtaaaaccagcctgatcaaccgttctggtcagaactttgtcttctcttcggtcatgcgagcttcgggacaaaaaagcgaaaacccatactcgtttgattggtggattggtgatgaatctgtcctgattgatcctgatggtgagctgttaacgcaaggcaatcgtagtgaagaaaatgatggtgcgttagagcgccgcttatggttgcattttgtcgattggctagaccgcactcgtagccgccgcccgttaaacggcatcgtgttggcgttggatgtggcgcatcttgctaccgccaccgcctcagagcgtaaagcttatgccaatttgctgcgtgctcgtctgcgtgagttgatggaaaccttatcgactcgtctgccggtgtacattgcactgactaagctcgacttactgcacggttttgagcctttctttaagcactacaccaaaagtcagcgcgaagaggtgttgggttttaccttctcaatggattcggtagataacctagattcatggttggaagagtttgccagtgagtacactcaatttgtgtcacgagttaatggcatgctgccgcatgcggtcgcagcgccaatgacgcttgaagaacgtaacgcgatttacagcttcacgcgtcaaatctcaggtttgaaagagattttgcaacagtttttccaagaggctttggcgagcgatcaattctcaacgtcagcgctggtgcgtggtgcctatttcacgtcggtttaccaacaaggtgtacctaccaacgcttttgatgatgcggcttcccgtcgttatggtctgtctcatgcgattaatacggcgcagcgcgcgaaaaactccacggtctatttcacgcaaaaactgtttacccacatcatttatcctgaagcgggtttagcgtcggataatttccgggttgcaaaaaacaaacgccgtttgatggggctctcttttgtcgcatgctcagtggcgactttgctgttggcgggaacttggcatcgtaactacctcaataacgtgcaacacgccgatactgtattaaccaaagtgaatcagtataaagagcagttcccgaccagccgttcattggcctcacaaagagaggtattggatccgttgaacaagatccgtgaggcgacactggagtttggtttcttccgtgataaacctcagtacatctccgattttggtctctaccaagggcacaccattggcccgaaagtagaagagacctacttaaacttactcgaaactcgcttcttgcctctgttgatggcggacaccattgttgcgctcaatcaagctgagacagatgaagaaaaattagcggtgctgcgtgtgtatcgcatgctggtcgataaaagtggtcgttaccaagactatgtgatggattattttgcgaagtattggcaaaaatccttctcaggtcagcgtcaaattcaggaagagctgctcggccacttagattacgcgatgcgtcatacggacctcactgcagagaggctcaatggtgataaaggggcggagcaggtgatgcgcccttacgataaagtgattgctcgtgctcaggttgaactgggttcaatgccaaacgaccagcgcgtctatcgtaacttgaaattgagcgcacaaacggtgcttggtccttcggttaacttgcgtagcttgattgggccggtgttcgatgtggtgtttgaagagcgcgttcttaacagtagcagcctgtttattcctcaaatgctcaccaagcgtggttttgatgactactttatgccgcaatctgaatcggtctctgagctggcactgattgacagttgggttctgggacagagcaaaacggcacagtttagtgaagcagacaagcaggcactgcgcgaaaaaatccgcgatctttatgtggcggattacaccaacacatggcgcgcggcactcaatgaaattgatgtgaagtatttcaatgacatcaatgatgcggtcatggttttggaaaatatcaccagtaaccttgagccgatgcagcgtctactgcgcacattagatgacaacacccaactgtacagtgcgttacctaaagatgaatcggcgttaaaagagctgctgaaaagtccgaaatacaaagtggcttcgatgattgaaactccgtttgctgatctgaacggtatgctcaaaccggtgggcagcaaaccagcgtacatgacggaagtcttggcttcggtggatgagctgaaaagctacttgaaatcgattcaagatgctcccgatgtcggtatggcggcgctcgatgcgaccaaagcgcgggtcaaactggttaatgctgaccctatctataccttaaaacgtatctcgtcaggactgccgaagccgctggatagcatgatggcaaagcttgcagatgagagctggtatgtggtcaagcaagaagcgatcaagcatctggaagttcgctggacggaggatgtgtataaaaccttccaaagcaagctggctgggcgttatccattcaaccccgcatcaaataaagatgttgccttggccgattttgaagccttctttgcgccgaatggcacgttagacaacttctacaatcagcaactgaagatgtttattgatgagaacatcagcgtcgcgtcggatgactcagcgcagtcgatcattcgtaaagaagtgctggatcagatcaagcaagcgcagaaaattcgtgaggctttcttcaaccgtaaagggattttggatgtcagcttctcggttgagccgctcagtttgagtaacaacaagcgtcgtagtgtgctgaatgtggatggtcagttcttagcttacagccatggtccgcgtgaaaatgtggagctgatttggcctaacacgctgcgtgattctgcggtgtctaaggtgaccttgattccaacccaaaccaatatgtcaccgcgcagtttgcaaatccaaggaccgtgggcattcttccgcttattggatcaaggtgatgtggtttcggcgagtcaaacgtcggttgatttcaaatttatcgtcgatggcggtgagatgatctaccgtattaacgcagaggccgatgccaacccatttaccgaacgcctgttcaagtcgttcaaactgtctaaaacactctattaataggttgccagagcgagtttttcgctctggctttttaggacgaagttgtgatgtccaatgtgatttttattgataacgtttgctaccgattaaccaatgattctgaggagattcgcggattagagccctatgcgaaggttcgtgaggagataaaccgccgcttcaatccgattgctgggggcacggattgggcagtggtaaaagagtactgtgaacaactggcctgtaaccaaggaatggattttctgatctgcggttactatgcggtagcctgcctgaaaactcaggggttagcggggtatgccaccggtatggagctgatgagtgcaagccttgccaaccaaggtgagtgtgatgtgaaaagcgccaaagtgcgcaaagagatccttgattgggtcaatgcacgtgtggtgcaggaactgaaagcacttaagccaacttatgagtcgctgcgagatctgtatcgggctgagcgccattgcgagcggttacatcagctgtttgaacagcaacaaaccgaatacaaagtagactttgaaggggtcgggtttgctctgtttgaacacatagacagaattgaaacccaataccacagcttattgaaaaagcaggagaaggctcagccacctaagcttaagttttggcagcgcggttacgcgttgttcactctaggtgtactcggggttgcactgggaatggtggggggctactgggggtggccttggttttataccacgccttatgccgcgccacagcgcatcactacgttgaatgaggcctctcaaactcaagcactgctcaacgactcttccacaagtgagcgtgcgcgttggcaacatgatctgatcccgctgtatcgcgatactttgcagcagaatttaaccatctcgtttagtgaacctaagcgacatgccatcactcagctgaatctattgcgcactctttatcctgaaaacgagcaagtgaatgcactgagtcaagagtttgcccttcagcagcaacaagcgttggagcaaaccgcgctgttcgtggctaagttcagcgaaattcgcaccaaaatggccaatatctcgttattggctaagcgagggaaatgggctgagttagaaaagcagaccaaatcattagaagagttcgcggtcagcctatcaccgatttatggtcgagttgactatgtgcaaggcctccttgaacagggcgatgtcacaaatgcccagaaagagtttgcgatcctcaaacaaaggctagatagcctaagttggaaaattgccgagcttgagcagcgtatcggcgatgcggctttgttgcagtgatggctgaaggaagaggtggggcaaaaactcgcttataggcagttttttgcttgattggggcaagggattgctcagtgataagagttaaccctggtgcgaaacagggaaaagtagacaaaaagctggcattgagtttgccattgactgccacacaatattttcaacgcaccattttcaacgaaccattttcatcgaacttaagatggccacatatcgagtgctatcgtcgaaaaaaagaacaaggaaaacagcatggcaaggttacagtttcaattaaaggtggatggccttgaggatgaatccctcgtcgtacgcggatttgaagggcaagagtccttgtctgattctgtatggcgctgtgaaccctgctatggttttcgctatcaggttgatttagccagtgcgctaagcaaccttactgctgagcaatttgtcgaccaaaccgcgcatttaaccattctgcgtgacgggcaagtggtgcagcaaattaacggtatcgtacgccaattgagtaaaggcgatactgggcatcggcacacgttttattctcttacgttagtacctgcgctggagcggctttctttacgcagtaatagccgtattttccagcagcaaagcgtgccggaaattatctctattttactgcaagagatggggattgaagattacgcctttgcccttaagcgtgagtgtgcccagcgtgagttttgtgtgcagtaccgtgaaacggatttgcagtttttacaccgtatcgccgccgaagaaggcttggtatacagtcacctacatgaagcgcagaaacacacgctactgtttaccgatagctcggacagccaaccgaagttagccaagccagtaccttataatgcgctggcgggtggcgagatcaatctcccttatgtggtcgatctgcaattcaagaccaccgcacaagtcagccataccgagctaaaggattacagctttaaaaagccagcttacggatttactcagcgcacgcagggtaaagatatcgcttatcagcagccaaattatgagcattttgatgctccgggacgctacaaagacgatgcaaatggcaaggcctttagccaaattcgcttagagtatttacgtcgcgatgctttgcttgctgatgcgaagagtgacgaacctttgctgttggcgggagtgcgttttgacttgcaagatcaccttgatcacgcaatgaatcgagattggctcgtggtacaagccaatcaccaagggacgcagccacaagcgttacaagaagagggtggttcaggcgctaccacttacagcaatcagctaaaacttattcccgctcacatcacttggcgagcaaggccttgtgctaagccgcaagtggatggtcccatgatcgccaccgtggttgggccacaaggtgaagagatttattgcgataactttggtcgcgtgaaagtgcatttcccgtgggatcgctactcaagtagcaacgaaaaaagctcttgctgggtgcgagtggcacaagaatgggctggtagccaatacggtagtatggcgattccgcgagttggccatgaagtgattgtttcgttcctgaatggcgatccggatcaacccatcatcacaggtcgtacgtatcatgcgaccaataccgcgccttacgccttgcctgaccacaaaaccaaaaccgtgctgcgcactgagactcaccaagggcaaggctacaacgaactgagttttgaggatcaagcgggcagcgaacagattttgctgcatgcacaaaaagattgggatgcgttgattgagcatgatcacaccgaagtgattcgccacgatcaacatctcactgtggacaatgatcgctttacccgcattcagcgcaaccaacatttaacggttgaaggtgaagtccgtagcaaaatcgcactcgatagcagccatgaagtcggcgcgtcactacaacacaaagtcgggcagcgcattgctgtcgaggcgggtaaagagatttcactcaaaagcggcgcaaaaatcgtggttgaagccggagcggagttaaccctaaaagctgggggcagttttgtaaaagtcgatgctggtggcgtgcacttagtcggtcctgccattaacctaaacgcgggcggcagtgcaggcagcggtagcgcttatggcgggcaattagcggcagcaccgagaatgttagcgcaagctaaaccagtagcagaattggttcagccggatattgcggcctcaatgcaatcaggcgcggcgcgtgttattgatgtggcatcactccccacaatgatgccgagttcagccaataacacggcaaatgatgagcctgtggccgaagagaaaacaccggagcgaattttaaaatccgatctcctcaaaccatccgatgagttagagaaactcgccaagcgacaagcgagtgcttatcgtcaaggtaatcacagcgatgaggttaagttactacaagaagcgctcataaaattggggtttgatctcgggaaagcaggagctgatggtgactttgggagcaaaactaaaaccgcgattgagcagttccagaaaagctatcaaccaagccaccaaacccacccgtcttacagcattggcgctgttgacggtattgtcggcaaaggtacactactggcactagacgaagccttgatggatgggtgggtgtatgagaataatatttatcaaatatggcctctaggtaaaacgtcagagaaatatgagtcggcaggaagaggcccaggggttatatcaacaggaaatggagattatggtggggcttcatatggttgctatcaaatgtcatcaaatcttggtgtggtacaaaaatatattcagtcatcaaaattcaaagaattctttagtggattaaatcccgctacgaaagagtttaatgttgtttggcaggatatagcttcaagatatcctcaggaattcagagaagaacaacaccaatttattaagagaactcattatgatatacaaataggacatcttagagggaaaggacttttgtttgaacataatcgagctgctgtacatgatttgatctggtctacttcagtacagtttggtgggagaactaatttgattttcaatgcattgaatggacaaaatatggaaagtatgactgataaggacatcattattctggtacaagattacaagcttgttaatacagaaaggctttttaagtcttcgccatcatggtggagtgatttaaaaaaacgtgcggtatcagagaaaaaagctttacttgaactagaaattgacggtttggaggttgatataaaatgaataacttgctttctgcgtatgtaactatgctgttgatattattaagtattagtggtggcgctattgctagtgaaaactgcaatgatacatctggagtgcatcaaaaaattctagtgtgtatccaaaatgagatagctaagtcagagactcagattagaaataatatttcttctaagtctatagattatggctttcctgatgatttctacagcaagcaaagattagctattcatgaaaagtgtatgctttatataaatgtcggtggccaacgtggtgaattgctaatgaaccaatgtgaactttcgatgctacaaggccttgatatttacattcaacagtatatagaggatgttgataatagttaggattagcatcacaaataagtttgtgataatgaatgctttgggtttactacggatttttaattaaatatcaatgatattaaaaatacatcgattaaattgagtcgttgtttaacccccagagcaattaaatactgggggttttccttctcacagcacacaatatttagcgtacgaacctgcttctttggctgtccagtcacctttggatttctcatccatatcttcgcaccaagatttgctaccgacttcattgttgaaaatgcagtgtttggcgaagtcgagcgtgtcttgagtattccactcgctttttggtttttcgcgcatatcttcacaccaagctttgctgcccacttcgctacaggccgaaagcgtaagcgtactcatgatcatcagcagagtgtttttcatcaattatcctcatcaaatcttcattacttgctgccactataccgaactgagatgccgctgtgttaaatcggcgcgaaatgatcacggttcgaccctatcactattcatcaaagtgagtattcagtacatcattttgctgatcgttttcacactctgtggatttgtcgcgtgcaaacttaattgagtaaactattatgtcatcgaaacgtttcgatgtgcattttttcgccaattgaaagtgatgctgtcgttattcaaacgtgaatcaataaaaggtatcaccatgaaaaaaagtaccctactaaactctgaactctcttacttggtggcaacactcggccataccgatgaaatcacgatctgtgatgctgggctgccaatccctgatgaagtgacgcgtattgatctcgcgctgactcacggggtgccttcttttttggaaacagtacgggtgattttgtctgaatcgcagattgaaagtgtcatcgtggcacaggagtttgctcaagtaagcccggtgttgcatgaagccttatatcgcgagctgaaagcagaagaacagttgtgcggtaagccaattgccatccaatacatcagccatgaagcgtttaaacaacgcacgctgcaaagccgcgcggtagtgcgcaccggtgaatgtacaccttacgccaatgtgattttccaagcgggtgtcgtgttttaaccacgcccaaccatggaggagccactatgactcaagcaattttagccctgagccaaattgaaaaagcgttccctggcgtgaaagccttggacaaagcgagcctgaatgtctatccggggcgggtaatggcgttaatgggtgaaaacggtgctggcaaatcaaccttgatgaaagttctgaccggcatttatagcaaagatgcgggcagcattgagtatcaaggccaacctgtcagttttaaaggcccacgagattcgcagctggcgggcatcagcattattcaccaagagctcaacctgatcccgcagctgacgattgcggaaaatattttccttggccgtgagatgacttcgccattcggacgcattctgtgggatgaaatgcatcgtaaagcggatcaactgctcgcacgtttgaatgtgaaacacagtgctaaaaccttgctcggagagctgagcttgggtgagcagcagatggtggaaattgccaaagcgctgtcgtttgaatcgaaagttatcatcatggatgaaccgaccgatgcgctgaccgataccgaaaccgaatctctgtttaatgtcattaatgaactgcgcgaacaaggctgcggcattgtgtatatctcacaccgtttgaaagaaatttttgagatttgtgacgacatcacagtgctgcgtgacggcaaatttattggcgagtgccgcgtgtgcgataccaatgaagatggcctgattgagatgatggttggccgtaaactggaagagcagtacccacgtattgccgcgcagcagggtgacatcagccttgaggtgattggcctaactggctcgggtgtgcacgatgtcagctttacgcttaaaaaaggcgagattcttggtgtctctggcctgatgggggctgggcgcactgaactgatgaaggtgatttatggcgcgctcccttcggagcgtggcgtgattaacctcaacgggcgcacggttaaccctgtcagtccgcaagatggtttggccaatggcatcgcctatatttctgaagatcgtaaaggcgatggcttggtactcggtctttcggtgaaagagaacatgtcactttgcgcgctcgatcaactgagcaaaggtgtgcaaattcgtcatgccgatgaagtgattgctgtggatgactttattcgtctgttcaacatcaaaaccccaagtcgtgagcaaatcattggcaacctttctgggggcaatcagcagaaagtggcgatcgctaaaggactgatgaccaaacccaaagtactgattttggacgaaccgactcgcggtgttgacgttggcgccaaaaaagagatttaccaactgatcaaccaattcaaagctgaaggcatgagcatcattttagtctcctcagaaatgcccgaagtgctgggcatgagtgaccgcattctggtgatgcatgaagggcggattagcggcgagtttatggcgagcgaagccgatcaagagaaattaatggcgtgtgcggtagggcgtaaccctgctcacgcagcatgaaacaaggatacagcatgagtacccgaaccatgactaatacgacatctgataaccgtaaaaaactgctcagcaaagagtggttgattgaacaaaaatcgctgatcgcactgctgtttttagtgattgtcgtctctttcttaaacccgaattttttcacggttgataacttactgaatattctgcgccaaacttcggtcaacgcgatcatcgcggtgggtatgaccttggtcatcttaaccgcagggattgatttgagcgttggctcagtattagcactgtgtggcgcttttgcggccaccttagtggcgatggaagttcctgttctggtagctgtgcctacggctttgctggctggtgctgcgcttggcgcaatcagcggcatcatcattgccaaaggcaaagtgcaggcctttatcgcgacgttagtgacgatgactctgctgcgcggtgtcactatggtgtacaccgatgggcgtccgatttcgaccggattcactgatacggcggacacctttgcatggtttggtacaggctacacattgggcattccggttccggtatggctgatggtcgtggtatttgccggcgcttggtacttgctcaatcacactcgctttggccgctatgtgtatgcagtgggcggcaacgaatcagcaactcgcctttcaggtatcaacgtagatcgcgtcaaaatcggcgtgtatgccatctgtggtttactggctgcgctagcaggcatcatcgtcacatctcgcctttcttctgcgcaacctactgcgggtatgggctatgagttggatgcgattgcggctgtggtgctagggggcaccagtttgatgggcggtaaaggtcgcatcatgggcacgctgatcggcgctctcatcatcggatttttaaacaacgcattgaacttgctcgatgtttcctcctactaccaaatgattgcgaaagctgtggttattttgctggcggtcttggtagacaacaaaaataaataaaacgtgaatccgcctcagcagggcaagagctgcgaggcgcaaccaaaaaggactatgagaatgaaaaaactgaccactcttatctctgctgctctactttccacttcggtttcttttgttgcgcaagcgcaagataccgtggcgattgttctttcaacgctgaacaacccgtttttcgtgaccatgaaggatggagccgaagcgaaagccaaagaacttggctacaacctgattgtgctggactcgcaaaatgacccaagcaaagagctttcgaacgtggaagaccttactgtgcgcggcgtgaaagcgattctgatcaacccgactgattcggatgcggtttctaacgcgattcgtatcgcgaaccgctccaagatcccagtgctgacgcttgaccgtggcgcgagccgtggtgaggtagtgagccacattgcgtccgataacgtagtcggcggcgaaatggcaggccattttattgaagcgaaaattggtagcgatgccaaagtgatccaactggaaggcatcgccggaacttcagcggcgcgtgagcgtggtgaaggtttcatgaatgcagtgaaaggcagcaagatgcaactgctggctagccaacctgcggatttcgaccgcactaaaggtttgaacgtaatggaaaacctactggcagcgaaccctgatgttcaagcggttttcgcgcaaaacgatgaaatggcattgggtgcactgcgtgcaattcaagcgtcaggcaagtcggtgatgattgttggctttgatggcaccgatgatggcatcgcagcggtagagcgcggtcaattagccgccactgtcgcacagcagccagacatgattggcgcgattggtattgaaactgccgacaaaatgctcaagggtgaaaaagtggaagcttacatcccagtcgctctgaaagtgattgcaaaataatctcctctttccctcctcacatgaggagggaaaaccgagcggtttactggttttattttcctcgtttacccaacgaataaagagggtatcagccattaaaccactctgtttttcctcatcaatacaaaggataaccgtatgaataagttggtggttctgggtagcgtcaatgcagaccatgtgctgcaagtgccttcatttcctcgccccggagaaaccctacacgggcgcaattatcaagtcattccgggcggaaaaggggcaaaccaagcggttgccgccgcgcgtatgcaagcggatgtaggtttcattgcctgtgttggcgatgattcgtttggcattaatattcgtgaaagttttaagctagatggcattaatacggcgggcgtgaagctgcaaccgaattgtccaactggtattgcgatgattcaagtttcagacagtggtgagaacagtatctgtatttctgcagaagccaatgccaagctgacggccgctgcgattgagcccgatcttgcggcgattcgggatgcacgttatttgctgatgcaactggaaacaccgcttgatggcattttaaaagcagcgcaagaagccaaaacggccaaaaccaatgtgattcttaaccctgcaccagcccgtgaactgcctgatgagttgctgaagtgtgtagatctgattacgccgaacgaaaccgaagcggaagtgctcaccggaattacggtttatgatgattctagcgcgcagcaagcggcggacgctttacactgtaaaggcatcgagattgtgattattacccttggttcaaagggtgtgtggctgagccaaaatggtcgcgggcaacgaattcccggttttgtggtgaaagccacggacaccaccgccgcaggtgatacctttaacggtgcattggtgactggcttgttgcaagaaatgcctctagaatcagccattaagtttgcccatgccgctgccgcaatttcggtaacacgctttggtgcacaaacctcgattcccactcgtgcggaagttgaggcctttttagcagaacactcataggagaaaacacatggccaccatgaaggatatcgctcgacttgctggcgtctccacttcaaccgtaagccatgtgatcaataagagtcgttttgtgagtgatgaaattgctgagcgggtgaataacgccgctcagcaactcaattacgccccctccgctctcgcgcgtagcctcaaaatgaaccgcaccaaaaccattggcatgttagtgaccacctcgaccaacccattttttggtgaagtggtaaaaggcgtagagcgaagctgttatcaccaaggctacaacctaatcttgtgcaataccgaaggggataaccaacgcatgaaagccagcatcaacaccttgctgcaaaagcgtgtcgatggtttgctgctgatgtgctcaacccttgagggtgaaaggttggatgtgtttgaccgctatcccgacattcctattgtggtcatggactggggcccgatcctttttgcgagtgacaaaattcaagacaactcactgcaaggtggctacatggcggccaagcatctgattgagtgtgggcataaagagattggttgtatcacaggtccgctgattcgccaccaagcacagatgcgttatgaaggttacaaacgtgcgctcgcggaagcgggaattgccattaatccagattggattgtggaatctgacttcgagtgtgaaggtggttaccaagcctttgaaaaactctatcagcgtggcaaattgcccagtgctttgtttgtttccaatgacatgatggcgatgggcgtgattcaagccgctagccaacgaggtttgcgagtgccggacgatctttccttgattggctacgatgatgtgcatatcgctaagtttatgaccccggcgttaaccaccatccatcaacccaaataccgcctcggcaaagccgctgtggataccctgctttatcggttggaaaatccagacactaccgcgcaagtggtacagttagagccgactttagtggtgcgtaatagtgtacgaaaactcggctagcgctatccgctcgtcccattgttctaatttatgatccaagccaatcgaagaggacaaatgtcctctcgctttcctcatattgttccttatagtgtggcaagtcataacaatgagagatagaacaaatggatctgatgactttttttgatattaaccacaccctagtcaatattccgatcggtggcggatatgccatgtcgtggattgaagcggtaggaacgctgtttggtttgctgtgtatctggtttgcgagccaagaaaaaaccattaactacttgtttggcttgattaatgtcacgctgtttgcggtgattttctatcagatccaactgtatggcatcttgttgctccagctgtttttcttctgcgccaacatttatggctggtatgcgtggactcgtcccaatgcccaaggggatacgctcgtcgtgcgttggatgagccgccaaaaattgctgctcacggcatgcattagcgtgatcagcattatcttgatgaccatttacatcgatccggtgttcttttctttagccaatatttccgttgatgtattgaatctgttcggcgcacagttggatcgcccagtgttatctccagatgctttcccattctgggatgcgacgatgacagtactttctgtggtggctcagattttgatgacgcgtaaatacgtggaaaactggattctgtgagtagtcatcaacatcatcagtgtcggaatttatgcggcgcaaggtgtgtatgccctctctatcgaatacgcgattttgctgttcattgccgccaatggcacccgagcttggatgcaaaccgctcgccataatgcagaaaaaaacctgaccaatgaggcaactgcatgagcattcaacctcacattcatgttgctcaagttgcgccacgtgttgtggtctgcggtgaaccgaatcgtgcgaaccgcattgccagcttgttgaataacgcagagcttgtggcggaaaaccgcgaataccgcttattcagtggtgagttcgaagagcagccgatcaccgtatgcagcacagggattggtgcgccatccatgatcatcgcggtggaagaactggcgcgaagtggcgcaaaagctattgtgcgagtaggttctgcaggcgcaatgcagtcagaaatcggactaggtgaactgattttggtggaaggcgcagtgcgtgatgagggcggttcaaaggcatatattggcgccgcttatccggcttactcaagctttgaattggtggtggagatgcaacgctttttagctgagcagtcagtacccattcaccgaggtattgttcgctcgcatgacagcttttacaccgatgaagaagcagaactgtgccgttattggcatcgcaaagggattctcgcggcggatatggaaacctctgcgctactcacggttggccgtttacgcgggttacaggtcgcttccgttctcaataatgtggtgttgtatgagcaagatgtgcaagcgggcgtgaatcaatacgtcaatgctgatcaaagaatgatgcagggcgaaacgctggctgcacgtgctgctttgcatgcgttaaacgcgcttaaattcgattagccccaacctattcacgacccataacatggcctcactcaatgagcggtattgctcagttgagtgaggaatctaggtagagcttcgcctaagtgcaaaaaacaggtagcctatgcccatgtgaatcgaatttcaaaacgctatgcaacttaccgagaatactaccggccgtttctcaggctatttgaatgcgcaactgcctgcgtttcgtctggcgttggctcaatgtcaaaccgcgacaaaaaggtttgatgcgggtgaggcgctgttgcagcaaggccaacctgttgagtctctgtatgtggtgtcttgtggtcgagtttcgatgcatattctggcggctaatggacgccgttttcaactcggtgaagtgcagtgtgacgatcacctgtttggcgagatggagttttttaccgctatgccttgtcagtggaatgtggtggctgaagaaccgattcaagcgatggtcatttgtgctcagaagctgcaagagtgccttgaacagcaacctgtgcttagcctgttttttgcttctgctttagcgcaggattaccaagagtcgctggacatttacacgcagcgtttgatgcattcaatcagctttaacattgcgtatgatctgctgctccagcatgaaactcgggtcaatttgggtggctttgaacggatggaacccgaagcggagcgcttcggtacatcaagccgggtgtatcgccgagcggtgaaagagttgctggataggggattggtcgaaaaaggcgagcgtggacttatcatcaaagatcttgaagctctgcgtgcttttgtggccagctttgaataagcgaggtgtccctcgcttattcgctgactggtgataatgtcaatttaaagcattattgatttaagaaagctaccgctttatcgggaaagtcagtgaacagaccatccaccttcacttggttgtagaacacatccaacatcccttcgaagttgtctgcccaaggtgcaatgcgccctttatcggctcggaaggtgtaaggatgcaccacgaggccagcctcttttgcttgcttcatcaacggcttaatcatgatgttgtctttggttgaagcatcatcaaccaacataggtttccacgggccgatgccatcggcgtactgcgcgactttggccatgccgccttcggcaaacatccagtcatagtcatagggtgtggcttggtctccttgataaaccatagtttcattccagtcggtgtacgctagtagctgaactagattgagatccatcttcatcgctggcagcagctcatcatgaatgcgttttagctcgatagggtcaaaacattgcagatagattttgtcgtctttgctgtcgtaaccatactgttttagcactttgaggacggcttgagaaatatctttgccttcgtggcggtgaaaccaaggtgctttgatttcagggtagataccaatgttataaccgagcgtcttgttgagcccttggatcagctcaatttcttctgcgagagtcgggacagtgaaatcccctttccaaagagggaaacgatcaggaaagccggcgacttcgttaccttgcgcatcaatatcaaacccttccgtgacacgcagggttttgatttcggctaaggtaaagtcaatcgcgtaataacggccatcggctcgtgcgcggttagggaaacgctccgcaacatcggtgacgcgatccaaatagtgatcatgtaataccaccaattgatcgtctttggtcatcaccacatcttgctcgatgtaatccggtttcatcgcataagccagcgttttggcttctaatgtatgttctggcaagtagccagaggctccacggtgagcaatcactaatggttctgcagaaacaatgcttgaaaataaagacgttgagcaggccagagccagcagagaaagcgagaatggttttagcatcatgaattccttttttgttcttcccagccctaaggcgtcaaatgacacgtgacgttagagtgggagagagagttgccgcgctcctaatcaggcaagagcgcggcgagggggacaagctatactgacgatgttattgcttgatgacacacgctcttaaatggtcgcttgtttaagcttatcgttatggtgagcgcgttcgccaacgaaagcgtaaatcaagcagagcactgagagtacacaagaggcaaccaagaccatgaagccgccatcccaaccgaagtggtcaacggtatagcccaatatcgcgttagctgccacagcaccacctaagtagccaaagagaccagtcagacctgctgcggtaccggcggctttcttcggagccagttccagagcgtaaaggccaatcaacatcacagggccgtagatcaaaaagccgatcgcgaccagagcagccatatctaccgctgggttaccagctgggttgaaccagtaaaccagaactgccagagttactaaaaccatgaacaggatgcctgctggcgcgcggcggcctttaaacactttgtcggaaatccaaccacacaacaaagtacccgggatgcccgcccactcgtacaggaagtaagcccaagaagatttatcaaccgtgaagtgtttggcttctttgaggtaaaccggagcccagtcaagtacaccgtagcggatcaggtaaacgaaggcgttagcaatcgcaatcgaccaaagcagtttgttgttgaagacatacttaaagaagatctctttcgcagtcatctcattttcatgcgacttatcgtaatcatcgggatagtcgtttttgtactcttcaatcggtggtaaaccacaagattggggggtatcgcgcatgactagccaagtaaatacggccaccagcaccgcaaagaaagcggggacatagaaggccgtgcgccaatcatcgttaaacatccataggccgagcaggaaaatggggccaatcaaaccaccaccgacgttgtgagcgacgttccagactgaaacaatctcaccacgctctttgcgtgaccaccagtgcaccatagtacggccacaagcaggccaacccatgccttggaaccagccgtttaagaacagcagaataaacatggcagtaatgctgcccgttgcccatggcataaagccgaagcagaacatcactagtgccgaaaggagtagacctgcactcagaaagtagcgtgggttagaacggtcagagacgttccccatcaaaaatttagacagaccatacgcgattgaaaccgcaccgagagccacacccagatcgccacgactaaagccttgttcaatcaggtaaggcattgccaaactaaagttcttacgaaccaaatagtagcctgcatagccaacaaaaataccgatgaaaagttgccaacgaaggcgtgaatagacgctgtccaccttatcggatggcagccgctgcgtatgcgcagccggtttgaagagctcgaacatagtgacctcattgtttttgcgatggtataaacctctactatcggaactcacagtacagatgtgagcatcaccgcagtaaagaaatggcgaacgagcaatttattttcgttcgaaagtgtcgagattcttatgtttctgaattgttattactgtgattgatgtggcacgtaaattattttacgtatagaaacaaattgtaaattttcgattttgttgactttaatcgcaaaattaagcgtttggattaattccattgcttttgtggtgatgaagttttcgtctgaaattaaatgtagattgaacgaaaataaaacagtttcgtaaattgagtgttggaagtgcagatggggataagaagagagggaatggacgtaggagggtgaatcaatggcaatcctttgccatctgagacaagtttgatcgacttagtcgcgattgctttcacgagttttgtattggtagtcgactttaacaatcgagcgatactcaacgacacctggctgtttcgcaaaagattgaaccacaacttcagtaccatcaatcttgacactttttggcacaacgctgttctgccatactgaaagttcattcgctaatttgttgctaggtagagcttgtaactgctcaattttcttaaatccagcggcgtaagcttgttcctggctcgcgtaaacacccgcattgattgagcgtgctttgtggttggtatcgatagacgcaaacgcaccagcactgagagtaagagcggtaacggcgagaataatctttttcataagttttccttattgagtttgaaagctgtaatgagtttctaaaagtaatttgttttctcttattgagagaggtattcatactatcaatggttatgtaaagagtccgtcaagcagggtaaagcttttgaaaaggtatggttgggtttctttacataaactgacttaagctgggttttcatgacactgttaagtctccatcagccttagttttctgatttagcatcgtcacaccgggctctagctaagggagtttgaagtgcctcgaagagcccaagcaagccaagactgttgcatgtagttactggaaagtaggcggcaaattgacgatttcccgcgtggttttgtgccgaaattgacacgttattttggggttattgctagcttttgttagccatttgtaaacagaaatggcgaataacaagagtcacaatcaagaaggaataaccatgaaatacggattaaaaatcagtgcgctaggctcagtcatactcggggttttggcggcttcgcaggtacaagcacatggttgggtggaattcccaagcgcaagacaaaacacctgttacctcgacggcggtttttgggataacgcgattccaaatcaggcttgtcaggcggcctatgatgtttccggtgcttttccgtttgtgcagcgcaatgaaatatcggccaatgtgcagaagtatcgggatatggccgcagtaaaagcggtggtgaaagatggcgagctctgttcggcgggcgataaagccaaagcgggcttgaatgtgccttctgcccattggcaaaaaaccggaatcaccctagatgccaatggtcaaattgaggtcgtgttccatgcggcaacccctcacaatccctcgtattggcaattttatttaagtaaagcgacttacgaccacaccaagccactgacgtgggatgacttggaattggttggcagctcggacgatgtggccgcgggaagtgataagaaataccgttttaaagtcaccttgccacaagatcgcagtggcgatgcgattctttacacgcgctggcagcgggtagatgcaggtggtgaaggcttttataactgcagtgacatcacctttggcggcactaccacgccaccagatccgactgacccgaccgatccggttaagctcaccgctttgggttactacgtaccacaagggtttggccctgttgaagtcggagacagtgttcgcttgcgaacatttgatacgacaggtatggaaacgacagatattgccttgccaatccgtgccaacaatttggagacttggcctgccgagctcgcgggtcagtttaatcaactgaaaaacggcgaatggtttattggtatttggcaccaagagatgaaccattacatgtttgatacgcaaaatctgtacgccaaccaagtctttgcgccaaacagtaacctcacttaccgcttatcgctgacgaagggagataccacgccaccgactcaacccgaaaatgcatgggataagagcaagacttataccgcgggtgcggtagtcactcataaaggcaagagctggactgcccagtggtggacacaaggtgaagagccgggaaccacaggcgaatggggtgtgtggcgctaagcgcgctgcctgtttgacgaactgagcatttatatacagccaaaaggggctgtcactcgccaaaacaggttgtctcgtacaacctgtttttctttttaaccaagcgcgttgccgctattgtgcggcacgcaagcggatttcaaagctcatgcccgcatcgggattattcgttgccacaatactgccttgcatatctcgcaggctattggcgacaatcgctaggccaagccctaatccttcgcccattttcttactggtttgaaacggttcaaacatggtggttaagagttctggtgcaataccacagccgttatcgctcacgcgcacgatcacttgatcttcttcactcacggcgctaatgctgagcttcggttctaaggtttgactcatcgcatctaacgcatttgacaccaagttgccgagcacttggcgcaagcgttgttcttcccccatcaccaacggcagatcgctagaaagtcgaactcgaacatccaccggagttaagcgcgcttgatggatgcgcaaaatctcctgtagtgcatcgggcagcgagatggcttgcaaagcgtcggggcgattgaacgcgaaggatttgagttgggaagtcatcgccgccatgcgatcaatcaaagaatgcaccagcttagtgttggctttgagcagttgggtttcaccgcgctcaaggagcaattcgttgctcgaaagtagggtgcgcaaaccggtaaggggctgattgagctcatgggtaatcgcacttgacatacgtcccagtgcggccattttgctcgcttcaatcagctcttgttgagcggatttcagcgctgcggtgcgctcttctactcgctgttgcaaatcgcgattggcattctgtagtgcgatttccgctttcttgcgtttactgatatcaatcagtgtcaccaaatagtggcggcgatctttccaactgaccgcaatcagggagaacagcaccggaaacaaactgccatcactgcgccgcgcaaccgtttccacgttggtgatgtcggccagctcttgatgctcggtgagatttttcagcagcagtggcacggtggcattcgggtttccagtatcaaacagcgaccaagcttgcagctgacgcaccatgctgtccgagaggctaaaatagcgcttcgccatcggattgatctcttcaatgcggccttgtccatcgatcagcagcagcccaacatgagttttgttgatcatattgcgttggcgctcttcggcctcaaacaacacgtgttgaatcttggcttcactgaggcgcttttgatactgctcgtaacgcagacgcatcagtaatagcagcaataatacgccgaccatggcactggtgctgatccagttaaccgtggcattaagatttttcagcggcgtgaggtaagtgagcgtccaattcagatcatccagcgtgacggattgggcaagataaggcgcttgttcgacttgccacagtgttaggcgtgttccatcaaatagactacgtttttgcgccgctgcgaccacttcggggtgagtcgctatccagtctgcgctgtaaactgaactgctggagagaaaataatggcgttgagaattttgaaaaaggatcaactcatcactggcaaaccattgatcggcaagcacgtttaaatccacttgtacggcaaccgcgccgacgatctcgacatccagataaactggcgcagcaacaaaataggtgggggtgctgccaacggatttggtgacaatcgaaatcccttcgcgctgctgcaaaattttatggatgatggctttgccatcagagagcttccagttttcagcatttttactggccgttagcagtgaaccggaaagcgtcagtatgtaccaacctttggtattcgcggctttatcgagttgcgccaattgttgctgtaattgggcttgcgggcgatcatcgccctgaaacagtttgagtgtgttggcttcattggtcatcaagtagggcaaatgataaaagcggcttagggtgcgcctcacatcactgatgtaatcgagcaaacgctgttcgccgtggcgctgcgcttgcctcagctgccagttttcactgacggcatgcgaaccccatcgcaccgcgatcagcagtaaaatcaccaacactatccaacttgctttattgagcttcaaagcatttccctatttaaaacgagcaccgagcttgacggttcaacttagcaacgaaagcgataaatgttaatgacgggtaactcagaagtgagaggcggctcctttccaagctcgacaaatttgcttactttagccgcacaacaagtatacccttcctacttgaagctgcagcggtgttggctacgttcgttgaccccaatcacatagtctatctatgctcatggggactcactcacttgccgcctacctgcaactccaagttgtttgggtatagaacaaggggtcaagtgtggaaagccaacggattgcattgattgaggacgacgacattgtgcgtcaagccactggccagtggttacaactggcgggttttgacgtggcgatgtttgctgatggcgcatccgcgttagcggcgattgagcagcagagtttcgccgccgtggtgagtgatgtacgcctgcccgataccgatggattgagtctgttggtggcgttgaaaaatgtgcaatcgctgatgccagtgattttgatcactgggcatggcgatgtcgacatggcggtgaaagcactgcatcaaggcgcgttcgattttatcgagaagccattccaaccggagcgccttgccaacaccgtggcgcaagcggtcagtcagtaccaaaacgcgctgtcatcgcagtcgcgtgcccactatcttgcctctgccaaagggttagagcagatcttgattgggcagtgtaagtcgattcaactgctgcgcgagcaaatcgccaaagtcgcagcgatggataccaacgtgatcatttacggcgaaactggctgtggcaaagaactggtggcgcagtgtctgcatcaagccagcgagcgtcagcgtggtcagtttgtggcgatcaactgtggcgcgatcccagaaaatctgtttgaaagtgaactgttcggccatgaagcgggcgcgtttaccggtgcggtgaagcggaggattggcaagctggaactggccgataaaggcacgctgtttctggatgaaatcgagagcatgccgctggccatgcaagtgaaagtgctccgcgtgctgcaagatcatgtggtagagcgggtgggcagtaatcagccgatcaccattgatctgcgggtcatcgcggcagccaaggaagagctgcgtcaacacgcggaatttcgccaagatctcttttaccgccttaatgtcgcgcagctctatttaccgccgctgcgtgagcgaggcgacgatattttgctgctgtttgaacacttctgtgtacaagtgaaaccgacttggcgcagcctgagtgaagcggatcggttggcgctgcttacttatcgctggccgggcaacgtgcgcgagctgcgcaatgtcgcgctgcgttatgcgctggatgacagcatcagtgttggggaaattctggcttcatgtccgggaatgactgaagaagaagcttcagcagggttaccgctggcgattcaagtgcacaactttgaacgtaaagtgatcgctcaggcgctgcatcgccatcaaggtaacatcagtgaagtgatgaaagagctggatttgccaaggcgcaccctaaatcagaaaatgcagaagtttggtttgcttcgcggtgattttactgcgcaggaggaatgagcaaaattttgctcatcacttttcaatggtttttattaacatcgatcacatttagttaaccttgcgtgatcgctctcctgatttttgagcctaaaacacgcgcgatgatcggcggttttttgctgatgtactttaggctcaatcagcaagattttgctcatttttatctgttttgaaaattaatgtcttataaaacaatggattaatttttggcatcttctttgctcttactgatattgttcatgctgtacgtttggaaacggtacagcatcgaaaaataatcacaacatggagagtcacgatgaaacaaaagcgccttacgcaaaccctattagccgccatcacttcgtttggtttaatcggtggagcttacgcagccgaagaacgcagctacattcttgccaccgcgtcaaccggaggaacttattaccccgtaggtgtagctctggcgaccctgaccaaagtcaaactcaccccgagctaccacttttcactctccgcgattagctcggctggatcgggtgaaaacgtgaagttgatgaacgataacgaagcccagttcgcgattttgcaaggtttgtacggtgcttgggcatgggcgggcgaaggcccgtatgcggagcgtcaaaaccaattgcgttccgtctctatgctgtggcagaacgtggagcactttattgtgcgctctgatctcgcgccaaccggcaccattgccgatctggccagcatgaaagggaaaaagttttcgattggttcgaaaaactcaggcacggaattttctggtcggcagatcatgaaaggggttggcgttgacccggatacctttaatctggcttatttgggttacggcggcagtgctagtgcgctgcaaaatggcaccattgacggcatgaacacgccagcgggtgtgcccgtgggcgcggtgactcaagcttttgcagcgatgggcaacgacatcaagatcctctcttttaccgatgagcagatcaaacaagccaacggtaactacaatttgtggaccaagtttgatattccggcgaacacctatccgggcgtcgataaaaccatcaccaccattgctcagccgaacttcctcgcggtgcgcaccgacatttcggaagaggatgtatatcagctcactaaagccatgtacgagaacttagctttcctacaaggcatccacaaagcgaccaaagatatggcgattgaaaaagccatcgaaggcttgcccatgccactgcacgccggtgcggcgcgttactaccaagaagtggggattaaaattccagctcacttgatgccacagtaagttcggcgaacgcgaaagactgctcgggagcgggcagtcttaccctttcaatcacaaataaagaaagggcatctctgttttcttcgtctatccccaaaccgccggaagtggttgcaatacggctgcttcgtgcgggggatatggcttagttgtctcgctgttggagtaacgcaatgagcaattcagtagaacaagaactggaaaagttcgaagtgccgacccgtacccgttttggctgggtaacgcgcacgatttccgtattgtgtgtgctgctgtcgctggcgcacatttggtttaatacgttatccacgtggtcagaattgtggatttcggccatccacttcgcggggttcgcgatgatttgcgcgctgtggtatcccgccttgcctcgttggcgtgggagcaaagttgcgctggcgtttgatgtgttgttagcgctgctggcgctggcgtgcttgatctatttgatgctggcagaagatgcactctatgagcgcggcgtgaaatttgtcaccagcgattgggtgttctcgattctcgcgatcttgattgtgatggagatgatccgccgcactatgggttggtttattcccacgctgattttgatctgtctgacctatgtctcggtttggggcaaatgggcaggcggcattttccattttcccggcttaagtgccgaaaccctgctgtatcgcagtttctattcctcggaaggcatgtttggctcgattgcggcgataagctggagcttcgtgttcatgttcatcctgtttggtgccttcttagtgcgctctggtgtcggcgattacatcatggatgtgtcacgcgctgcggcaggtaaagtggtggggggccccggttttattgctgtactggcttcgggtttgatggggtcggtgtctggatctagtgtcgcgaacacggtctctacaggcgttattaccattcccatgatgaaaaaagcgggctttcccgcacgtttcgccgcaggggtggaagccgcagcttcgaccggtgggcaactcatgccgccagtgatgggcgcaggcgcgttcatcatggcgtcgtacacgcaaattccgtatgtggatattgttgcggtgtcgtttattccggcacttatctatttcctttccgttgcgtttttcgtgcgtattgaagccaaacgcatgggcgtacagattgtcactacgagccaagagccgtttatgaaagtgctgctgtcggggtggcataacttgatcccacttgccgtgttagtgaccttgttggtggtaggctttaccccaacgtacgcggcgggcttgtcgattctgtcggtgattgttgcttcgtggttttccaaaaatcacaaaatgggtcctaaagcgatcattgaagcgttggagcaaggggcgaaaaacatggcgactaccgcggtattgctggtcggtatcggcttggtgattaacgtgattagcacaacgggcatcggcaataccttctcattgatgatcaacaactgggcaaatggcgatctgctgaccatgctggtgttgatcactttggcctctttagtgctggggatggggctgccagtaacggcggcgtacattgtgctgggtacgctttcagctcctgcgctgtacaaactgctggccgaaagccagttggtggatttgatggtttcggggcaattgccggaacaagccaaagcgattttcatgctggcggcgccggatcaactcagtttgctcaatgcgcctatggcggcggaaaaagcccatgagctgattagccttgtgcccgccgattttgtggaaaccttgctacaacaaagcttagggttagaagcgattggtctggctctgctttcagcgcaccttattatcttctggctctcgcaagacagtaacgtgacgccaccggtgtgtttgacggcctttgccgcagccaccattgccaaaaccccgccaatgcgcaccggatttaccgcgtggaaaattgccaaaggcttgtatttggttcctgtgttgattgcctatacccagctcatcagttgggacgtggccacagttgtcactatcggcatctttgcgatttttggcacttacgccatgattggcgcgattgaaggctatctggaagggcggctgaatctcttatggcgtttgctgttggcggtgatcggtgtgctgctggtgtggccaagtttgccgatttggatccgtttagtctgtgtggcgctgtttatcgctatctttatctactctggaaaaacggcagcgcgtgttgagcgtgcccatagcgcagtacggggagcaaaatctgcatgacttatgattacgtgattgttggtggtgggattgtcggtgtctccacgggttggcaactgaaacggcgttatccggaaaaatcggtgctgttgattgagaaagaggcggggttttcccgccatcaaaccggtcacaacagcggagtgatccatgcgggggtttattatgctcccggcagtttgaaggccgatttttgtaagcgaggagtcgaacgcaccttggcattttgcgcgcaacacaatattccagtggaaaactgcggcaagttactggtggccaccaatgagcaagaactcgaacgcatgcacgcactctatgatcgctgcttacaaaatcagattgatgttgaaaaactggatgccgcacagttgaagctggcggagcccaatattcgtggcttgggggcgatcttggtgaaagcgaccagtatcgtcaattatcgtctggtgaccgagaaaatggccgaagcctttatgcagttgggtggggatgtgaaaataggcacggaagtggtgggcttggaagaaacgccatcctcgatcacgctaacttgccaacagaagaaccaacgcgtgagttatcaggccaaatttctggtcacctgttcaggcttaatggccgatcgcttaaccaagatgctcggtttgccgacggattttcagatcatcccttatcgtggcgaatactatcgtttggcacccaagcataaccaagtggtgcgtcatcttatctacccgattccggatcctgaattgccgtttctcggcgtacatttaactcgcatgattgatggctgcgtgaccgttggtcccaatgccgtacaaggttttaagcgtgaaggttatggcaaatggaatgttagcctccgcgatgtgtgggagatggtttgcttccccggcttttggaaagtgagtgccaagcactttaaaacgggtatggtcgaaatgaaaaactcatggtggaaagcgggctacttacagttggtacgtaaatactgcccaagtatcgaactgaccgatcttgagccttaccctgcaggcattcgtgcccaagcggtattaagtgatggtacgctagtgcacgattttttgtttgccgaaagtccgcgcagtttgcatgtgtgtaacgcgccttctccagcggccacttccgcaatgccaatcggcgaatatctgtgcgacaaaatcgcggaaaaatcgcttgcttgagcctctcaatgcccatcaatgaaggtgggcatcttcttcgcctcgaattgtaaagtgcttatatatcatcatctttaattgattattgtgtaactatttgctgattttatgtgtaattgtttgcatatttttttggcacggagtctcatttccaagaagccatcttcacagagttggaacccttgtctcgctgtggaagctgcgattctaccgaaatgctattcggtaactaataataaatctgtaactcggttgtctatgtccggaacctattgtggtgtgaataccctaggtttcgagggttactgcggccgaaattcaggtcgcatcacgtacgctaaccacaagaaaaacaaaatgagaaatccaaccatgaacaagaaaccattaacgcttctgatagctgggctattaggaagcacatcggcgtgggcgcaacatgagctcacgctagtgcagatcggcgaaaaaaccgttgagcggctagaatcgattaaagcgatggccgaacgcggggaaggggtgtttgagcgcaatggcgaacgctggatccgttacaaagggacggactatcgcctgagctacaaaaatgatctgcagttcccttttctgccttatcaaggcggcgatgatacgccttatcgcaacgtgattgactttgtcgatcagagttgggaattcatgatgtatgacggcggtttttatctcatgagccgtgaatttggtgtttacgaatcagacgagcaaggctgctttattgaatacattcctgcgtcacacggctctaagcgtgccgatggcagctacatttgggagcgtgatgtcatctatcgcaccgaaaccaatgattgcggtgcgttagtcaaaccagagattcgctcgttaaccgtttcgagcctgtctgatgtcggtgtgtcatttgactggcttgggcaaaacgaaacggactcagtgacactcacggtcactaacctcagtgatcacagtgatgttcgacgttatgaccatgtttctgcgggtttctttgtgggtgggcttaagccagaaacccagtatgaaattgccctcagttcttgcaatcaagtcgattgcgctgagccgaaagtggtgcgcttcacaactcaggaagctcgagttggctttgccgatgagatcccaaccccgaaccatttgcaaggcagtttagaaggcgggttgagcatcacgcaaacccatacttcggttgcgcccaagggcaatgagctgactgggcaaggccatctcgatgcgatcatgaaccgtgaagctctactgctgtttacgccgcagcaaggtgaggagattaaccaagtccgcgccgaagtgttcctcgatggcgaattagtgcaaaccaccttgatgctgccgccaagcgctctggctgcgtcggatcagccagagaatggccgcatgaaagtggtgttttctcatcttgcatggtcactgcccctgcaatgggattggatgaagccgggactatcgctgcgcctgactgacaacttaggccgtgagggtgtgctcagccaaggagaaatccagtttggcggtgcgcctgagttggtgatccagaacattgatatcggcatgttaatgccaccgcgggatcgcaacaccatgatccaaaacttgcctacgcttgcggcggattatttccagaaaatccctgcctctaaactggtgatggccgattatacccctgcgcactttcccgtcgtgaccatgccaaacggtgtggtgtataccgataagagcgcaagtacgggcggttggcacagcggtgatatgcgtgaagcgatcggtaaagccatggtctctacgggtatcaacaatgccaacgtcggtattgtgagcagtgcgggttattcgcagcagtacaatcgacgttttaaccacatcactgcccataccaacgtgggcatctacaccaaaaaagacacggatttaccgcaagtcgtcgtgcatggcggcagtggtggcggcggcatcgtgacactggaagcgacgaccggtaacgagtggtctcatgagcttgggcataactatggtttaggtcattggccatacatggcctcgattcacgatctggagtccggttgggggtgggatgcattccaccaacgctttattggtaacttacactggaaaggcgatgtttatactcaacagcaaggtgatgatattgtgccaccgtttaaagatgccttccgtttcttacgtgatgcgcaaaatggcggagagcaagagtacgttggcaccatcagccgctttaccttggagcatccggctcagtcgcgcaaagcacagcgttggatgaacaacggcttcaacctagatagccacagcccaagcggctatgtgcaatgggatcaggagacgcaacgttataaagccgtcgaaacggatacacccaaaccccagcaagtgggtgtgccggtagtgaccttattggggatttacgatccgcagaatgagaaccctagccaaatctatcctctggtttattcaaattatggcaacgtgtttgaactgccacagccagagcaaggtgagtatcagctagaaggttggcaagcagccggggatctcactcaagccgaaatccaatacaaccaatggcagacgttattgattgatgggcaacaactgccaatttgccgctttgattacaccaataccaatggtcaaagcgcgacgtttgttggcagcttaaatgcacagcgtaacgtgtgtgaaggtagccgagatatgcgctggtataacgattatcagattgattcgcctgtagggcagtatgagttactttcacaatttggtgcaggtaatgtcacctacactccgaatgcggagattggagaagtgcagctgtgtactctaaacaagccgcacaataacggtagtcatgacggggcaggttttgttcgcaatggccgctgtgagcaagtcgaaggcgtgaaaaataacgctgaaggtcgcgtttggagctatgcaattcgtaatagcgaagtgttgtcgagaaccttagcttctcaacgtcgttgtgagttagtggtggaacatcgcaatggttcaacccacatcgcactggatggcaatcgtcataaatcgaccgaaagtaacaagttccacgttaacttatcgatggaaaaaggtgtacctacccaagtgagtttgagctgtagtgaccttaacggtacttcaacgctgacacgtttcacgccagatcagaatccgccgctggataagctcaaaggtccaatcatcatcggtcaggaatacggttacagccaagtcatcgatatgacgaaaaccttcgcccagaaccagactttgctgaacacggattttgcgaccatcgctgagtttgatgcctttgtggccgaacactatgggcgcggcgtgctcaacaatggtgtgacaaaagcggagcgccgtgcaggggcgttgtatgtttacccgaatccagaaacgggcacgcgcgactactttgtgatgcgcacgcttgaagctggggcgttcccgaccgaccaaaccagtgatcaaggttggaaataccttggttcggcagatgaccacattaactttgctttcaacccaatcaagctcaacagagccgagggtgtgagcgttgaagcacgtgtgcaaagctactttggagtatctcgcttgttgacatgggatgaacgcacctcaaccacgtgggacaacgcttctaacgcagtgtttgttggtcaaatcgaaggtgaaaaccattacttcatccaaaagcgtccgggcgaaggggaggcattcccaacgcgcagagcgtcaaaccaagattggatttggctaggcagtgactcttctattcaagagactcttactgagctcaatcgcgatctggccagctttgagcggatgctgctggaatggtatcaacaagacgcgatgggcgtgtggggcagtgatggtcagcgtggcaacgtgaacgatatttatcaatatgcgtttagaggtggctaccactactaccgcttgaaagtgacgaagtatggttatttcccttacccaaccgatcccaatccaactaatggacactgggaatatctcggccagttttaagttattcattgcaaagccagtcgtttgactggctttattttttcgccaaacattgtttttgcaactatcggccttggtttacaactgggagagaaaacactatcttacgccgcgttatttttattcaactaatgctccaaggaaaccatggctgttctagagattcttactgcacccgatccaagacttcgtgttcaatccaaacaggtcacggatgtggcctcagtacaaaccttaattgacgacctgcttgataccctgtacgccacggacaacggtattggtctggcagcaccgcaagtaggccgcgaagaagcgattgtggtgattgatttgtcagacaatcgtgaccagccactggtgctgatcaacccaaaagtggtcagtggcagcaataaagagatgggtcaagaaggttgtctatcggtgccagactactacgcggatgtggagcgttatacttctgtcgtggtggaagcgctggatcgtgagggtaagccactgcgcatcgaaacgagcgatttccttgccattgtcatgcaacacgaaattgaccacctttctggcaatctgtttatcgactatctatcaccactaaaacagcaaatggcgatgaaaaaagtcaaaaaacatgtgaagaatcgcgcgcgctaatcgcgacataccgattgtttcaaaatagaaaggccgcctgtataacgggcggcctttttgatctttactcaactttacccttctgcgacagcgctttacattaggtttgttactttaaaataaccttattgataaagtggaattgggttatgagcagggttaaatacactctctgggtagtggttggcatcgtcactctgttatgggtacaggctgaacctacactgtttgggtcaacaaacttgtttcagtggcgatcgggtttagtgcagttctccggtattctggcactcatgctgatgtcgttggcgatgctgttagccttgcgtttacccttgatagaacaatggacgcaagggatagacaaaggctatcgcattcataaatggctcgggatctctgcgctcttacttgggatcttccattggcttgcttaccatcttcctaagtggctcatctcacttgaactactgacgaaacccgcccgccttaatggttctggcccaaatagtaacctatccggtttggctttatggctaaaagaggctaagcctttggcgatggaaatcggggagtggggattctacgccttgattgtgctgttggtggtttcgctttggtcggccattaaatacaaaccgtttcgactgactcaccgcttgatggcggtggtgtatttgttgattgctttgcatagtgtgatcttgctgaaaaaagcctattggggtgagccaatttactggctaacaatgctgtttattgtggtggggtcatgggctgcatgttatagcttgctcggtttggtcggtcgacaatctcgttatccggctcatgttaaggcgtttcattactgccctaacagtcaaaccttggatttaaccattcaattagataagccttggttaggtcacaaggctgggcagtttgcgtacttaaagtttgccggtgaagaaccacatccgttcactatcgcctgtgctcatcagggctcccaacttcgctttttgattaaagagctgggtgattttacaacggggctgcatcagcgcttacaaaacggaaagtctttggaagtcgaaggcccttatggcaagtttgatttttcgactcagcaacctcagatttggatcggtggtggcgttgggattgcgccatttatggctggactcgactggttaatgagggagagagcacacccaccagtacatctttttttctgttgccatcaaattgatccggatttgtgcgcagaacttcgccacaaagcgcagttggctggggtttcattaaccattatagattcgagcgttgatcctcatctgtcagcagatgacattgcgcgccgatgtggagatttaagccgtttcgaaatctatttctgtgggccaatcgcattttccaatagtctgaaaaaagcgcttaaaccttaccaagtggatttgtcacgccagtttcatgaagaacaattcgtgatgcgctagggctttcgaacggatgagtgatgagcagtagtggcaaggccatcactggctggaagagatggataggcagcaaactacttctgcgcctttttctgtttggccgcgtcttgattacgccagaaagcatagccggcttgttgtgtgactttacccagtaaatgagccgcaacgggagcggtcagaaaaataaacagcatgatgccaaccagtcgtgatattacgccaatctcaggcatacagagcgcgacagcaaggagcaataaagacaagcctgcggtaccggctttggtggcggcgtgcatgcgagtatagagatcgggcatgcgtaaaatgcctaggctcgcaaatagcgtgaataaggtgccgagaaccagtaagagggccgctaacatcgacattaaagttctccttttcgtttagcgataaatcgtgcaaatgctatggtgccaaggaaagccactaagcctagggttaaggcaatatccaatagcgtttgctgaccactgtctaagctataaacgacaataaagcctatggtgataaaggaaattaaatcgagagccaccacgcgatcggcgagcgatgggcctaacactaagcggataaacgccattgccaagctaagcaaaagtcctagataggcgaagtgaatcgccagcggtaatgaattatccacgagtgacctccagtatccgtttttcaagaccatttttgatgtcgttgatcaccgcttggtgctctggcgcaaacatcgcgtgaacgatcaaatattgtctatcttcgctaacatcgagacttaaagtgccgggagtgagcgaaaccatgttggccaaaagggtaatctcaagatcgctgcgggcatctaatggcacgtagacaatatcaggatcgctcagatgctttggcgtcacgacatcccatgcgactcgtgcgacagagacgatcatctcgtagatgaaatagagaattaaagtggtgatggctctaaaacggcgaaagtaagtggtttttaagccaaatggctggctgaggcgcaatgcccaaaaccccaccacgaatcccaataagaattgcaagctggagtagtcaccattgagcagcatccacgctgtggcaagaaagaggttgaggaagagataaatcattttgagcctcccaaaacagcatggatataagcggttggcgttaataattgttctgccgctaaggttgcaaattggtaaaacggctgcgcagccaaaccaatcactaggctaaacagagtgagcacgaggatcggcagtgcataaagaccgagtgttgagcgggctaacgtctcctgttgtagagcagcaggagcatctttccaaaacacttcattccaaattttggtcatcgagaaaatcgttagcaggccaaccaatagcgcaattgcggcaagccaatacagctcagcagccaaactcgctttgatgactagaaacttaccccaaaaccccgacagaggagggaagcccgccaaagagaaggcggcgagcaagaagccaaaggtaagccaaggcatggcgcgatagactccgccgagctgcgtcaattgtgtagtgccgtactttctgccaatcaggccaccaatcagaaataggttcccctttactaagatatggtgaatgacataaaaaatcgcccctgtgatggccaaaggggtataaatggccagtcccataatcatgtagccaatttggctaatgatatgaaaagaaagaatttttttaatgtcatattggcttgccgcaccgagtacgccagtgagcatggtcagcgccgcaatccccagtagaaccggttgccaaccactgccatcgagcggaaacaccagagtgaagacccgcagcaaagcgtagacaccgactttggtgagtaaagcggcaaacagggcaacaatggcgctcggcaaggtgtgataagacgccggtagccaagcaaacagaggaaacagcgctgctttgatagaaaacgcgaacaatagcaatccagcgagcatggttttcatctcaggagcgagggattgagctttgtcatgtaaatctgcgaggtttaaggttcctgtggcaccgtaaagcagtcctatcgaaagtaaaaataccaaggtagagataagattgagcagcacatatttgatggcgccatcgatttgctgctggtttgcatccaacaccatcaagccgaaagaagcgatcagcatgacttcaaaccagacataaaggttgaaaatatcccccgttaagaaagcgccatacacaccagccagtagaacatgcaacagtgcgtggtagcgcgcgtatgagggtttggcgcttaaatcggcaatcgcatagataacgctaaccaaaccaataatggccgtcaccatgaccataccgacgctcaataaatcagcgacaaaaacgatgccaaagggggctggccattgcccaaaggcaatagatgctgggccatgagtgtaaatggtgatcgtgagtagagcgccagtaaagagattgatgacactgcagatcacactcaaaccgttggtcagccaacgattacgccccgctaaaaagatcgcaactgcggtgagcagtgagatcacaacgggtaaggtcaacccaatcgcggtcattcttcctcctctgagcgacgcatctcatcgacgtccgcgctgcgagtctcaaaataagctcggtaaaacaacatcaaagcaaaaaccagtaagccaaaaccgatcacaatggcggttaaaatcagggcttgtggcagcgggttcgccgcaccttccgctggtaacaaggctcctacctcaattaatggtggtgaggcgggggttaagcgtcctgcggtaaaaatggccaagttcaccgcactactgaggaggatcaggccaaacaataagcgcagtaagtgtcgctctagcattaagtagataccggcggcgacaaaaacaccgacaacaatgctccataatccttccattagtcgagttcctccttaacgcgcagcaacatgctcatgacaccgccgatgatcgccagatagatgccgacatcaaagagcagtggggtgccaagcggtaaaatttctttccaccataatccagttaggaaaggtaaaccgaccgcgacactcatggctcctgccataaaactgagcaggatgccaaacagagcaatattgagtggcgagaagtgcagacgatctcttacgtattggggcgattcggcgaagaggagcagcgaaaagccgatcaccgcgatcaatgcgccgataaagcccccgccgggagcattgtgtcctcgcagcagtagatagagggaaaacatcagcatcaaggcagtcacaatatgtgcggtagtggcaaagattagagaatgaatcttctgtggttgttcggttcgtttaggcaagaggctaatcgcgacaaggctcgccatgacgaccacaatgacctctcccaaggtatcaaaggcacgaaaatcgaccaaaatgacattgacgatgttgcggccatgaccgccgggaacgctctgctgcgcaaaatagtcagacaaagtggtatcgataggatgcgctgtgatattgagcaggattaaggttacggatgcgccaatcacactggctatcaccgcattcaatgtgcgacgcggtacagaatggcgagcgaccgtcgacaagtagggcacatgacgcatcaaaagcaccacaaacaccaccatcagtgtttcgaccagcaaaagggttttggcaacatcaggagcgctgtaaatcataaagaccagcgtcgtcataaatccagccatgccgagcgctaataccgacagcaaacgagacgtgctcagcacacacaacagcgcagaagcgatgagtgcgagcgcaattgcgacttcataaaaatgaacatcaaacagcgaggcgctgaaagtggctggtaaaggtagcggctgatagatcagtattaaggctaaaacggcaaaaaatagcagcatataaccgcttgagcgtttttgttgtagcatttgcgtttgccagcttgccaatgtcgctaaataagccagcacggcatcaaacatttgctcagctttgggcagcggcttcactaagcgcgtgagccatgtgactagggttgcgtagttcagatacagcacgccccctaacacaagcgtgataccactcaaagccagcgggatattgaagccttgccataattttgcggcttgtggaacgctgtttggatccatcgccatgactgctggtatgactaaatgctggttaatccaatccagggcaaaaacaggcagtaggaaactggcgatagccaatcccatcgcaggtagccaaagggattttttctgttcgatcgctttgggtgggtggctttcactctccttggtcgcttggccaaaaaagggtttgtaaagtagtgcgatggctaacgccaccatcagcgcattaatcagtaataagaccagcgaaatccacgcaatgccagattccacactggatttgtacatgtactccttgctcaaaaatccgagcataggcgcaacaccggatttggataaagcggcaataaccgcagcaataaggctcagcagcaagacggattttaagttgccgagcttttctcgctctcgagtgcccgtcgctttatcaatattgccgaccaccataaagagtgcggctttgtaaaatgagtgggcgaaaataaacaacacagcagcggtcagcgcgacctcggtacctaatcccagcagcagggttaatttgcctaatgcaacattggtgctgtaggccaacatcagttttagatcggtttgcttgaacgccagtagcgcgcaccaaagtgccgttaccgcgcccacaatggttaagcagtagaaccaaaaatcactactggcataaatcggtgataagcgggccaaaagatagattcccgccttaaccatggtcgctgaatgcaagtaagcgctcaccggtgtcggtgcggccatggcattgggtaaccagaaatggaatggaaattgcgcagatttagtgaatgcaccgagtaaaactaaaatcagcgaaggcataaaccacggatgttgcgcgatgtgatccgcgtgctcaatgatgacgctgatttgataactattggccatcaagccaagtaaaatcagtccggctaacagcgcgagtcctccggcccccgtgactaaaagtgactgtagggcatttttgcgtgagactggtttgtcatgattaaaaccaatcagcagataggaagtgatggtggtcagttcccagaagatgaacagcagtaaaatattgtcgcttaccaccacgccaagcatggcgagcatgaagagagtgaggtagagatgaaatgagaagcgcgccgctttctctttcatgtaagcgagggcatagatttgaatcaaggcaccgatgcctgtgatcaacgaggcaaaaagaaaagagagcccgtcaagtcggaaactgagattcagatccagcccaggaacccaagtgacttgccaagcgttaccgccggtttgatgccaataaaacacccacccaaatagaaggatgggtaaaacggcgaaaggaagtaatctcgccgacactgtatttgggatgagggatgtatgcttatcgagtcctgtcttcaagatggcagcctcttcgatgtcatattaacgccgctcagtgcgtccttgttgcgacgtcctgagcgggtacaggtatctactactttgaaaagtataggctaattcttgatagcgtcgagttcgttggtggaagcgtgacgcatgatctactttgattgtgagtcaaagggtgtaggtcgctcatcaaaatggctgcattctgagtcaaaaggcaggctgacgagcggtagctcattcgtgagcatggcgtcgtaaacacaatcaccgatcgcatttcttgggcagatatagaggttggcacgctccaacatttcacagtggcagtgtgggcagaactttttcatcacatcctccttagactaaggatcacaacggtctcgccaacagatgaaggtcggttgacccaatgtggcattacttactcgtttttgatcggcgaaacgaatccttctggtttaagagcgactaaagagcactcaatcgactgaacgatgttttctgccgtattgccaatcacaaagcctgcaataccggttctagcgagagtccccatcactagaatatcgatattctcttgcgtgacccattcggggatcagttcatccggcttaccgtgcagatggtgtatcactaactcgcctgtaatgcctgattcatcaatcagttgacgtaaggcctgctcatgtctgatttttgcttgtgcgatttcttcggcgatttgctgctgctcaacttgaatccatacctgatcatgcaggtagttttctaaatagtattcccagcaggaaacaatatgcaggcgactgtcacacgtgttggcaattgagcgtgataattcgagtaaacgcaatgccagggccttttgctgctcggtcgtggtgatagggtcgatagccaccgcaacacgccgattggcttttggcttggctaacgggcgatgcaaccaaactgggcaagggcattttctcagcagtgtcatatccaaagctttaaaaccttgctgactatgagtcataggttccgcttctttgatcaacagatcgatatgatggttgagtgctgacttaataatcgcgaccgcgggttgctcgctgtgctcaaccattaaaggaaaaggaacctcatctttatggatgtggtgctgtgaacggcacgcctctacggtttccatcaaagtgttcagataggattgctcgtagggttcttgatagcgttgtagatcggcaggaaatgctggaaatgcaatcaaaccagcaagttgaccgcggttattgtaagcaagttgaatcgcttgctccaacgcgtcactgtgtccgggtaagccttgagttgcaaataagatattcttaaattttttcatagccagctccttggttgattaaagattagtcatattgctggcctatgtcatagcgagtaattgtaagggtttatgtaatgctgagattagatctcatcgatatgcttgtctgcgcgataaaatagggaagccgcagcgatacgtaagaaattgtttcgctgcggcttctttgtattgatggagtcgcttttgacgttatcccttaaacgcaggtaacaaattggccatcgccatcatatgaaaaaccgcggtaagcacaccaaagatcagaacaagtccgagagctagattgcctcccggtacgacaaacccctgcgctccattggctaaagtgcgcgatttacgcgcaagcagtactgggataatacaggcccaaatagtggcggctgcgcctgcgtaaccgatcgcaatgataaagccgaatgggaacagcaaagagagaatgagaggtggcaaaaaggtgaccagccaagttttggtacgcccttgtttacagttgctgaactgaaataaatcggccagaaaatcaaatacgcctaagccaacgccgataaaggaagataggatcgcggccatcgaaaaggcgttgatcgcttgtgagactttctccgactccaccaccgaacctaaggcttttaaaagcacatccacattcccaccttgctgtatgacaggcgcaaaatcggcacgaggtaaattgccaaaaatgctaaatagccaaagcgcataaagacttagcgcaatcactgtgcctcccaaaatcgcgtacttggctttgcgctcttcgccgtaataggcacgcatggatgaaacggagtgatgataaccaaacgaggtcagcgcaacgggcagcattgccatcgcataaggagcgtactcaccactttgatttagggtgtcaaataggatggatgttttcacattgatcgctaatcctgaaacaccaaaaataaagctcagaaccataaatacgatcaaaataaccgagatacgatccactgcgcgagtcgaatgccaaacgaaagcggaaaataccgccacgaacagtatcgaggctattttgctattgatatgcagtaaatcctgcaaaatcaaaccagaagaggtgatgtaggcgtacaacaaaatgccgccgacaaagtaaacggtcaggttgttaaagcgattgatatggctgcctagcatatctttggtcacggtattaaacgagactcgaagatcatagtgtttaaaggcttcaagtagcatccagcctgaaagcgtcatgaccgccatggttaaagcgagcgccaacatagaccagagagtccatgcgccggcacctgcgctggggagaccaagcataccagcacctacgcagacgctggcaataatgcaggctcccccaaacagtgagggttgtttcgacatgataaaatccttgggtttcacgttattgttgattttgttgttatgtttttcaggtcaaaaaaaggcagcctatgcaggctgcactttttcaataccgtattaggctttttcttttaagcgagccgtaaagtggcgtagcacgggtggctcgtaagtaaactccaatcctttgacgttacgagcattggctttcaccttctcaaatgcttcgatgatgaaatccatgtgcgtttgcgtataagtcgcgcgtggaatggttaaacggagcaattcggctgggcaaggatgctgttttccggttgcaggatcgcgtcctagtagtaatgagccaatttctactgcgcgaatgcctgcgactttatagagttcacaagctaaagcgtgagcagggaattgatctgctgggatgtgaggcagcagtttacccgcatcgacaaatgcagcatggccgccagcttgttggcaaataaccccaatcgcttctaaaccattgaccagatactccacttggttaatgcgataagcgagccaatcttggcgcataccgtcatacaagccaaccgccaaccgctccatcgcaccgccttctaagccaccgtatgtagggaagccttcttgcaccacacacagggttcggcattcggtgtacacgtcaaagaagctttcgtctttgaagcagagtaagccgcccatttgcaccatggcatcctttttggccgacatcgcgagtccatcggcgtatttgtaagcttcacgcgtgatctcttcgatactccagttgcggtaatcacgctcacgttgctgaataaaatacgcattttcagcaaaacgagcagaatccatgatcacgggaatgtcgtaacgctgggcaatctcatacacggcttttaagttggcgatcgaaactggctggccacccgcagagttacaagtgatggtgctgacaatatatgggacgtttgctgggcccgcttcaaggatggcttgttcgagcttttctaagtcgaaattgcctttaaaatcagctttgacaccagtatcaaacgcttcctcggtgtacacgtttttagcaacacagcagttaatttgggtatggccttgagtggtatcgaaaaagtagttagatagtgcgaccattttactgcgatcgagtcctttctctttttcacgctttttaatcaaaacaggaatataaatctgctctgcaccacgaccttggtgggtcggaatcgtgtattcataaccaaaaatatctttaaccgctctcgcgagtgcgtggtagctgcggctgccgctgtaggcttcatcaccacggaacatcgcggcttgcatctcctgcgtgatagcgccagtgccgctgtcggtgagcaggtcaataaatacatcttcactatcgagcaaaaaggggttcattccggcatttaaaatcgccttttcacgatattcccgtgtggtgcgtttaactggttcaataacacgaatacgaaaaggttctggtaagtgtttaaaattttccatgctgggtattcctaaaaattaaaatataaagtcatgcaaggaataaatgaaattccttgtgctgagattgattcactatgcagctataacgtaaataatatctacgtcgaagcgaatgcatatttaatgcttacaaagcttaaaacgcatatttatatttattcaatggcttaactaaacacagataaacaccaatataagtcattagatagacttaaaattgtcgatatctggcagtaagcgatatcccctgcttacttgaagctgcagcgttgttggcaacgttcgttcaccgccaatcccagagtttatctatgctcatggggatgaacacccttgcctactacctgcaattccaagtggtatgggtatgtaaagccatgcgtcaagcaagtaagacagcggaataacaaaaccggattgcagtcgattgactgcaaaaacatgcctagtcatccacgcgagaagggattacgcaggaaagaagaaagcgattttataatcgagggtaaaccagatactagagttgttgtgcgttctcatattttcacctatttgaaatgattcatttcaaacccactttgattatggatgaaaatagccattcgtcatctgacaaatgaataaattgagaatacgctaacaaaaaataaaacagtgggtggtgaatcacatttattccgctatttttctctgcatccagatgcaggaagatatttacttttctcacgcttcgctttagtctgcccgctgagttatcgacgatattcaatattcacaatgtttgagaaaacgcatcttataaaattggcacaaatgaaaatgccatttggtaaatacgcaggtcgagttttgattgatttgccagaaccttatttactttggtttcaaaaacaaggttttccagaaggggagctaggcgtgttactagagctttgcctagcgatcaaaattgaggggctagaatccttagtcaaacctttaaaacagtaaccaaactggattgctgcgccatgttgtggcgatctcttggtctgcgctttcagcgcgagaccaacccatttaccactcaataaggatgggcacaccgggctgaactaggcttaaaaactcatccatttcttgattggtaatggcaatgcagccgttcgtccaatcaaagctttgtacgaaccccggctctctctcatcaccgttttttaagccatgaatcttaatatcaccaccgggatttacgccgcgcaattgagcgagctgcagatcgcgagtgttggggtagctaatgtgtatcgaacggtagaagctcgaatcttcaataataaagtctaaaagatagtgtccctctggtgtgcgttgatcgccttcttgctgcttatgccctttaggcgattttcctagagcaatacgatactcacggatgatttcattgccttggagtaagtacatacgccgtttcgatttatccactttgactaaatcgacttgcgcataactcaggttagggaaaatcagcaataacagcagtacggcagagaaaagacgcataggagacccaagatggaaacaaactgcgcctaattctagcagatatcttctttctacttgaagctgcggtgtggttagccatgctgacttcacactccgcacagcgcttaagagagtgtgtctacctcaaagtccaaatcggtcggggaggaatttgaaaaaccagggctattgcaaggagacagtaaccacaaaaaactgactcattaatgagaaagcattcaaaaagagtatgctattgatgcaataaatggaaacaacctcgcaaaaatgctggctgtgccgaggatgcgatcagttatttaaaaaaagtgcggcgtagttaacagccagaaggataaccaattgattgcttatcagaatttcggccatgatttcgcataaaacaaagattaagtcaggctgcgcatgtttcctcgaaccctactcaaaagagttacctcaagtcgtaattatcgaatgttggccgagaccacgtttgagtacttaacgacatttttattatcgcaatcagcagggatcgtacgagcaccatctcaagacgtggcaggtcacaccttactctcttccaacacgtttacgccgctagaagcgtatcctgaagccttttgggcatgggctgcgcagtttgatacttccgatggtttgatcccttttgccatcaatacctgtcgctggaactatttgccagtgatgggcggtgagtcgtttatttttatgctggataatcatcctcagcatcggacttatctgatcattcaagcggcatgcgtcgataaagtacacctgagcactcaatccggtgagttggattttttacagttaattgcagcgaaatggcaatgcttacgagcggaaattgaagcatcgaaagagtttaaaaatcgtgatttacgtgaggcgcagtaccttagtgaaattcgtcagcgagagcagtttattgacaacatgaagctggtgcatcaagtcgcgctcgagttgtccaaccccgccaatcttgatgagctacaccgcgcatcggtcgaggctatgcgacatcgtctcgggtttgatcgatccgcgctcttgttgcttgatatgaaaaagcgttgcttcagcggtacttatggtaccgatgagcacggtaatacgattgatgaacagcacacccagtatgatctgcaccaattagagcctcaatatctcgaagctttatccaatgaagagtgcactttgatggtggtggaagatgtgcctttgtacaccgtcggacaggtagtgggacaaggctggaatgccatgctgattttgcgtgatggtaatgacaccataggctggattgccatcgacaactatatcaatcggcagccgattaccgagtatcaaaagcagatgcttgagtcgtttggctcattgctcgcgcaaatttatattcgtaaaaagcaggaacaaaacgtacgtatgctgcatgccagcatggtcgaactgtctcgctgtatgacagtcagtgaagtgtgtaaatcggcagtcacctttgcgatcaaccgaatggggattgatcgcatggcggtgtttttgacggatgaagcttgctcttatattcaggggacgtgggggacggatattcaaggcaatattgtcgatgaatcctatttccgtggttcaacgcatgaaaatgacattgtcgaccttgccaaagtgtacccaaacgaagtggtgtttaaagagagtgttcccatctatcacgactgtaaaattgtcggttatggttggacggcgatgaccatgctcaccgacaaaggcaccccgattgcctttattgcggcggataatttgatccgacgttcccccttgacttcacaactgcgtgaagtgattcgtatgtttgcttcaaacctcaccgaagtcttgatgcgagccaaagcccaagaagcgatctcggtactcaatgaaacgctggagcttgaggtgcgtaatcgcactcgtgatttgcaaaaggccaacgaaaaactcgatttaatggcgaaattagatccgctgactcgtttagggaatcgccgtatgcttgagcaccaactggagcaaacttgcgaacagaccatcaaagaggtggtcaattatggcgtgatcttgcttgatattgaccatttcgggcttttcaacaactgctatggtcatcttgaaggcgatattgctctgatgcggattggtaatatcctcagtcgacatgcgcaatctgagcatgaactgttctgtcgtattggtggggaagagtttctgcttttagtcgccaatcgaagcgccgaggagattcacttactggctgaaaatattcgtaaaagtattgaagcagaatgcattgaacactgcgaaaatcccagtggtgagctactgaccgtatcgattggttatgctgcttctcgttataaaccgcgagagattcaatttgatcagctctatgcagaagcggataaagccttgtacagagcgaaaagccaaggacggaatcaggttattggcgttattgttgaaaatatcgactgcatacaggcagaaatgtagcattatccagcagatttcttacgctttggcaaataacacaaataaatgtagcgtttcgaaaaaatacgtgtatagtttatctcggctcttaggtaagagttgttaatgttaaattcagtgaaagttcaatctcagatcgttatcgatttctcgttaaacctgcgtcaactttgtcttgatataccattcaatagctttcgttatcagccaaataaactcatagcaaatatatatcagaggttactatgtctcagaaaatgactggttcagtaaaatggttcaacgaaactaaaggttttggtttcatctctcaagacaacggcggtcaagacgtgttcgtacacttcaagtctatcgtttctgaaggcttcaaaactctggctgaaggccagcgtgtaagcttcaccgttgagcaaggcaaaaaaggcccacaagctgctcaagttactgcgctgtaattagctcagattgattctaaaaggggcgtggtgaaaaccacgcccctttttactttctaatagattgttttctaacattgttttctaacaaaaattgctttctaaaaaatgactttctaatgaatggctttccattcattttttgctttcgatgaatgcgctcttatcccaaacaccctagtgttgctgttcagtgagctcatccctatcagcctcatccctatcagcatagacaagacgtgattctcatcttgcccacactgttgctgcaagacgtggttagggtgtatcaatcggacaagtaatactcaacggtggtgaccacgcgtacatttttgatgtatggcgtattgttatcacgatcagtaatggaaaactgtccttgtgaagccgttttgatcttgcctagcgtgctttgcgaatcttttgcaaacttctgcgcgacttctcttgcctgcttcgtcgcctcttcaatcatgtctggtttgatggcattgagcccggtgaagctaaattcaacgcgattgttgtaaggatcttggttaaaaaccacgccttgcttacccaactgaccaatttcgctaatgattttgcgtacttgatcgacttgtttgctgtacacggtcaaggtttgagtcgctaaatagcgaaactcagcgcggtcttcaccatattgttgagcttttttatcgatcactgcaggtgctgaaagggaaatcgctgcgcgatccacgcctttttccactaagaattgggtaataagctgagtttgctgatcgacagtggcaaacagagaagagagttgattatccgcaacggtaaactgaataggccagatgacggtatcggccaccacttcacgttcagacagccctttcaccgccacaacgcgctcgtactctttaaacttaaccgccatttgttgtaccaagaagcccagtgcggaaagcccgataatcaggcttagtccgagcacagtggcggctttggtattgatattggtcatggatgtcctcccattgattgaccttttaactgacgacagagaagtaccacacctagtcacattctccaccatttttcatcgcgctctaaattactcttaccacgcttaacaagctatccctcgagaacatgaaattgtcagcctcctgtcaaagccaaggttataacggcggtaaggtggatgaacggctgcgctgcatttttccttgctgtttctgtttagccacaaaccaatttttcaagggattgaaatccggttgctctgtccgctccgagaaacaagcttgctgtaatgtatggacaagagccgtcagggtttgctcctcttcttgattcagtatcacttccttttgccaagtacgtaacgctgggctcagagccagtacgtcttgttgctcgatagcttgtagcacggcttgataggcgcaagacggtgcgtgataggccgctttcgttttatggttcgcctgagagtcggtgtgcttgtgacgccacaacatccaagctaaaagggctgtgctgagccacagcagcgcaaacagcagagtgatatatggccaatagccagcgtcgacgacctgccggatctcaggagtactcggctggctcggcgtgggtaatacaggcgtttcttcgctgggtttgacttgcaaagtcatgcctgccacttggctggtctgttccgcttgtgtctgggtgttccaccagttgaggctgaactcgggtaagtgaatttcgcctgcctgacgagggatcagcacttgcttgaatgtcattacggtatcgccattatccagcgtactaaattgtggcttctcagcatagacgctgatgctctctgggtatgggatgtggatgtttggcaattgttgttgagtcaacccactgacttgcagacgaatctcacgtgtaatggcatggccaacttgagtcgagtaggcagtggttgagtcgagcgtttgttgcccatcctgccactcttgagtcaggctcagcttggcggtgggcagccaagtgccctgatagtgtttgggtttttctaatacttggattgagtagtttttggccttagtcagtattgggattaagcgagtattgccactgtattggttaccatacaataagccggccttaagcacaggctcacttaaggtaaactggcctgcctgttcagcggtgatgcgaaaggattgttcgacaatcgtcacttctaccccattgagcacactcggatactgtttcggctcgctcgccgattctaaacgcatgccctcgactttcggtggggtaatgttggggtcgcgtaggcgacgaatgtcttccttaatgatcaactgcgcgtggaatagtgtgctttcaccaggataaagctctgttcgttctaaacggctgcgtacctccgccaactcttcttgggcaggttggtcttgatcttcagtcacttggatcgcgataggggaggtttggtgactccctaactggaaacttgggatagtgactatgcctactttttgcgccgcaagagcaacggtccattcactgcgttgtgagtagttgccattgatgatattggtcgaggaggcaaaactcggctgaccaacaaaaaagtcaggctccagttgggaaaaatcgagggcatcggcagagactttgtcatgactgacaactcgcagctgaaatacttcatttttgaccactttatttttgctgacactggccactaaatcagcggaatgcgcgggaagtgccagcaaacttaccagcagcgttagccaaaaaagtacggattgaaacggtgcgtgtatctttaccatggctgatcgggttccgtgggttgaggtttacgttgggcttgcagaataaattgcgcgcgcagtagtgcactcggatcgcgagcactctcgacttgctccaacttacgtaacatagggtcaagattgggatcagaagaggtggtgaccgacgtggatggctgagcggcattggctttgtcactctgctcatcgttttgctcggttccacttggctgtccattttgcgaatcttttgattgctcccggtgcgcgctgggttccccagcttgcgcatcatccacagcgtttggttgctcctgtggttttgcattcgctttgggctcagtactctcttgtagatcctgctgtggatcaggcgtcgaggcgccttttgtttgagagctcgcctcttgctcctgagctgtatttgagggatttgctgatgagtcttcttgcgcttcttgaccggaggcgcctgatgacgaatcctgctgttgctgttgctgttgctgttgctgttgctgttgctgttgctgttgctgttgctgttgctgttgctgttgctgttgctgtgcagctttgaccacgtctaaattgtgtcgtgcatcttgatgattcggctcttgcttgagaacgtgttcgtacaaatcctgcgctttctgtaactctcctgcttgcgcataagcattggcgagattgtactgcgtggcagtatcagggttagcgatttgcgaataggcgtcaatggccccttggtaatctttggcatagtaacgagcagcgccttgccagcgtggatcgcgaaaggcttcagcggcttgcgcatattgctcattgttgaacatgcgcatcgcttgctgatcttgatttaaccatgcagaggcccaagcctgctggttgggcaaactcacaccgaaaagcagcagtaagctgaaaatcaccccacggcgaaataggcataaagcggcgatcaagaggggcaatactaaccagtaaccgttattgacgcgctccgtgatggcttgacgagaagtcgattcggcaatatcaatcggctgctgagtcaggctgaggatgtgcgccacatctgcgccatccgcacgatacgcagtcagcacgccttgaacactttgtgagagctgctgtaattggtcaaatgcggttttggcaatcacggtctggccttgacgatcttttagcaggctaccatcacctaaaggaataggcgcgccgctaggagtaccgatcgcaagcgtcaccaaacgccatgggctaccttgtaacaacgagatcaatttttctcgttctgtcacactcatatcatcggtgataagaatcagatccccttgctgatgacctgattgctggagcatggtgatcgctaaactcactgcggcagcggcatctgagccttgataaggcatgatgtctggagagagattcggcagcagattggcgagcgttgcactgtcactcgtcagcgggctcaccacataagcatcggcggcgtaagccactaagcccgtgctgccttcttgccaaccttttaggagatcaagtgccttataacgcgcctgtgttaaacggtttggcgctaggtcggttgcgtacatcgagcgtgacatatccataattaacacacgtgcggcgctattttgcacactcggacgttcagcggattgccagcttgggcccgccatcgcaagggtagcgacgatccaactgagtgccaatacacccccaaaagagcgccgcgtgcgagtttcaattcccaacgcttgcgcgagatgaggggcaatcaatccccgttggttttggcgcagccctcgccaagcggcgagcaacaacagaggcaccaacaaccctaaccagtgtgggtagagaaaaatcaacgatgacatgttatctcctcacgataaccaaaatgaccgagagcagcagtgccaaacccagtggatagaaaaaccactcggtttgtgggcgccaagtttgattggattggctaattggctccagttggttaatggtgtcatagatgttttgcaaatcttgttgattacgggcgcggaaatagtgtccacctgtggtggtcgcgatggtttgcagtgtcttttcatccagatcttgcgcggtattcaccttacgactgaacaggaaatctttgaccaccatttcacctgcaccgacgccgacggtataaatcgtggtgttgtactgtttggcgatattggcggcttcaagcgggtcaagcactcctgcggtattgctgccatcactgagcaaaatcatcacgcgttgcggcgcatcactgtcgataaaggttttggtcgcgagtccaatcccttcaccaatcgcggtttgagtgccgataagtttaagtaccgtttgattaagctggttagcgacggtttgtctatccaacgtcaaaggcgtttgcagataggcgtgatcggcaaacaggatcagtccgatacgatcgccttcgcgcttggcgataaattcagacaatacctgtttgactgcagttaacctatccaccatctgctggccagactgcatatcctcttgactcatcgagtaggagaggtcgaccaccagcattaggtcgcgatgtgacgtactggtgctgataggatctccgtaccacacgggtcttgccgcagcggtgagcagcaaaaaccatacaccaaccgcgagtaatcgaggaagccaagtcgcggggcgtgaacctgatgtgctgggaaggtagggcagcttaatcgccgcccgaggtttgagggctggagtaaaaaaatagataacccaaggcagtggtagaaaaaacagcatccaccaccaaataaactcaaaacttgccaatgcctgattttctccgctttttcggcggcaaggcgctttctacccagtgataacagtggtgaaccagctcatcagcattgttcactttttgtttctggtataaggcttgctgccacaaggtttcgttgggtacgaagagtggatggcccacttgggcatctaaaaaggcgtaccaatctttaccggttaaatgcgcaatctcctcgcgagggtagtagcacagtgccgcctgacgaaccaattcaatagcagaagagggcgtttgcggagtcactgtcaaactcaaaaggcgtaatgcggtttttttaggggccagccgacggcgatgccaacgcactgccaatccgataataagcatcacgataagaatgccggctaaacttgcccaccatccccaagccaatggaaaccagctagggagttcaggcagatgtaggccgttgagatccagtgatgtggttgacgattccttcatttcttatggtccgataattgttgcagcaaaggtatcccgcttgaaactgagcggtagtccatttccaataatagacagagtgattttagtttttctttttgagtttcaaaggcttttttgatacctgcccgcgtactatttatcgaaaagttgagccagcgcgtctcttggttattttgtacttgctcaataccacgaaatgaggtgtctccttgctctaaaggatcatgaatctgtaccagctgcacgcgattatggcgacagagttgacgcagcgatagtgcgtgttgctcggtatccaaatcgacaaaatcactgatcagcaccacttcgctgtcttttgggcacaaacggttaagggtactgagcacctcatgcagcgccagtgtgcgcgtcgtgggttgtgtgggtggaatatgctgctgcgcttcaacgcatgccgctaagatggtaagcacgccgcgctggcggctaccgggtttgatttcgatcagccgatgccccaaatcaatcactgcgccaactcggtcttgttgtttcacggcaagccagcttagcaagcttgccaaatgtgccgcttgcaccgatttcagcagtaaacaggagccaaactgcatcgagggactgagatcgatatagagcaccaccgttctttcgcgctcttcactgaacagcttagtatggggtttacctgttcgtgcggtgactcgccaatcaatcgtacgaatgtcatcacccgcttgatattggcgcacttccgagaaatccatcccacgtcctaaacgccgactctgatgctgaccgacgcgctgtgaccaaatttgacgtgctgggggtaaaaaatgcacggtctgctgctcataagcgagcaactcctccaaacacaaagacaccccattggcatgtaaggggagggcgtgtggcatcgtcatgatttatgcactaccaaccagtgacaacaggtgcgagatgattttatttgggtgaattccttccgcttgcgcctgatagctgagcaacagtcgatggcgcagcacagagaatgccattacttgtacatcatccggcgtgacaaaatcgcgtccttgtaaccaagcgtgagcacgggcgcagcgatccagcgcaatcgtcgcgcgtgggctgactcccatcgtcagccattgtgccagtttggcatcgtagttggcaggatggcgcgtcgccatcaccagtcgtacgaggtagttttcaatcgcttcagccatatgcacattgagcacctcttggcgagcactaaacacctgctgctgggttagcaaaggtttattgatggcttgttgtccttttgcctcacctcggttgaggcgcaaaattgccaactcatcttctgcattggggtagttcacctctaaatgcagtaaaaagcggtcgagctgagcttctggaagcggataagtcccctcttgctcaatcgggttttgggtagccatcaccaaaaaaagctcaggtaaacgataggttttacggcctgcagaaatctgtttctccgccatcgcttcgagcattgccgcctgcactttcgctggggcacggtttatctcatcggccagcaccaaggcattaaaaatggggccagattgaaagacaaattcgcccgtttctggacgatacacatcgctgccagttagatcggctgggagtaagtcaggggtaaattgaatgcggtggaaatcaccttcaatacaatcagccagtgatttgacggcacgtgttttcgccagccccggcgggccttccaccagaatatgtccatcagccagcagagcaatcagcagttggttgatgaaatccgtttgacctatgacttgttggtttaggtagtgctgcaaagtttgaaaggattgaaacgacatgaaaacttctactcctagatttctcagcgattagtgttgcgtaacatccagaaagttccacaaaaaatcccacagccagcatggatgttgaaaaaatgcgcatttatatgtggttgaacataaaaagcgactattttaatgaatgctaagcagcgatttataaacagcacttgggtattttcagttgaaagtgtgatgtatggcaactttggaactgggttttgtgagaattttcttaagtggcgtgatcttaagtcgataatgtagaggtttcgtagatagccatgattaggcgggagaatatgttcaaactgcatcagatgagtattaagcaaaaggttgtgttaggggtcactctcgccgtactggcatccaccctgattgtgggtgtgatggcacagcgccaagcgcgagaggtgctagagcatcgcttagtcgatttagaactgcccaatattttgaagttgattaaaagcgatattgaccatgaagtgctacaactgcttgcttctgctcagcaaattgccagcaatgagtttgtgcagcaagcgattgctaccacagaaagagatccagcaacagaagcgttattagtgaagcagttgaacaacttacgcgatcaataccgcctgaatgatgcgtcggtagccaaccgaaaaacggcatattactggaaccagaatggctttttgcgtgagctgaatcagcagcaagacggatggttttttggctttatcggctcaggaaagccgaccatggtcagcatgttccaagaggcgaatggcgaagtcaaaatgtttgccaactaccagttggtgaatggcaataccatgtctggtatgtctaagtcgatggatgacatggtgcgtctgctcaacagttttaaaattgaagacaccggttttgtgtttttgaccaatgcacagggtgaggtacaaatccaccggcagaaagagcaagtaaaatcgagcttacagcaaatttatggttcaggggcgagtgcgctgctgaacaaatccggcttcaacttgatttcgacggactatcaaggtgaagaagtcatggtagcgagcatttacatcgagagcatggattggttcttggtcggcaccgtgcctgtgcatgaggtgtttgcggaattggatgctgtagcacagcgtatgatgctcacgacgctggcggtagctgccatctttatttttatggggattttcctggctaacagtatcgctatgccgatcaatcagatagccaaacgctttaccgatttgggcagaggggatggtgatctctcgcagcgtattgaagtgaaaggcaatgatgaaatcgctcagctttccaaaggctttaatggttttattgagaagatccatcaatcgataaaagacgttgcccaaaccagccgtgagttgcaagtggccgccgaaggggtatcacgcaaagcgttagtcacccacgataatagccagcagcagcgcgaccaaacgatccaagtggttaccgccatcaaccaaatgggggcgacgatcagtgaaatcgcctctaatgcggcgactgcggccgaaacggcgaatcaagcgtctggtaatgcggatcaagggcgtaatgtcgtcaataaagccaaagaggcgatcagccgcttagctcacgatattgaaaacacgggcaaagtggtggagcaattggcgtcgaccactcaagagattgggtcgatcttggatgcgatccgcggcatttcagagcaaaccaacttgctggcactgaacgcggcgattgaagccgcccgtgctggcgatcaaggccgcggttttgcggtggtggccgatgaagtgcgtaacttagcgagtcgtacggcatcctcgacggaagaaattcagaagatgattaaccaactgcaaaatgatgctaagaatgctgtatcggcaatggatgcgggtaaaacggtgactcatcaaggggttgccgcttctgatgaagcagtacaggtgctgatgagtatttcggatcgaatccacgatatttcagatcgcaacacacaagtcgctacagcaaccgaagagcaatcgaccgttgtacacaccattaaccaaaatatcgaagagattaacgcgattaatgaagtgaccacctcaacggcagaagagctggctgatgcgagcaaatcattgcgtgaactctctggccgtttagataagttggtgggcaactttaaactctagaaaccttgccgggagttcgttacacttccggccagtaaaaaccaagtaggtaaagagtgatgaacgatttcgaaaaagagctggagttgatgtctcagcaagttgcagaagagccagaaacgcaactgcccagtctggatgagcaaaaagcgattgcagaaaaactcaaacagttggaagccgaaggcaaattgaccccagaagtgcttgaagcctattttggtcagtattacgcgaaaacggaaacgcctattcactaaggtgggtaccgagttagtccagacgtcatcatcgagccgctttgcggctcgatgtttatcggcttgtcctatacccaaaccacttggagttgcaggtaggcggcaagtgagtaagtccccatgagcatagatagactatgtattgggatgaacgaacgtagccaacaccgctgcagcttcaagtaggaagagtatattcataatatttgtgttctgcgccatgcttctcaacgtgaggtttccgctcaagccgttgaagtgaaagtgagaggcgcttagtgctcgcgatccgtttttgtggtcaggcgctgcaatacatccagcaaaatatcgctggtttgtgcgcctgagattaaatatttctgctcaatgatcaaggtcggcacggcatgaatgcctgcttgtagccactgttgctcagtattggctactgcgttcgcccatgattcatcggtgaggatctgctggcaggcgctacggtctaaacccaccgtctgcgcgatttccagcagtacctcatcctcatctatcgcttggccttgctgaaagtaggccgaccagagggctaaggtgagaggcaactgcttgtcttgctgatgagcccacagcagtaactggtgggctttgcgtgtgttgtagatgcgcatttcatcaaaaaagtgaaacgcaaatcccacgtcgtttccaagttcagtcagcgttttacgtgcttgctggctcgcctcaaggctggtgccatattttttattcaggtgctcgcgcaggttttctccgccgatggctagccttgggttcagttcataaggatgccacctgagtgtgacattgacctctggcagccgagcgagggcatggcgcaatctaaaatagccaatcacgcaccaagggcagacgatgtctgagacaagatctatcgttagcttgtgcatcgtttcctccttaatcagtgctgatgaaaagtataggctttctgattaaatgtacagcgagtgacgtgtgagtgacttgcaactccgagtcatggggatagcgctgaaaaaacgcctcacggcttctttgaaacacgtgaggcgttgacactgacgttgttagtaatggttattcagaataatcaaattgcattaaagctaggctgcttcgcacttttatgccagcttgtttttcgaccaatcgataaaagaatgcaactttgtgatatgtgttccattcaataagtaacaagttcttgaactgtcatgataaagagccatttttgtaaagcgctgcatgcctagtgagcgatgagataaaaaatacccgaaataaacgtttgcgcgaaaaaatgtgatgaaactcatttttttatcgttatactttgcgcccggctaagagccggttgctctgccagtacaagccgtcacaaggaaatgtgaatgaccccaaggacaggaccagctatttcccagcttgtatctgttgatgttgatggcctgtgagcaataaaactttattccctccttttgaggttgcctctgcctacacactgatcaagccatgggtttccctgtttttactcacatttttctaggtaaattatggcgattttgtttggaatcatcggtgttacggtactgatcttatgcgcgtatctgctctctgaaagccgcagtgcgattaattggaaaaccatttcccgagccttgttgttgcaaattggttttgcggctcttgtgctttatttcccattggggcaaaccgcgctaagcagcttgagtaatggggtttctggtttgcttggttttgccgatgtcggcattcgctttctgtttggtgatcttgccgatacgggctttatttttgctgttcgtgtattacctatcatcatcttcttcagtgcgctgatttctgccctttattaccttggtgtgatgcaaaaagtgatcgccctgatcggcggtggcattcaacgcttcttaggcaccagtaaggcggaatcactggtcgcgacaggcaatattttcctatcacaaggcgaatcgccacttttggtgcgccccttccttgccaatatgacacgctctgaactgtttgcggtcatggcgggcggtatggcatcggtagcaggctctgtgctgggtggttacgcaggtttaggggttgagctgaaatacctgattgcagcgagtttcatggcggcgccgggcagtttaatgatggcgaaaatcatcgttcctgagcgtggtgtgccaatcgatcaaagccaagtcgagttagataaagcgcaagacagcaacttgattgatgctctcgctagcggtgcgatgaatggtatgaaagtcgccgttgcagtgggcactatgttgattgcgttcgtcagcgtgatcgctatggtcaacactggccttgaaaatctgggcgatctggttgggtttagcggcattaccttacaagccatgttcggttatctgtttgctcctctggcatgggtgattggcattccaagtcacgaagtgctggcggcaggttcctacatcggtcagaaagtggtgatgaacgaatttgtggctttcattgactttgttgagcataaagcgctgctttctgagcatagccaagtcatcatcacgtttgcattgtgtggctttgccaacattggctctatcgcgatccaattaggctccattggcgtgatagcccctgagcgccgctcggaagtggcgaacctaggcataaaagcggtcattgctggcactttagccaacctaatgagcgcttgcttagcggggattttcatctcgctataatcgcttcaacaagcaacctattgagcctatcccatcggataggcttttttatttgctaagccgtctggttgctaagtcgtttggttgttaagccgtttgggtatcgctgattttgattaatcggtgaaaaactgatttgtaacaactcatcggcgctgagaatacgtagtatggggtgcaattcactgcttatgctccctttcagcgaggttaaatcaacgctgcgtatttgaatgatgagtgcttgtttatgaaaaatcttgttgggcgctttatgcgctatgtcacttttgatactcaatcgaaaccgaaaaaccatcactgcccaagctctacgggtcagaaagtctttgcccaagcgctgtatgaagagctacttgaattaggcttaagtgatgtttcgctggatgatcatggctatgtgatggccaaactcccatcgaatgtgaactacccagtgcccgcgattggctttattgcccacatggacacctctccagatgcttgcggtaagcatgttaaaccgcaaatcgttgaagattatcaaggtggtgatattgcccttggtaaaggggacgaagtgttgtcgcccattcaataccctgacttgcatctgctgcatggctataacctcatcacgaccgatggcacaaccttattgggtgcagataacaaagcggggattgcagaaattatcaccgcgatggaaatcttgcttgctgatccttcgattcctcatggcgatatctcgattgcattcacgccagatgaagagattggccgcggtgccaatcattttgatgtggcgaaatttgcggcgcagtgggcatataccatcgatggcggcccgattggagagctggagtatgagaacttcaacgccgccactgcgacggttgtttgtcatggagtgaatgtacatccggggacagccaaagacaaaatggtcaacgctatgcacattgcagcgcagtttattctgatgatgccagaaaacgaaacgcctcagcataccgaaggctatcaaggtttctaccatctttctggtgcgaccatgagtgttgccaaatcagagctcaaatacattttgcgtgactttgaggcgatcggtttacaagctcgccaagcattaatgcaagctaaagtggccgagctcaatcagcagcttaaaaaaggtcgtgtcgaggtgagtttcgagcagagctactccaatatgaaggagaaggttgagccgcatccacatattattgagttggccaaacaggcgatggtggcttgcgatgttgagccgaaaattaaaccgatccgtggtgggacggatggggcgcggttgtcattcatgggattgccttgtccaaacattttcactggtggctataatttccacggcattcatgagttcatcaccattgaagggatggaagccgcggtacaagtgattgtgaaacttgcagagaaaacggcactgcattatcggcaataaacgtttttcctttgaaaagccgcattaagcggctttttttatgatgaaatttgccgagcagccaagagtttggggatagcgcttgtcaggcaaggggattcaatgttgaaattgcgcgacacgcaacaccacgagataaagcggcgggttaagccgtagtaggagaaagagatggaacatctgagcatagcggtcgattttttgctcacccataagttgctgctgacagcgttgattttattgggtgtgatttcagtgcgccgccttgttttagaacatattcgtggtgatgcggcgctcatcaccgaaaagcaacgcaaatggatgtcacgtaccaaaaacggcgtatttacggtcactttgcttgctctgttcatgctttggcaatcggaaattagcgaatttgcactctcggtgacggcgattgcagtagcgattgtggtggcctcaaaagagatcattttgtgtttcaccggatcgattcagcgcgcgagttctcgttcatttcggatcggggactggattgaagtagggagtgtgtgtggcgaggtgattgagcacaacctcatggcgactgtgatccaagagattgatttacaccacggccagtataactacaccggaaaaaccgcgacgttaccaaacagtatgtttttctctcatccggtgaaaaacctcaattttatgaagcgctatgtgttccataacttcaaaattgtggtgcccgaatttgtgaatcttttcccactggtgccgatattgcacgaaaggattgaagggcattttgcccattttatggaagtggcacgccgctacaatacggtgattgagcgccatgcaggggtggatttgcccagtgctgagccgcacattgaaatcagcagttcatcaacgggagagcaagtggtgcacgtgatgattttctgcccgaccgaacgcgcgaaccaacttgaacaactgatccggcgtgattttatgcaggagtatgagcgggtgtttccacgctcaactcccacgccgatagttcctgtgcctagcgccagttaacgagacctttctattgagtggctgcgggatacagtaatgccgagccgtttggccagccgtgtcaggttggctctgtcggtctggaggcggcgtgccgcctctgcccaattaaagtcagcttgggtgagggtttcgctgatcaaatggcgttgaaattcatccgtcgcgtcacgtaaacccaactcaccaatccattcacccagcataggttcatcttgcgctgtcggttcaaccatcgctgctcttggcccttgtaattcccctaagtcttcaacttttaatgtcgtgactgggcgcccccgctggcgtgctttggctttgagtgccgcgcggttaatcacatgctctagctctcgcacattccccggccaagggtattggataagctgacttaacacatcgccatgcagctttagttgagtgataccgagtttacgtcgcgcttgttctacgaagtatcccgcgagtagggagagatcgcctttgcgttcacgcagtggcggcacgtagatcggatacacgctcaatctgtgatagagatcggctcgaaaacggccagcttcgacctcttttttcaaatcacggttggtggctgctagaatccgcacatcgacggtttgtactcgatcttggccaacaggttgaatttcatggttttgcagtgcgcgcagaattttgctttgcgcactaaggggtaattcacctatctcatcgagaaacagtgtgccgccatccgccagagcaaacttacccattcgcgcgcggtcagctccggtaaacgcccctttaacatggccaaacagttcgctttccagcaggttttcagggatagcggcgcagttgacatagaccagaggctgccgtttgcgatttgagcgctggtgtatggtacgagcaaccagctccttacctacaccggtttcaccgtggatcagaatattgaattgcgagggcgcaaccacatcaatatccgctttcatggcgagcatggggccgctattaccaataatttcgacactgtcacggctccatgcttcttggttgagctcttccagccgtaattgtgtctgtttggcttggttttccagctcagaaaaggtgagcgtcattttcaacgttgctgccgcaatggccgcaagtatttctaaactacgaggtgagagatgatcaaacgcatcgggctttaagctatcgagcgtcaatatacccagtaattgctcgccaaaatggaggggtaagcccatacatgagtgcataggcagatcgtcttcgctgtcgagtagcagcccatcaaaagggtcggggagtgggcaatccgccgcaaaacggacgggtaaatccgcgctgcaaatttgagccaatctaggatgttcactgactacgaaacggcggcctagggtgtcgcgagttaatccctgcatcgccagaggagttaaggtgtcgttgtgcagagacatcagaacgacgcagtcacagatcaccgctttgcgtaccgcatccaataggcgatgaaaacgctcttcgttgttggctccgctggcgagcccgacagtcatttctaacaaagtactcaaggagaattcttgcatcttggcttcttaggttcggattttttgatagtgtagtgtcaaatcgacacgatgagaagagttaaattgacctgttagaaaatgacttatttttatttttcaataaattaggttttggcatgcaatctgctcattaagaaggcttgtgtagagtggctcaagccaccgttttgcctatcgaggagaagttatgctcacccaagaacacatcaatatcattaaaagcaccattcctttgctggagtctgcaggtcctgcgctgacgcaacatttttaccaacgtatgttcagccataatccagagctgaagcatatttttaatatgacccaccagaaaaccggacgtcaaagtgttgcgctgtttgaagcgattgcggcttatgccaagcatatcgataatttagccgcattaaccagtgccgttgagcgtatcgcccataaacacaccagttttaatattcagccagagcattatcagattgtcgggcatcatctgctggagactttgcgtgaattagccccagatgcctttacccaaccggttgaagaggcttggaccgccgcgtatttctttttggctcaagtttttatcgaccgcgaaggcgcactctacttagagcgcaaacaagctttaggtggatggcgtgatggccgaacctttgttgtacgcgagaaacaggtagagtctgcttacgtgaccagttttgtgctcgtacccgctgatggtggtgcggtactggattatcaaccgggacaatacattgggattgaagtgacgccagagggaagtgattatcgagaaattcgtcaatactccttgtcgcatgcatcgaatggtcgtgagtatcgcatttcggttaagcgcgaaggggtgggcagtgataatccagggctggtttctcactatctgcacaacaacgtcaaagttggggatagcgttaaactctatgctcccgccggagattttttctatgttgagcgtgagcggcctgtggttctgatttcggctggtgttggcgcgacgcccatgcaggctatcctgcacaccttagccaagcaaaataagtctggagtgacttatctttatgcgtgtaattctgctaaggaacatacttttgctcaggaaaccgcgcagctcattgcgcaacagggatggatgcagcaagtgtggtaccgtgatgaaagtgcagatgatgtcttacaaggtgaaatgcagttagccgagcttattctgccgattgaggatggagatttctatttgtgtggtccgatcggttttatgcagtatgtggtcaagcagttactggcgcttggtgtggataaggcgcgaattcattatgaagtgtttggtccacatgcacagcttgcggcgtaagagtctctgtcttttggggcatctaagccataagtaacggccgatattacttttcttatcggatcttttgtaaaatcgatataaaagaagcataaaaatagccagcctagtgaggctggctattaaaatctttggcaagtctattacagaactttgatgctttcagcttgtggacctttctggccttgagtgatcacgaattccactttttgaccttcagccagagtgcggaaaccgtcaccttggattgcgctgaagtgagcaaaaacgtcaggaccgttttcttgcttgatgaaaccaaagcctttagtttcgttgaaccatttcacggtaccagtaactggagtagacataataaatatcctaaaaacattttttaacgtaggccgattacggcgcggatagcgtggaaaagtagcttgctattgcgtacgacacggacggttacgaataatccaaccaagcgatgtgtatacaaagaactctttctagccgcgatcgagtctagagtaaaccattggcttgtcaatcgaatcttgaacagagtcgaaacccgttaacaaaaatagtccaaaattttgcactgaatgccatttctatgtaactaagttttctctttgttccgctcatttatgagttgacactgcttaaattgcgtacaaaatgtcgtggctgccgaaatgtggcagtcaattgtatggagctctatcaatgaaaaacaaaccagaagtaataccagtatcgacttcatccgtaggggatacggagtgtgggcgtggtgtagtgaaagacaatgctttgaaagccgtcgtcaccagtaccttatttcgctgccgagtggaaaaggcgaaaaaaggtaaaggtagctattcacgtaaaatgaagtacaaaggcaaagagccttacgcaaaccttacggatttcgttgtgtttgcgtaaggcttttgagcctatatcccgccctgtattcgtctaccgcttccccatccctttttagtcagttttcgctgataaagcacaccagtaaagatgctgtgaaacaggttttacatctcagaatagagaaaatctggcaatcttgaaatgtaacttttttgtttcaaatgtttccttttgttgcttttgatgctttgccttctcttttgcctagtattttcaggctatgtgtatttaaccattgtgtaacaataggtttcattaaaatttggatacaaattctgcatgttttttgagcttgaaataattttttgaaggttcaaaattaactaaaaatgagttttcaaaaatgaatggatgcttttagtggaaatttaaggtaggtgcatcatgaaactgtttttaattctcatgctttctgtatcgggtggcatcgcatcagcggatcacatccaatcatttattctcggtttcggtgtggcttccttagccgttggcagctgttactggcttgcgtttcgtagtacgcgttttccacaactcgccgtttttctgctcctgtgcggtttctttgctaaggttgctgtaaccgtcgtgggcgtgatgtggggaatttcaaatgaactgatgacctcgccgtttgtctttgcgttgtcttatctcttcttctcgattgtcgcgacttatttctggttccgctatcgtgagttggcaacaaaactcaaagacaaaattatcgcaacacagcaccaatcgcactctcattaaccattagctttttaattaacagcacttaccaaacaattaagcagagccactgagctctgctttttgctttacgtagcgattcgatggattgtttattctctttcgacgccgacttgaaactgtcgccacgcttactggcttggctcatcttaatcacctcactttgttcatctcaccatcaggtcaaggtagcgtaagccttagacttttgtacaacagccaaatctcagcacaatgattacactgaggaaaagtgaatcagaggaaatgatcatggagattgtgctgttttggattgagaaactgattctagttagtggaattttgctcgttttgactggtgtgatgcggtacggccgtcgcagtcaagattggaaaggggtggtgactatgttttataaacgcatcccaatgacgattgaagagtataagtggtatcggctcggagtgagttgtattgtgtttgccattatcttacgaattgccctgttgactttctggcccgccatttgatttacgatcccaccaccttttacctagctgtagtgtgaattttgggtatacactttagttactgataaaacaaataaggtggtggcatgtctttccctgttctcatctgtgatgactctccactcgcgcgcaaacagatggcgcgttcgcttcctgcatcgcttaacgcagacattacctttgcggtacatggtttggatgcgatgggcattttagagaagcaaagttttaagctcatgtttttggatctcacgatgccggagttagacggcttcgagacattagaagcaatggggaaaaaaggctacacgacgcctgtagtggtggtatcgggggatattcaaccgaaagccaaagagcgggtgttagcgctcggagccaaagccttcattcaaaagcccatcgataagaatgtgctcaatgatgtgctgaaaatgttggtggagccacccactcagccacgcattgtcacgccggtttcggttgagttgccgattttaaaacggcgcgatatttacatggaagtcgcgaacgtgtcgattggtcgagccgctgatgccttggcgcgccattttgatgtgtttgttcaattacctttgcctaatgtgaacatctttgaggtgagtgagttacacatggcactgcgtgatttggctgaaaacagtcaagtctcgggggtgtgtcagggttttagcggcgaaggaattgctggtgaagcactggtgttattgagtgactctagtgtggcggatctcaaaaaattaatgaaggtgccggtcgatagtgaagacttgcaagagttagagctgctgatggatgtctctaatattctggtgggctcatttctaaatggtttaggccaccaagcagaagtgcgttttttccaaagttcgcccgttttattggggcagcatatctctattgattctgtgattcagtcgaccgaaggggcatttaagaaaaccatgacctttgaggtgagttataacattgaaggcacctcgattcgttgtgatttactgtttatgtttgtcgatgaatcgttaccgctgctggacaacaaactttcctatttaatggaggacttctgatgctagcgttacctgcggagtttgagcaattccattggatggtcgatatggttcagaatgtcgatatgggattgattgtgattaaccgagactacaacgtgcaagtgtggaatgggtttatgacccatcatagcggtaagcaagctcatgatgttattggtaaatctctgttcgagatttttccagagatccctgtggagtggtttaagttaaaaaccaaaccggtgtacgatctgggttgccgtagttttattacttggcagcagcgcccttatttgttccattgccgtaatgtgcgcccagtgactcagcaagccaaatttatgtatcaaaacgtcacgcttaacccaatgcgtacaccgacaggcgcgataaattcactcttcttatccattcaagatgcaacaagtgaagcccttgtttctcaacaagcttcttctcaataaatatgaaacggccatctgatggccgttttgtcagctgttggacaccattatgccgttacccactcatttttatactacgcagcagctcaaacaaggcgaacaagatgccgcgagtgagcgaggtcttgagctctttcatttaatggaacgcgcaggacaagcggtattcaccatcgcttttgctcagtatcccaccagccaccactggttaatttgttgcggtggcggaaataatggtggggacggttatattgtcgcggtattagccagacatatggggattgatgttaccgtatggcagttaggcgatcctgaaaaactgccagccgatgcccatcgtgcttatcagcaatggaaagagttgggtggtgcggtctacgctccacagtctgaagtgcccgaatcgacggatgtgattattgatgcgctgtttggcattggtttaaaagaggtgttacgcccgcaggtggtaccgctcgtcgagttactcaaccaaagtggcaagccgattgtggcggtcgatgtgccttcagggctgtgtgccgataccggtcaagtgatggggacatgcattaaagcgcagcatacggtgagtttgattggattaaaacaaggcttagtgactggccaagcccgctgttatgttggaacgttacactatgccgggcttggggttgaagaagtgtttgcccagcacaatacgccatccttagtctccatcgatggtaagctaaggcacagtttattgccgccacgtcaagcttgtactcacaaaggccaaaatggcaaagctttgatcgttggaggcaatgagggtatgggcggagccttgattttgtgtgcttccgcttgtgctcgttcgggagctgggctgagcgcggcaatgacccatcccgataacgttaccgctatgctgacgattacaccggaagtgatgagcacaagctggaataaacagcatttatttgaagagcgcattgaatggtgtgatgcccttgctttggggcccggattagggcgagatgcgcaagcgcagcagattatgcagcgcttaagtagcttgaaggttccgaaagtgtgggatgcggatgcactctattttctagcgcataaccccagctatgatgcgcagcggatcattacaccgcatcccgtcgaagcggcgcgtttattgggctgtgaagtggaagaggtggagcaagatcgttttgcggcgattcgccagcttcagcaacgctatggaggcgttgtcgtgctcaaaggtgcggggactttagtggatgatgggaaagagatcgcggtctgcttacaggggaatcctggaatggccagtggggggatgggcgatgtacttactggcattattgtggcgctattagcgcaaaaaattcccttagcggatgcggcaaaactcggggtttggctacacagtagcgctgcggatctcaataccaaatcgcatggccagagaggacttctggccagcgatttattgcctcatctgcgtgagttattgaattaattcattacccgatgcttgattgtcaaaaaagagctggatgttattgagcgtagtttgcgcaatattgttcagtgcatcttcggtcaaaaaggcttggtgaccagtgaacagcacgttatgacaagcagaaaggcggcggaatacgtcatcgacgatcacatcgttggacttgtcttggaagaacagatctttctcattgtcatacacatccaagcctagcgcgccgattcggcctcgtttcaatgcttcaattgctgccacagaatcaagcaattccccacggctggtgttaatgatcattacgccatctttcatctgatcgaacgctgactcattgagcaaatgatagttctctttgctcatcgggcagtgcagggtgatcacatcactctgcgcgaaaagctcggacaactctacatagcgcgcacccagtgcaatcgcatcgggattgggataaggatcaaaacagaggatctgcataccgagcccttgcaaaatgcgcatggttgccaccccgattttgcctgagccgatcaccccgaccgttttgccgtggaagttaaaacccaccaagccatcaagagagaagttggcatcacgggtacgctgatacgctttatggaagcggcgattcaaacacagcatcatccccaccgtatgttcggccaccgcttctggcgaataggctggcactctgacgacttgcattccaagtcgcttcgccgcttcaaggtcgactttatcaaagccagcacaacgcatggcaataagacgagttcccccttggtaaagctgttctaatacgctggcgtgaagctcatcattgacaaaagcgcagaccacttcgcagccttttgccatctgggccgttttatcggtcaatcggaaatcatgaaagtgcaaagacagctgggtggggtcaaccaatttgctgaaagaggcgatatcgtagtgttttgcactaaaaaaaatgacgttgagcatagtaattcctgtctcttagagtatctggcctatagatatacccattagtgggaaaaataaaccacaaaatcactaggtataaatgtgcaacaaatggatgtttggacgtctagactgttgacatgcatccggcttacctttaggctttgcgcccaatttcgtcaccatgatttgatatttgcatgcactacacttcgtcttcaaagcctcaacaaccgaatgcctttgccctattaccacttatggttttcttactgctttttatgggcgtagggagctatctcacttggcaaggggttgagtttgcgttctatcaactgccggcccctgttgctgttctgccagcggtcgttttggcgattgccttgagcaaagagtcgctcaatcgagccatcgagcagtttttacgtggtgtggggcacagcgatattatggcgatgtgcatcatttatctgcttgccggagcctttgccgccgtcgccaaagctactggtggcgtagatgccacagtgaatcttggtttagcactgctgccagcgagtctcattctgccggggctgtttgttatttcagcctttgttgccacagcaatgggcacctcaatggggacgattgcggcgattgctcccgtggcgttaggtattgcccaagcggcggatttaaatcttggtttaacggctggggtcgtgctgagcggtgccatgtttggtgataacctttcgatcatttcggataccaccattgcggcaacccgttcacaaggctgccatatgcgtgacaaatttaaagagaatatccgcattgctttgccagcggcgctgttggcgcttgtggtgttcaccttcagcagccaaacggcacaatcaccgcaaaccagtgacattgaatggctaaaagtgctgccttacctcaccattctcgtgttggccgtgatggggttgaatgtgttccttgtactgctggtgggcattttaatggccgcgggtgtcggtggtttgagtgacggttactccttgtcggcattaaccaaagatgtttacgcgggttttggcaacatgcaggagattttcctgttatcgatgctgattggtggcatgggtgaactgatgaaacagcaaggcggattggcgtttctcactcaccacattagccgaatgatcgataaatttgctcgttcacacagtgatgtacaaaaaatgcgagccagtgaattggggattgcaggcttggtggcactgaccaatgtgtgcactgcgaacaacacggttgccatcattgtgagtggcggggtggctaaagagctggctgaacacaatggcgtgacagcaaagcgctctgccagcttgctggatatcttctcgtgcatcatgcaaggagtgttgccttatggtgcacaagcgttattgcttggctctatttttcaaatgtcgccattgagcgtggtgagttactcttattactgcttctttttggcggttgccgcattagtggcggtatttcgccgccacaccatgcgcaacgcctgaattaggcgttgcgattgtcttgcgacggaagttttattcgacgacgctttggtttctgatttttccgtactgtttcacgttctgcgagctgccgacggtagctcgctagatgaaaacgctttctcggttgctgagtttcaaccaattgattcaactgtgtttctaactgctggtttttttcaagcaagagattgagggagagatgatcttgtttggccgtatcatcctcaacaaaaaaagaagccacactcgcggttaatagaccaaacagggtgatccctgtcagcatcaaaaataccgcgactccacgcccaaaccctgtgaccgggtacatatccccataacctaccgtagtaatggtcgacatcgcccaccacagcgcgtcggcatagctattgatggggctaggggttcctttctctaccagatatacaaacgccgcagagagcagcacagtagaaagactcgtcagaccgataaagctgaaggttttttggcgcagaaccgatttggtttgtctccacgctttgggcagcaccaacaaaatacgtaggaaacgcaggggacgcagaaacggcatcgccacgataagtacgtccggccaattttgcatcatatattgcagtggtttagggctgacgaagattttgactaacagctctgtcgcaaaaatgccccacacaatccagagtaagccatcaagaaactcaagatcatcgggagataaaacggcaatgtcaggcagcaacgcgacgacaacataaacgacagaaaggatcagcatcggagtttctgtcgtgttttctactttttctaacagctttttgcgaagggtgagtttcataaaacgaaagtgataaatagcaaatcgtggccttagcctatcaaaaaatgctgtctaagtgtcgcttaaaaacgatattgcccgcctacggtgaaggaaagactcgaataatcttgctctaaggggtagtaactgagctccatagtcagcgccaaacttttgtcgatgctcgattgcactttcgtaccgatgccgatatacggattggttcctgaaaattgacggttatcgccaatcgcacccaattcatagcgctctttcactttgaattgtgatagcccgccgcgagcgtaaagaatcgtcaggttattgataggctgttcgaaaaaagcgccaaaataaaaaccttcaactttgacatcaatcttctgtttttgcgtgtttaacatttcggctccgttgccgatcatgcctgaatagccgagatctaagccgataaacggcgaaaactggtagttatacccaaactgagtaacccaagcttcatcactactggaagggctatcgatacggctaaagcctgtgcttaacgaaaaggaataagggctatttcccgcataagcaggaagtgcaaagcaacaaaaaaccattaaccagccgcaaaaacgtaccatagcccacctgtttcattccctgaaaggattaatatttcctcctacttgaagctgcagcggtgtctgttaccttcgtttaccccaatcacatagcctgtctatgtcatgaagattgtcatgaagattcactcattgactgcgcatctacaaatccaagtagtttggatgccgaatgcaagaatagatttaaagttaagcaataaatgcgccgaatggataagcgtggtgaattatttatacgtgatgtgagcttgatcgacttcgaaaacggagcttgtgagttgctggaattttgccctacaaaaaggtgatcaaagtctaatttatggcaatttaaagcgagggcaatcgattgttcagtaaaaagcgatatgtcggtaatttgacaaaatagaactaacgtactgtttggtaagcaatttaagagttgagtgttacagaggggattgtctaggtatgaaaacttcggcagggtaacacaaaaaaaagtcaaatatcagtcttgagagaaaaaaaacgcggcctataatgctgaaaaccggagcgtctgccaacgctccggtttttttgtgtccgaaatgtactgacgtctgccaacgaaggtactacgcactctgctaagagacacaaatggtcaattaatcaaggaattacacaatgcgtatcgaacaagaacttaagttaggttttaaagatgtcctgtttcgcccgaaacgttcaaccctgaaaagccgttctcaagtaaatttaacccgcgagtttactttcaaacatagtggtcgtcaatggtcaggcgtacctgtgattgccgccaatatggactcggtaggcagttttgccatggctaaagccttggctgagcatggtgtgatgaccgcagtacacaaacattacactgtggctgattgggctgagtttgtgaaaagtgccgacaaagcgacgctgaacaatgttatggtttcaaccggcacatcggaagcagatttccaaaaaaccaaagatgtgatggcactgtctgatgaactgatcttcatctgtatcgatatcgcgaacggctattctgagcaccttgtcgagtacgtgcaaagagtgcgcgctgcatttcctgacaaagtgatttctgcgggtaacgtcgtaacaggcgatatggtagaagagcttatcctcgcgggtgccgacattgttaaagtaggcattggcccaggctctgtgtgtacgacacgcgtaaaaaccggtgtcggttacccacaactgtccgcgattatcgaatgtgcggatgctgcgcacggtcttggtggtcgcatcatcggtgacggcggctgtacgtgtccgggagatgtcgcgaaagccttcggcggcggcgcggatttcgtgatgcttggcggtatgctggcaggtcatgaagaagcaggcggtgaactcatcgtaaaagatggtgaaaccttcatgaaattttacggcatgtcatcgaagagcgcgatggacaagcattctggcggtgtagcaggttaccgtgccgccgaaggaaaaaccgtactattgccataccgtggcagcgtacacggcaccattcaagacatcctcggcggtgtgcgctcaacctgtacctacgtaggcgcggcggagcttcgagagctgactaagcgtacaacttttatccgagttcaagagcaagagaacaacgtctacgggcgtgagtaagcgcatagattctcttacattaacgaaaagagccgctttgagcggctctttttatcctgtgagtggctgcgaatcttctacgcagtcgcttgctttcgtggccttggggtaacattcacaaaacctaggtttttgctgccgtctgctaaattactaatggatatgtattaaactccaagtactgtgttaatatacagttcattcgaattgggctagaactcaatgtttgctttagtttgttaaaaacaaggtaaatattgggaggtaagctattttaatatgtcactatgttatgccatgaggtagtatggtgatacagttaattgataactttgacagtatgggctttcaatttgttctctccttctaaaccaataatattttctttcttcgctggtagcggctttctagacttaggttttgaaacatcaggctttgatgttcgttttgtcaatgagtttcataaaccattcctggacgcttacaaatattcaagagaacatatgggcttacctaagccgaaatacggtcattacttgggcagtatcgatgactttgtgactggtgaaaaaaaacaattactttatgatcttgtacaagaagccaagtctgaagcgttaactggtttcatcggcggtcctccttgtcctgacttctctgtggcgggtaagaacaaaggttcagatggtgagaatggtattctcactcgtgtctatattgatgctatcgttcagaatcaacctgattttttccttttcgaaaatgttaaaggcttgtggaagactggtaagcacagagctttttatgatgctatgaaagcacatcttgaagatgcaggttatgtgcttacagaccgattaacaaatagtatcgaatttggtgtaccgcaagatcgagaccgtattttgatgttcggtatccatagaaagcatgtgggtgataagcttaccagcatagaacttgccagagatttcgattgggagcgagaagtaaaatttgataaaacgaaagtcctagataaatcgatttggcctgaacttgcaacttacaaagagaattcaattcgaaagcttccaaagcatttagataactatcgtgagttgacagtagagcattggtttcaaaagaatgatgtgaaccagcatcttaatgctaagcatcattttaggccgtattcggataagttcaaaacaatccaagaaggtgatgataagaaaaagtcattcaagcgtttgcatagataccgtttttctccaactgctgcttacgggaataatgaagtgcatttgcatccgtacaaacctcgcagattaagtgcagcagaagcgcttgctattcagtctctaccgaaagagttccacttacctccaactatgactctttcagatatgtttaagactataggaaatggcgtgccatttctcgcctcaaaatgcattgctcagacgattcataattatctagaaagtttgtaaaaagggagtcatttgactccctttttacatgcttcacagcgtagtcgcttgtttctctacacttccaattaagccgtgctaatatagcgttaataaacaatactttgttagtcggcgcatgttatgaaacttgaagaagttttaggttatctagaacagatggttggtttgaaacttcaacccataaatgaatcaaatgaatcacttgttatccttgaagttgaccgagagaacagccgttatacggtagataagacccaaaccacacgaaaacgtactcgtcctttcgttgagctacaaaagatattaagcgcattaaaccagaaaggttttactagtgtagatcaggctctagggggcgctggctcgagtcgtcatcagccagaaactatttttgccaacctcccatgtattgaacattttaagtatgaaaaaaagaaacacctttacttaagagattctaatacacatgagcttggaactattaaagagctaacagcatctgaaactcgagaaattaagagaaaaattgatcgatatcgtgatttcgacgtctcccaattttatgaactgcacagagaacaaactatacaacttaaacacaaactagatagtatttttacgaaatatcctggtgagagtgatgtagatgcagttaaagacattatagaaaaaatccaagaactagaagttcgactttctgaagccatagtaagtattgagcaaaatgaaggacaatccttttctaaaagtattgatgatgattcgatcccatttggtggtgaagaatcaggtgatgataacaatgatgagcgagaaacgattgacactgatgttacgatcgtaaaggggcttaccccaacaagaattacccaagttagtcctacagtatcacttctatacgaccgtgttttacacaatgaaatagatttaacacctgaatatcaacgcaaagatcgtatttggcctataaaagatagagcccgtctaattgagtctattttgcttggtctaccgttacctgtattctattttgcagaaagagctaataaagatgcagagtctgaagtagattttgattgggtggttattgacggcttacagcgtacaactactttagtagatttcgttcaaggtaaatttgctcttaaagatttaaatcagttaccgaagtatgacaactgttatttcaaagatttaccgaggaaagaacaacgaaaaattcgagaatatcaaattcatggtcatttgattcaagtatcgaatgatagcgaagaaatgattcgtgagttatttcatcgtatcaatacctatgggaaaaacttgagttatcaggaaatacgttcagcattgtatccaggttcgactaatcgattctgtaaatatttctcttctgaaaatattttcttagatagtattccagctaaagttagcgatgagagaatgctagatgttgagtatgttttaagggctgttgcttacctcgtattaggatttgaaaaatatttttataaaactaatgatgacttcttgtgtcatacaatgaaagttcttaacgcatttcattatgataaagataagggtgtttcttcgtcagatagaatatttcagataattgactataaattaaaagagtcactcaaaacgatatctgtgatatttgaagacgatgcatttaaaaaagaacctaaaggtaagttgaataagatattatttgagttgttagtttctatatttgccatgatgtctgatgaacagcgggaaataatggtaattcctgagaatgcggaactttttaaaaaaaccatgtgggacgcgatatctggtgatgaaaaaacgtctgattgggagtctgaaatatacaaagagctgggaagagggtttgattattctattacaaactctacaggtaaacgagtgacggttctataccgatttagaagtttggttgaatttattaataaagtgcctggcatgatttttatgccgcaaggaatgttggaaaatgaaaatttagtcatgggtaataaaaatgattaacgaagtaactttaagaaattttaaatgttataaaaaccaattatttgaacttgctaatttgacggttttttgtggaaataattcgtcaggaaaaagtactgtaattcaatccttattgctaatcctacaaaataacttctctaataaattggaacttagaggagattatgtgcaaccaggaagttataacgatttgcacaatagaaatgctgatgaagattcgttatcaatattaatcgataccagcgttggagctgtctcttggggttatagtgaagatgagttttcgagtcagaaaagaaaggaagtcgaagaggctccactacctttattagacttttctgacaaaactgttctacacaagcttcgagagttatatgaggatgaatttatttaccttcatgcagagcgttgggggccaaggagcagttatccatattcaactcgaagacgctcacaaaactggttaggaacaaatggtgaatatgcaccacaagttttagaactggtggttaaaaatattcagacaatgcccagtgatgatgtacgtatacaccctaatctgactgatggctctgtagtcggtatagcgcagaacttatttgaatggatgggggaaatttctcctggagtttttattaaggctcaggcgtttaaacatgcggacattacgacaaatcaatacacttttggtggtgagagctacagagccgtcaatgttggttttggtttaagctatgttctaccgatcgtcttggcacttttggttactaaacctggtggactagttattattgaaaatccggaagcccatcttcatccgagggggcaaagttatttgggcaggctaattgctcttgctgccgaggctggagttcaagtcgtagttgagactcatagtgaccacattataaatggtattcgattgatgccaaggctaggaaaggttcaagataaaaatcttcttttttatcaggttattaatgaggatgtaggtacaactacagttaaaaaaataatcgttaatgcgcaagggcaattttcagaatggccagacggtttctttgaccagcaagtattagatatgcaagtgttaatgactggacaggataaatgaaaactatagtttccgtttcaaatttcagtttagattcgtgcaagtttagtagttttatggagatagatacatcgctttccaagttaaaaaatgtcctatcattatttaatcaagagagcgtagagtattacgcaggtaatgacattttagagcataaaggatttgggctatcgtttattgaacaggctaataatttctcttatgctggtgataaaggtgtacaagcatatctatatagtaagttatttcaatcatacttaaatggttttactcttactttttctacagatgaattaatggagagagcaaatagatttgtgctagaggaatgcaatgaaagctatatcttatacgctccttgtttaaatgtttacagagtcaatgttattaatagtgttgatgacttttattctcactatgagaatttattaagtaaatacccagtcgatgagcatagttattacaatcgagctaaaagtcattttaaaaaaatcacttttcattctgattgtggtgataccctaaagcgtatcggtgatggcggtataaaaaacttttcaattgcaataacgaagtgcttaaaagccctaaatgaatatcaagcacaaatgaaaatccctgaggatttaactatattaggtggtttggctgggtgtgactgtacgacacagggtaagaatgggaaagatgatatgaagtttattttccctgaaatttcaacaaaaaatgaagttaattgtgaatatcatttaaaaccttacagtagcaatgatccaaaagataataaatattaccaaaagcgtatttattttacttttgccaatgttggtgggtgtatcaagacttttgttgctagcattggacctcatttataaatataaaaatccgccttcttagaaggcggttttaatataagccccctaaaagggggccacgacgctgttagtctctcaataactctaactgctgctcttgctcaagctcttttttgtcttgatgccgtacataccgtctaatgatttcttcatttacacctaccgtatccacaaaatagcctcgcgcccaaaaatgatttccccataactttttcctgatatgtggaaacttgttgaatagcctaattgcactcctaccctttaaaactcccatcaacgtcgaaatcgatactttgggcggaattatcgcaactaagtggacatgatctggctgaacattgagttccaaaacttcacaatctttcatattacaaagaatgtagatcgaacgatttagctctttggcaacattaccttttaagatcttaaaacgaaattttggtgtccaaacgatatgatatttgcaacgccaatagacgtgtgatgaacttctgtagtcgcccatgttatttgaatcctcttacttatggtgaataagagtttgtcttctaacatgggcgcattttcgggcaaaagcccctagggacaatcaccaccgctaaaagcggtggtttagggatgacaataaaagagcggctataagccgctttcttttccttcaatcttcgctagtaagttaatcgtgaggtcttccctacctttaccactatgcagccttctatggcagtttgggcaaacaccagcacagttttctggtttgtctttcccgttatcgattagtcgaattaaatggtgaacttctaagaagggcttaccttcatccgtttcaaatggggctggttcattacagcactcacagatgccatttgctcgtctgagaacccatgctttaaccgttaggtgtcttagaaatcaaatgtggaagtaggtgtttgccatctaagagataccgaagatggcagccgatacaaactactggatctgtcccttcttaaatgtttaaacgaagttacccatttctaacagggcgctttgtcggttttttcggctccgaatgagtgccgccttttttcgctgtgcgagcttgtcctgtaggctggcctcggtggccagctttaggtttgttttcagctacgctgcctttgttttctccagctccctctacctttttaggctttttgggctttttcggcttcaaaggtcgagtgtctaattttgactcagggagttggttggtcggctcaaatcccgctaaatttacacggggcagtaaggcttgcgttaaacgctcaatcgcaaataattccggtgcttcaatggcactcaccaaagaaatcgctttaccgacttcacctgctcggcctgttcggccaattcggtgcacgtaatcttcagcaattttcggcaattcaaaattcaccacttgaggcagttgcgggatatcaatgccacgcgccgcaatatctgttgcgaccagaatacgcacctctcccgctttaaaatccgccagtgctcgggtgcgtgcgccttggctcttattgccgtgaatcgcggccgcggttaaaccttgctcgttgagataggtcgctaagcggttggcaccatgcttggtacgcataaataccagcacttgttgccaattcccctctttgaccaatttcaccagcatgtccggtttctttttcacatcagcaggataaatgcactgctcaacggttcttgccgttgagttggctgggctgactgaaatttcgacggggttattcaccaagcctttggcaagctcacggatttcggtcgagaaggtagctgaaaacagtaggttttggcgcttttcaggcaataatttcagtatcttatgaatgtcacgaataaagcccatgtcgagcatgcgatctgcttcgtcaagtaccaaaatttccaactgatcaaatttgaccgcattttggttatacagatccattaagcggcctggggttgccactaagatatccgcacctttacacattcgctgcatttgtgggttaattttcacaccaccaaacacaaccgcgctcttgagcggtagatggcggccatagagcatgacattgtcttggatttgtgcggccagttcacgcgttggggtaaggattaaagcacgaacttgattggcgcgaacttttggcccttttgccagcaattctaaaataggtagcgtaaagccagccgtttttcctgtgccagtttgagctgcggccatcacgtctttgcctgctaaaaccgcaggaatagcctgtaactgaatcggtgaaggcgtgttgtatcctttctcttcaatagctttaaggattggcgcagacagaccgagcgaggtaaaacccatatatcattctcaacagtaatcaaataacgcgggaagtccgcgcaaagcccgccattctgaggcctttattgattagtagcaaccgctatctacaatgccaagtcatttggggagagagagcatgaagattggtcgtcaataaaaagagccacatgcagtggctctttggctattggtgacaagctttgtttagccgatgatgattttgctgagcacaaatcctacacagcaggctgagatcacggaaatcagaccgacagccataaaggagtggttgaaataccacttaccgatcttggtggtccctgtgttatcgaagttgacggtggcgatatccgatgggtagttcggaataaagaagtaaccgtacagcgctggcatcaggccaatcagcaatgccggttctaaacctagccctaaaccaacagggagcatcatccgcgcgactgcggcttgtgagttcaccaccacagacacaatgaacagcgccagagcaaacgtccaagggtagttggtcaccatctccacgatgccagatttaaattgcggcatggcgtattggaagtaggtgtcagacatccacgcgataccgaagatggcaatcgcagcaaccatgccagatttgaacaccacaccgttaggtacagagcgtgggtctgttttggtggcgagcaaaatgataccgccgaaacagagcatgatcatctgaatcaccatgtccatgcctattggcttagtgccttcttgaatggtgcggatctccggccacattgcaatcaccacgatcactaaaatcgaggagatgaacagcagcacggagttacgtgctgacgctggcaaggtttcatcgagtgaggtggcggtggtgttgaggattttctcgcgccagacggggtcttgcagtcttgcttggtactcagggtcgttatccagctctttaccgcgtctcaaactgtacagcgacattaaaagcgtaccaaacagggtagcgggaatcgtcaccatcaaaatagagagcaaggtaatgttgtggttgatattggcgagttcggctaggtagtagaccacggcagccgaaatcggcgaggcggtaatggcgatttgcgacgcaacggatgctgctgccatcgggcgctcaggacgaatgccatttttcagggcaacgtcaccaatgattggcatgatcgagtaaaccgcatggcctgtacccagcataaacgtcatggtgtaagtgacaaaaggggcaattaacgtgacacgttttgggtttttgcgcagcatgcgctccgccacttgcagcatgtattttaagccgccagcggcttcaagaatcgaggcacaggtgacgaccgcaaggatgattaacatcacggtgatcggtggtgaggtcggtggcatcttgaagacgaaaacttcgataaccaaaccaatccccgaaacgaccccaagcccgataccgccgtatcgtgagccgatatacaacatcagcagtagaaaaagaaattctacatatagcatcccatgttccctatattgaaatgaagttatatgtattgtcggatttcatttgcaaaaattatgaagcagagttcacagaattctagctggaataaatgagatctcgttattcaggtgggagtcacactatcgggctgaaaagtaaagatttttagtgattttttgtaacgagtttgttgcgtcagacaaggcgatattttgactatcaagccaagcgaaaggcttggcttgatgtaggtcaataaggcgtctagtcgtaaatggtcggaataggctggcgcttgtgctgagttgcgtgataaatcgccactaaacgctggctaacttcggcaggtacggctttaccttccaagaaatcatcaatctgttcataggtcaggtttaaggcggcttcatcggctttttgcggtgctaactcttcaaggtcagcggtaggggttttgtaaaccaactgttcaggtgcgcctaacgtttttgcgagcaagcgtacttggcgtttgttgaggccaaacagtggggcgaggtcacacgcgccatctccaaacttggtataaaaaccggtgatgttttctgcagaatgatcggtacctagcactaaaccgccgacatagccggcaatttcatactgcgcgaccatacgcgcacgcgctttcacgttgcctttgatgaaatcaaccttagccggatcgcttgggataagtccggtattcgccagtgcgtggtgagaggcggcatgcaaaccatcgactccggctttgatgttgacggaaaccgagtgagttgggcgaataaaggagagggcgagttgcgcttcatcttcatctttttgctcgccgtaaggtaaacgcaccgcgataaattggtactccgtcgtattgtgttgctggttgagttcttcaaccgcaagttgagccaagcgaccacaggttgtggaatcgacgccaccactgatgcccaatacgagggatttgcagcgcgcttcagtgagcttacgcttaataaaagctacgcggcgttcgatttcaaactgtggatcgatcgaaggcagtacgcgcatttcttcacggatcttgtgttccataggttcctttcctgcaagcaatgtcaatttttcggtgtatgataccgcaatcgttgaattagaaaaccgagaaagggcatttcccgatcggcaaggtgcacaatgaaaaagattgcggtgtttggcagcgcctttaatccgccgaccctaggtcacaaaagtattattgattcgcttggtcattttgatttgattttgctagtaccgagcattgcccacgcttgggggaaaaccatgcttgattacgagttgcgcagtcaactggtggatcaattcatccaagatattggctcaaataaagtgcagcgctctgatgtcgagcaagccttatatgctccgccagaggccgtcactacttatgcggtgttgacgcgattgcaagctctgtatccggaggatgagttgacgtttgtgatcgggccggacaatttgcttcactttggaaaattctacaaagcggatgaaatactgcagcgttggacagtcatggcatgccctgaaaggttgcctatccgcagtaccgcgattcgcgatgctctgcaaaatggacaaccgattacagacatgaccacgtcaggggttgagcgccttttgcaccagcagcagctttacactagcccaagcttctaaattttcactggctgaggattcagccagtgaatgccccatcgtagctatttcattcatgttgctgcacctcgaactgctcaatctaggacgcgagctctactgcgcgcgtattaacggtggaatgaggcgctgaatatgattttatgatggcccagccacacacatattcacgaatttatcattgaaaatagtgcccatacctctcggacttcaagctattgtgctaaacctaaagaaggttgaagtggtttaaatatggagatggcatggatctgtttgcagatatgcgccaagaggccgcaggggaaaaagaacgggtagtcatgcatagccaagagccttggtgtgtgttgttagtcgatgatgatgagcagatgcaccaaatcacacgtttagcattgacggggttcaagtttcaaaatcgtccccttgaattaatttcggttctttctggcctagaagcgcgaaaagtgatggcggagcgctcggatatcgcactggcgctggttgatgtagtgatggaaaccgaacacgcgggcttagacttggtgcgttacatccgcgaagaactccagaaccgtcaagtgcgtttagtgctgcgcaccggacaagcagggcaggctcctgaagatagggtcatcaaagagtatgagattgatgattacaaagaaaaaacagagttgacgactcaaaaactgcgcaccttgctctattctatgctgcgtgcttaccgagatttgtgcttgattgaagatcagaagctcggtttaagtcatgtgattgaagcctctgcgaatgttcaaaatacgaaaagtctccagtcttacgctactgcggttttgaaccaattgacttcattgctgaaattgcacgcttcagctttttattgcgtggcgacaccttgtcccgatagtgaaaaatgtaacgctttaaccgtggcaacaactgctgaacgggttgagttatacgttgaatctccctttaaaggtttaccggaagacgtgcagcgtcgttgcaaagaagtgttgagtcagcgcacgactcgcgactacggcgatgcttacgtgttctttaaacaagatgaacgaggtgttgatagcgttctgtatgtaggttttgagcaggagctttctgaactggatagaaaattgcttgagatctacatgtacaacatcggtcttacctttgaaaacattaacttgatggtggacttgcgtgagacgtcgaaagagttggtatacaacttagccaatgccgtggaagcacgtagccgagaaaccggcgcacatgtacaacgtgttgccttgtattgtgagcgattagcccatttatacggtttagctgaatctgaggctgacatgatcaaaaatgcctcacctttgcatgatgttggcaaagtcgccattccagacagtatcttgcataagcctggtaaacttgatgcccaagaatgggcgatcatgcaaaagcatgtggagtatggggtcgaaatccttaaccgttctaaacggcgattaatgcaagtggcgaaagaaattgccgccactcatcatgaaaaatgggatggcagtggttatccgaaccgcttacaaggcgatgatattcccatttcaggccgtattactgcgatagccgatgtctttgatgctttaggcgcgaaacgttcttataaagatccgtggacagatgaacagatccgagaagagttaatggcgcaaaaagggcgtcactttgagccgaaactggttgagctattactcgaacactgggatgagtttattgctatccgtgcttcgctgcctgactaggacagcgacaaaagtgaataccggcagaaatgaataccgatggagcgctaggcgtggctaggtcgcacagtcggctacttgaggcatcgatagcgcttggggtaatgtgatcacgtaatgcacgccgtgccccggttcggaagaaaacgccagttggccatgcagcttttgcttaaccaaattaaacaccagatttaatcctaatcctgagccaccttgacctcgcttagtggtaaaaaatggttcaaagattttttgatgcagttcttttgctacgccgcatccattgtctcgatattcaatcatgatctgctgatctttttgatagaagtggatatcaatctctggctgagcagtctctgcgaaagcgtgattcacactgttcatgaccaagttagtcataatctgtgtcagtacaccaggtaagctgttcatcatcacagaatcctccccatgcagttgcggagtcaccggaatttttcgggtttcactgtgtaagctggccatcagcgcgtcgaggacttgttttacgtgaaattggctacggctttccgaaacttggtcgacggcggtctgcttaaaatctcgaaccagtcgtgcggcacggttaagattggtttctagcatcagggtgctttgagtcatcctctccatcaattctgcaaactgttggctggtgagggtttgctgattaaaggcgttgagcaagctttctcgtgtttcctgaatcacagaagtggctgtcaccgcaatacctaacggcgtattcacttcgtgtgcgacgcctgccactaagccaccgagagcggcgagcttttcagattcaatcagttgggtttgggtttcttgcaaacgagttaaactgagtgctaaatcttgcgttcgattcgcgacttgctgctccagatcttggttcatgatttctaaactcaattgagccagtttgagcgaggtaatgttgattgcagtaccacgaaatccgagaaattgctcatcggcatagcgagcaatgccttgaaacagtaaataggcttgagtgccatcactgagtgtcaattccacttcacaatttgagaaatcttgctgtttgagtaagcagttcatgagcgcggttgaggattgaagcggagcaatacttactatgagtggtttggaatcttcctcaatcgctaacgcagtagacatggcttctgagctataaatcagctcgccatggcagttggtttcccataaccaatcggaggcggcttgtgcaaaatcttccaaccgttcttgctccgatttgatggtgcggtaaagggttgttacgttgttagcaatccgattagtttcatctcccagccattgtaactcatcatttttctccataatccaagggttataaggcagttgtagtggttttttagggtggcggggattgtagcgacgtagaaattgcgcaatcgcaaaaatccgctgattcacactggcgtggaaaatcagcaagattaaatagcacacaatggcggttttcagcgcattgacggctaaggtgagcagaaactggcgaatcagatagttataaataccttgggcgtccgattcgacatataaggtgccgatattctcagtcacctgagtatctgggttggtgtattccagtgctatttcgctatttaatgccatgctggttacgggttctccggctgagaaatggtagtcgccagaggtgatcttcatataatcgacattgggtaagttgaccaagccttccagcctttgggtaagcacgactaagtcataattccacagtgagctggcgagaagctcggcgtgaatggtttggatttcatcatgcctagcttggacattattgaactcacggttgtagtcgatgaaggtttgggtaatcgtcatggctaaagtcacggcaccactgagtatcaccatgatgagaatgatgcgtcggccaatacggctgaacatcgggttactgtccatttcttctgcgtcacggtttttcattattatctattgttttagaagtaattcatttcagtatagatggtctatgccgtaccttccttcccacttggccaagttataggcagaaacatcagctacacttgcctataccctttctgcttgaagtaacggcgatgttggctacgtttttgatctcagaggcatagtttctctatgctcaagggaatgagctcacagtggcatctgccaccccaagtggtttgggtattaaagcgtggaggaagccatatgcgctggtggatggttatagtgtggttattgagtggccaagcatgggctgccaatgtgttggtgattcaaagttatcactcgggttacgcgtgggatgcagcctacacaaaaggattgaaagaggggattaacgcccaacatcaattacacttttttgaaatggatacgaaacggattcccgctcgagaatacagcgtggctgccgatcgtgcatttcaagcttatcagcaattgaaacctgatttggtggtattgggcgatgacaacgcactctattatttgttacccaaactgtataacgaacccatctcgattgtttttctcggcatcaactcaaatcccagagagttgctggatgagtattcggggattgcgcaggtaacgggcatcttagagcaacccttgtttgtaaaaaatatggctgaaattggccgcttgttaccgaaagaaaaacggcgtgttttggtgttgtttgactcagggaatacctcaaaaattgccttggattatatgcaagatcaacacaagctgattaaggagaatttggggatagaggcggacatccgttctattaagagcgaacaagagtggaaacacgcggttgagtacgcgaatcaagaaggctttggagccatagtggtgggtttgtatcaaacccttgtcaatattgatgggttacatgctgctcctgaaaatattgtgagttggacgaatgagcattctcaactgccgctgtttggcttttgggatttctcgatcggcaaaggaaaagcggcgggtggcgtggtgttatttgggttagaacaaggagagatggctgctgagctggtgacgcgtattttggataagcaagagcttgccaaatatattccgatccaaattaaccgccaagggagaggtgtttatcagccagaagagtttgcgcgctgggggttaacgccgccgaaagattggacacctatcgatgaataagcgctgcacttagtttataagttgaaggtgtgttgtagataaaaacaccgcccataaagggcggtgtgagaaagaacttaggcttcaacaggttcttgctgccaacgtttttggcgtaggttgaaggcacaaaacagcacaaaccatacactgctggcggccaaaccagcccaaacggagtgcaataagcccattgccaaataacccagtagtgcgcccattgctgcgctgatcgcgtaaggaagctgagtcacgacatggtcaatatgatggctacctgcgccggttgctgacaagatactggtgctggaaatcggtgaggcgtgatcgccaaacactgcgccggccaatacggcggagagagtcggtagcattaggctgatgtctgatgccgcagcgatatcacccgcgagtggcagcataatcccaaaggtgccccaactggtgccagtggcgaatgccattaagcaagaaagtacaaacaccaaggcggggagcagttcaaccggtagattgccttgagtcagagacgcgagataaatgccggtttgtagatcgcgcaccacaccaccaatcgtccaagcaaacagcagaatgatgattgctggcatcatcgccataacccctttgggtgccgtggatagccacgtttgcgccgagagttttaagcgcagtgacagaactatcgagaccgccaagctacacagcgccgcataaaccagtgactgagccacattggtattttcgagtgcgccaatcaaagagaacgcttcaccgttagcggctaagacggcgttaccggtttggatcatgaaaatcaaggtggtgatggtcagtactgcgatgggcaacaccatatcaatcatggtaccgcgagcggtttctccaccttccatatctaagcccgcagggcggcctttgctttcgtcccacaatttaccttcacgagcccacgcttcgtgttggcgcatgggaccaatatccatcggcaggaaaatcaccgcgagcaccataagcagggtaaacacggcgtacagattcatcgggatcatctgtacaaatgctgaaatcgcactgatttcggtcatttcgtgtgccgctaaaatgccgcctatgagagcgatgatgtaagcgccccaagaggaaatcggtgtaatcacacacacaggggctgcggtagagtcgagcaaataggcgagtttcgcgcgcgagatttggaagcgatccgtcactgggcggcaaatcgcacccacagataggctatggaaaaaatcgtcgatgaaaaaagcaaataccatcaaacccgtcagagcttttgcactgcggcgatctttgcatttgcgctcagcccataccgcgaaagcacgcgttgcgcctgaggccgtcattaagcttatcaaaccacccagcagcagcataaacagcagcatattgatgttatcgctgttggctgcaccttccgcccaaaacagaccgctgatctttccaaacaggtattgtactgtactcagcggggaaaaatggttaagcataaccgcaccagcaacaatgccagcgcctaaagagagtaatactcggcgtgtggtaatcgcgagcagcaccgcgagtagcggtgggatgaccgagtaaaccgagtcagaataaggggctaaattcatggatctcacatcaccttttcaggtggagatctaccagcaggataaaaaacacatttcagcgaaataacacttcttatccttcaaggtagcgctccatagacaacacactatggcagtccggcatttgttcaatgctggcccagcgaacgttgatgacgcaacgatcacttcggcgctgtaccctttaaccagtcatcatcggggtcaacctacgactggcgactcatgaacagcgcgcctctacttaaaggaacttgtgcccgtcgaagagctaggctcagaaactgtgacacacgacgtatattactgccttttcaggtgacgacaagatttaatttccccatttctgcagtgaaattgatctcatccggtatattcgctaaagggtcagaattttctcacctcagatcgcaatcggcatctcatctgacggtggctgtttggtgtaaacgcgtttaagtccccacaacgccagtactgacatcagaagcataataataccgagtggtagttgatcggatgctgggaacatggcggcaaacagcgtagccagacctgcccctaaattttgcattccacctaaaattgcaccgcccgttcccgcgtgataagggaaaggagaaagtgcacctgtggtagcggctgggaataaaatgccagcccctaagaagtaaatggttgcgccgccaatcagtgataaggccgtggtcatacccaataagccgggcagcataatgaccagtgagcccgttaagatcgcgagtaagccgacatgcatcgcggttttttcacgccagtggcgagcaatcacgttagagagccaagcgcccgccaaatagccggggatgggtaacacaaacagcaaacttacggtcgtcgcaggtaggcctaatacaccgcctaataacacgccagccgccgcttcgaacacggctaagcctgcaaaggtcgcgacaagacagattaagtaaccttggaagcgacgatccgacagcacgtaatgataactgcgcagcacgggctcttttttacgcgctgtcgctggcaaggtttctaccatgctcgtcatcatggtgatcactacggcaatggcaaagagtgacagaaacaaatagcttgaacgccaaccaaaactttcggttaagtagccacctaagaccggcgcgaccaacggtgagaaaatcaggcacatactgattaagctgttgactttatgcagctcagcgccttcgaaacagtcgcgagagagcgtacgagacatcgcaccgccacaaccaatcccaagaccttgtacaaagctaccgatcaaaaaccatgaatactgatgggcgaagagcgcaatcaaagaaccgataatgtagatcgccaatccagcaataatgatcggtttgcgaccaatacgatcagaaagggtaccgtaaacaaattgcgacaagccgtaagggatcaggtagcacgccatcacagcttgcagcgctgctggtgaaaccaaaaactcttgcgccatgtaaccaatagaaggcacatacatggtttgtgtcgcttggccgacagcagccagaatagcgataaagaaggtcagttttgcgacagaaagtgaggcagacatcgttatctccagataaaaacaatatcttattaaaaacatctaatgaaaattcttgaaagagcttagctctcggcgcgagatgttattgctgtaggccttatctagcaaacgattattgctgttttgctcacgataaatatctatggctttgattattttttctaatgcaaattttggttttattgtgccttgaaccaaaactcaaggcagactatgataaatgagaattaatatcataaagatgccgtaaacatgttgtcacttgctgtaccactacttttcatgagtttgctcggatttaaattaaaactgccttatgggttgttgatgggattaatcatactgacgctattgttaggctggcttggtaacgtcagcttattgccagtgttggtggtgctgttctttatgtctccgctcttgctggcaacaaaacgagcgccatggcagagcatattgttcggtgttggttgcttgttgccccaactagtgcaattcgtgatgttaaatcagcgatgaccatgagttgaacccaatagcgcatgacaatggtcaccattgagttcaatgacatgctcttcatcgaagctgacgcggtttttccccatttttttcgaatgatagagagcttggtctgcgcgtttgaaccactgctccggatcatcggtgcgaagtgcttcggctaaaccgacactgacggtgactttggcatggtatgggtagtgcgtttgttgaatccgacaaccaatatgactcatcacgagtgtagcgtcggttaacgacgtattttcaaacagcagtaaaaattcatcgccccctaatcgaaacaacagatctaactcacggcagtgagtattcattatttcaacaacttgggtaatgactttatctcctgtgtcgtgtccataaaggtcattaacagatttgaagtgatcgatatcgatcacggcgatcaccgccgattcattggcgagctggcggtggcgaagacattttttcaaaaaaccatccagttgatgacgattcaatgtgcccgttaatgcatgacgagtggaaagataaaaaagctcagtgtgcagcttacggatagcatctaccaccacatacatgatggcggcacaagcgctgatcgcaaggctaaagcgcaaggtgacttcggcggtttgatggggaattaaaacccatatgctggctggaatgataatggtgatggtcaataagttatctttctgggggagtagaaaagcaatcgcaatgagcacgggaaatagccagtagctggcgagggtgccgaaaatgtgaatagccatcaccacgatgactaccaccaatgccagtggaagcctaaaaccccatggtgttttcttttgataatagatagccgtaatttcaatgaggagcgtgcattggaatacgatgatcaacccgccaagaagaacgtagtcaatcagcaagtttttaacggcgagtggaaagaaaaccaaactagaaataaaaccaataaaaagcgacacccgacgttgatagtaagtgttcagtaactctgaaccggtaaaagcaggagagtgagtcgattttgtcatcgtcatgttgtgtcatctcatcattttttataaggctatgaagagatgctcaataaagcaaagaaaccgatgactaagctgtgagactgaggatggatttacgccatcctcaggatacggtgagcattaaagcggaaattgtgccatttcggtggccaaaatctgctctgcaagatagtgatgaatcgcggtggtgggatgagtcacttcccaaaacacaaagcgatctgagccttgcttggcgcactccgcagagagtgaatgtgacaataggtaatcggcggcagagttgcgtcgaatatctaagcaaggggagttcgcgttggcaaatccatgttgctctggctgagtagtgatactgtcaaacagggtataagcatcaaacagtacgatgcgaataccttgcatttggtagtaacgtgcttgctcacggataaaggcattcatgccgatgattttgctgcgtacagtatcaatttgctcttgcgtggcatattgaaactgtggcgcgcgcgttgcgtccggcaaggtcatcaggacaagattttttgctcccgcatcaataagacggatcagcgcggaactataatcggctttcacatcggccaaggaacggttgtagttcataaagtcgttcagaccaaattccaaggtaaacaagctgttttctggctgatagtttttagccagtcgcatataagacagataagagctgacctgctcataaacgcccgttaatgccacatactggttacgccctgccgcgccaccgaccgcccagttatacagaggtacattcaaaccttgtgctaggtattcagtccagacgaatccattcgagaaatggcctaggaaccatgagtcagggttggggaagcgccactgtgaggcattgaaaatgttgcccgtatcggaaaggctatcgccaaacgcgatcactttgctgatgcggttggactgaacctccggatcattgctccaaatagtgtggttgtatgaaaagcgatgatcggccgcgaaataggtaatatcggcaaaatcgtggttgacaccaagcgtctcttcacagcgttctaacagggtttctggctgaactgtcgtgtaaaacatgtttttttgtcgaatactcgaccaccaataaccctgaatagtgtaatagctaccatccgcattctttgcccactcccaagtggtgtaggggtcatcatgagtggctgcaggacgataccaacaacgcacataggtataggtttgtttaccttgtacttgttgaatttgcgcgcggctaagcacttctgcctcaggggaagcccatggttcagtggcggcattaaccgataagctagctaagccagcgattagaatagagagtctttttttcatcgtttacttcttatcattgagtaatcagagtgaggatctggtcagatctgtgggtattgtgaatgaggtattcatctggtcaatgaaaacacccagcggcttccctaggttggaagtaagatcaagtctagttgatgaaagcatcactatcttcttcttacttgaagcggctactgtgtcggttaggcgggttcattttgattgcatagtcaatctatgcttatacgggttcactgactcttaaattatgctttcttatgtgtaagcgtattgaaatctttagagttaaaatggagaacttaactttttttaaattattcaattaatctttaaatcaactttataaattaattcagactaaattagttcaaattaaattaggctcattaaataatatgaatatcagtaattgttattttagtaagaattattttacagcaaataaaaagtctttagaggctaaaatctgtgatccgctgtgaattttcaattttaccgtattttacatttagaaacataagtgatatttcagtaagtatgtggtggcagaaaatatataccaaaactccttggagttgcaggtaggcggcaagagagcgaatcctcatgagcatggataaactgtgtgattaggatgaacgaacgtggccaacaccgctgccgcttcgagtaagaaggggatatgcatttctgctaaaaggatacgcggtaagccgtagcagtaaagccacacgcaaactcaaggatgacgagggtaacccatgagacacatgcaaaatgggtatgttctaattacttgaaaatataagaatattactcaactcagaattatagaagagagtttattagcaactattaatttgagtgtttgatatatttcttgttttttcagtagtttgagtataagtcactttgtttggaaatctctcttgtaataacactaaaaataacagagtcagtgaggtttatatgccaaaactcaatcgttgcgcaatcgcgatattcacaatattaagcgcaatatccagtccaaccctgttggcaaatatcaatgaaccaagtggtgaagcggcggatattattagtcaagtcgctgatagtcatgcaataaaatattacaatgctgctgattggcaagccgaagacaacgcattaccgagcttagctgagctgcgcgatttggtgattaaccagcaaaaacgcgttttggttgatttcagtcagatcagtgatgctgaaggtcaagcagagatgcaagcccaattcagaaaggcttatggggtgggttttgctaatcaatttattgtcatcactgaacataaaggggaactgctgtttacaccttttgatcaggcagaagaggttgaccctcaattactcgaagcgccgcgtaccgctcgcttattagcgcgctctggttttgcaagtccggcaccggcaaacagcgaaacaaataccttgccgcatgtggctttttacatcagtgtcaaccgtgcgatcagcgatgaagagtgtacctttaacaactcttggttgtggaaaaacgaaaagggcagtcgtccgttctgtaaagatgccaatatctcattgatttatcgagttaacctagagcgttcattgcaatacggcattgtgggttccgcgacaccggatgccaaaattgtgcgtatcagcctagatgatgacagcacgggagccggcattcatctgaatgatcaactcggttatcgtcagtttggagccagttatacgacgttagatgcctatttccgtgagtggtcaaccgatgcgattgcccaagattatcgcttcgtgtttaacgcatcgaacaataaagcgcagatcctgaaaacctttcctgtcgataacattaacgagaaatttgagcgcaaagaggtttcaggttttgagcttggggtgactggtggggtggaagtcagtggagatggcccgaaagccaaactagaggcgagagcaagttatacccagagtcgctggttaacctacaacacacaagactatcgtattgagcgtaatgcgaagaatgcgcaagcggttagctttacatggaatcgtcaacaatacgcgacagcagaatcgctactcaatcgttcgaccgatgctttgtgggtgaatacctacccggtagatgtaaaccgtattagcccgctgagctacgcgagttttgtgccgaaaatggatgtgatttataaagcctcagccacagagacaggcagtacggattttatcatcgactcttcggtcaatatccgcccaatctataacggtgcttataagcactactatgtggtcggtgctcatcagttctaccatggctttgaagataccccacgtcgtcgaatcacgaaatcggcaagctttacggtcgattgggatcacccagtattcacgggtggccgcccggtcaacctacaacttgccagctttaacaaccgctgtattcaagtcgatgctcaaggtcgcttggcggccaatacgtgcgatagccagcaatcagcgcaatcgttcatctatgatcagcttggtcgttatgtgagtgcgagtaacaccaagctctgtcttgatggtgaggcattagacgcattgcaaccctgtaaccaaaacctgactcagcgttgggagtggcgtaaaggcacagatgaattgaccaatgtctacagcggcgagtcccttggacatgacaaacaaaccggtgagcttggtttgtatgcgagcagcaacgatgcggtaagtttacgtaccatcaccgcttataccgatgtgtttaatgcgcaagaaagttcgccgattctgggttacacacaagggaaaatgaatcagcagcgtgtgggacaagatcatcgtttgtatgtgcgagcgggtgctgccattgatgcattagggtccgcctccgatttattggttggtggcaatggtggtagcttgagttcggtggatctgtccggcgtgaaatccatcacggcaacctctggtgatttccaatatggcggtcagcagttggtggcgctgacattcacctaccaagatggacgtcagcaaacggtaggctcgaaagcgtatgtcaccaatgctcatgaagaccgtttcgatttaccggctgccgctaagatcactcaactgaaaatttggtctgacgattggttggtgaaaggggttcaatttgatttgaactaaaaagagaccgtcaacatagccattaaacaatggaagcatgccctgaaatttcagggcattttatgtatttaatgttctttatttagtcatttatcgacttaacaattcagaaacagaataattttgccatactacttcaaaggctgaacttatttaggtgtacagaattccctttcacattagggtaaaagtacgcaatcacaatactaagcgcgagacagcgtaagtccagtttgctgacatccctacaacccatataggtcagcagactcttttttctgaacgataggtacgagacatgatcatcaataaattttcccttaaatggatgttggctattgccgtcgccatccctgcgatagcactgttgtttgtggctttcaccagtctaaacaccatgtcagtgatgcaagcgcagtccaacagcttgtatgccaacacggctgcaccaatgcgtgccatggctgaagcaacctcacgtattcctcggatgcgtgtcggtatcgatatgatgctactgcaagaaacggcgctcaaagatgcgaaaggggtcctcaaacgagtcgaagaggcaagaaccgaagatatcccagaaatgcgtcaagcaatgcaagttgcggttgattctcaggttaatccggaactcaaagagcaggcacgcaaacttcaagctcgttttgaacaaatggtacgtgaagagttagagcctatgctgcaagccttcgccaataacgatatgaccacggcacaaaacatttaccgcgataaatacgcgccgacctatggtgaaatgcgtaaacaagccaaccagatcctcgatacgcttttgcagcaagcggagcagcaaaaccatgccagtgtggaaagcttcgaagcaggacgcaccaagcaaatggtgatcattgcagcaggcttgatcatttcattcatcacttcactggttatcataacgaacttacgtagccgagtggcttacctgaaagatcgtatgagttctgcggcggcgaatctttcactgcgtactcgattggagttggatggtaacgatgaactgtgtgacatcggtaaaagcttcaatgcgttcattgataaagtgcatcactcgattgaagaagtggcagaaaactcaaaagagctggcgacgatggcctctagtgtgtcgcagcgcgcgcacatgacgcaatctaactgtgcttcgcagcgagatagaacagtgcaagttgcgacggcgattcatgagcttggtgccaccgtatccgaaatcgcttccaatgcggccatggctgccgatgtcgcgaagcaagcgacgctgcattctggtgaagggaaaaaagtggtaggcgaagtgcaaaatcggatccaaacactggtcaatgaactcgataatgccactcaagttgtctcatcactggcgacccaaattaacggtattagctcaacacttgataccattcgcagtatttctgagcaaacgaacctattggcgctcaacgctgcgattgaagctgcgcgagcgggtgaacaaggtcgtggttttgcggtggtggcggatgaagttcgcacattagcaagtcgttcagcggcatcgacggaagagatccagcaagtcattaatcgccttcaaacggagtcaactcgcgcagtagaagcaatggaaaaaggtcgctcgcaaagtgatgtggtggttgagttttccgctaaagcgaaccaatctctcacagagatcaacagccaaattgatcagattaatgatcaaaatattcaagttgcgaccgcgacagaggaacaatcaaccgtggtggaagacattaatcgcaacgttgaagacatcaaccaactgacgacagaaacctcgcatgttgcggatgagttaagccgagccagtgcaagcttgcaacgtctctcttcgcaactggataaactggtgggcagttttgaactttaaccaatgactacgctaagcaagcattcatgtcgcttgctgatgacgttgatattctatttctcactaagcggcctttctaggccgcttttttatcgctcttcgccttttttatgttgcctcaaccaaagttggggttgtacacattttgtgttaatgaaatgttattaattttatgttttgttcacattttgaccttttgagattcggaaatccgccacttctcttctagcttaattaacggtaagaggtctgacttctaccgagtaatgaccctgttttcagttaatgagactcacgccacttcgtgtggttccaagactgaagacaagaacgagaaggaatatcccttgaataaaatcattatattaatcgctctctcactgttttcttcctcaatctgggccggaaccagtgctcacgcgttatcgcaacaaggctatacccaaacccgttatccaattgtcttagttcatggcctatttggcttcgacaccttggcggggatggattactttcacggcattccacaatcactgacccgagatggcgctcaagtgtatgtggcacaggtttcagcgaccaacagctccgagcgccgaggtgagcagttattggctcaggtggaatcgctactggcggtaaccggagcgaaaaaagtgaacttgattgggcatagtcatggtggccccaccattcgctatgtggcatcagtgcgtccggatttagtcgcctcagtgaccagtattggcggggtgcataaaggctctgccgttgccgacttagtgcgtggtgtgattccatcgggttccgtgagtgagcaggtagcggttgggttaacccaaggcttggtggctttgattgatctgctctctggcggaaaagcgcatccacaagatccccttgcttcgctggcggcgctcaccaccgaaggatcgctgaaattcaatcagtattatcctgaaggtgttcccacatcagcgtgtggagagggggcgtaccaagtgaatggggtacgttactactcatggagtggcgctgcgaccgtcaccaatattcttgatccaagcgatgtggcgatggggttgattgggttggtctttaatgagccgaatgatggcttggtcgcaacctgcagtactcatcttggcaaagtgatccgtgatgactaccggatgaaccatttggatgagatcaacggtctgcttggtattcactccctgtttgaaaccgatccggtaacgttatatcgccagcatgcgaaccgtctcaaacaagctggattgtaggagcttgccatgaaaaaaatcgcatggagtttggggattttggtgaccataggggcactctgtgcgattgtttggccatcttggtatccctctcggcctttagtgaccacgccatcgcaggcggacatacaagcagatcaatcgagtccgcgcgatctcttggaatattttctctcaggcttgggtgaaacgtctttacccgtgattcagcagcaagtgcagcgttatgagcaggaaaaccaaggcttgctcattgatagcagtctgtttgcacaatatgtgcagtataaagcggcgttatctgagctgacgctgccgcaagccagcggggggctttcgacccaagagtggtggcaattgcaccagagcttgttagatctgcaagctcgttatttttctgctgagcagcaagcgctgtttgcagaggagaatcggctgcgcgaattggcgatcgaaaagcgccgaatttatgagcagtatgggcaaagtgaagaggcgcagcgagcttggcaagcgctgttgctcgaccagcccgattttattcagcgtagtgaggcgacagcgcagctattgccgcagttaactcaagcggggcagggggatacgcagcaacgctatttggctcgcgttgccttggtgggtgagcaaggggcgcagcgtttagcggagctcgatgattcccgtgcgacgtttgaacagcagtttcaggactattatcaagcgcgggccgctatattagttcgcaacgagctctcggccagtgagcagcaaacccaaattcagcagttacgagagcagcactttgcgcctgagcagtggcggcgtattgatgcgttagagcggctgaaagataacggagaataaggcttttcgcattggcatgagccttaaaaaaggggcacccgaaggtgcccaaatccatggaaggagaaggaagaattacagtttgactttgatggtgatggtggtgactgcgccgcggtcatccatcactttgagctgcacatcatggtgcccatagcttgggaaaatcgcagtaaacatacgaccccgcttaattttaccattcggcagtgtccattcggtgtcgacaatgcggccatcactgtcggtgctggttgaccacatggtgacccagcgacctaaatggatatagttggcactggcttgtggtaacgcattcggtgtgtccactttaatggtttgctgatgagtatcgctatcgcctttgtcatccgtcaccgttaaagtgacagagtaactgcctgctttggtatatgaccaagttggagcggcttcggtactggtttgaccgttaccaaaatcccacaaataactgacgatattgccatcgctatcactactggtgttttgtgacatcacagagagcccctcgactttcagttcaaagcgagccacaggcgcgatattttccgtggtgactttcgacaagcgaacaacaccgtactcattctctttactttgtgagagcaggtcgatcttcaaaccaaatggcatcactttgcggccagaatctggagcttgaggcgagctgtaatcttgatcgtccgagaacgaggcattcgcggttaagttcatatcttccagcgtattgccatcagccgtgaccagtttgagcggcgcttgatcaaacagtgagaaggttgcatcacgcacttggaaacgcgtttgtgccacttcccctgtttttgaccagaccaaggcattttggtcggcatcgaccacgcctagccagccttcacccggatgtttgccaacccagttatccgcgtaagattcgtccacataccacaccagcaagcccggctcgaatgacatcagttgcccgaagcgtttcaaattggctaagccttggtcaacgtcattatggctgcgccattgcagcaagtaatagtgattggcttcgtggaagccaccgtttttggtgaaaccttggaacgcaaagctggatgtgccttctgcgttatcgatcaaggtctgattgccatccacctcaagacgtaagtcatcgacatacagaccttccatggccagaccgccatccgtcaagtaatcaaatgccagttcaacggtttggcctgcccaagcagagagatcaaattgcgcatctacccagccatcagattggcctgagatggcaggtactaaacctgatttaaacggatcatccatcgtcgtgatattaccggcaatcggtttgccgttaatcagcacacgcgcgtagtcgtaatctttttcaatctggaaccacgctttaaagcgcaacgtggcttggctgcctgctgggatcgtcaatggacggctcattcggtttttcagatcatcgccacggttcgagtagaaggagaactcaccttctgcaggcttaatgccttcaacccgtttcatcggcagagtcactttcaccatgttcgggcgtgagttatctgtggtttggaatagcgtaaccacgcgcggtttggcttctaactcattaatcgaaagctgctcatggttaatccagcgtccgccaatcgaattttgtaagaactgcttagcccatgaactgaaagccgtgggctgtgtaccgccaattttgcccgcccagctgccagatgacatgattgaccaataagagacgggctctcccgtacctgtgtactgggtgtcatattcatcgggcagacctaaatcgtgaccatattcgtgggcacacacgccggcagccgcatcaatcggttgaatggtgtaatcaaaggcagcgaattggccattgaagcgtccaggaacgttgcttttcgtgccttcaagaacatggtaacggccgaggttaaaacggtgtgaccaaatcgcatccgcgcccaacacaccgccacccgcttcttcacccacagaggcatggaaaatcatcaagtgatctatcacgccatctggctcacggaaattaccgttaccgttgtagtcatagcgatcttcgatatcgtaatcggcaaggttaatgtttggatcgcgcgcaagttgatccagtgcttcgcgaaccagctcccgagcattcatatcattgttggtaccgggagagttgccaccgtaataagccgcattttttgaggcacgataccatcctgctgcttggccggagacactgtagctgttgccagattcactctcgtaatattgacgcattgagataaagttttcaccgtttggaccggtatagcctttgtccgagaacagcaaatcttggtagtgagaaggctcataacgatcgtagagcatctcagtatgctctttcgtcaggcggttatcatcccaagggagatcggggaaatcgatcaatagcgcgagcactttgtccgtgcgcttttgaccaacatctaaagcaaaaacacgcgccttgtgcgggcctttttgcttatcgatcactttaagaattttcgcacgctgctcgagcgctttcttaccaaattgcgcatcacctttgaatccggagcgaattttctcctccagataacgttctagcgcaatacgtttatcaacgtcagaggcatcggcaggaatttgtccggtgcggactaacatttcaattaatttatcctcattcaccacgcctaaatcaatgggtgtttgagcgtataatccactgctgaaaaaactggctatggcggcagctaatagcgtttttttgatcgttttcattttatttccttaatatttccttatttaaggtgtgaaaaggccagccgaaaataacaatcttcggttaaccagattgggtgatggctatggcgactctggattaatacagcgtggctttaattcagggttttcacctgaggaagaggattcgctatcagctttgatatcgttattcttattattaaacctttgctgtaagtagagggataatgctttttgttgctgctcataagaaagcccttcgcagataatgccttgttcaatcaaggcactaactagcttttcatcattaggctgagcattggcaaataataaggtggaatagcagattacccataatccaaatagggtgcgcatagtacatatccatatgtaaagtatttgtaacaatttatggctggcgataattcatagcaagcctgaattattcattgcttggcatagcatcacatttgcaacacattcagtaaacaaatcatcaatcgaataaatgactaataagacaattaactatgcacaatatcgacatggataaatgatatctatgtcgatataaaacatcgtaattgttagttaggtctgttaaataaagcaattagagcacaataaataatcagtgaaattaaacatgctatcaatatatgcgaaatcccatcactcgattgacgataaaataaagggaaataatttgatcttgcttcattgattttgtttcgatttgacgctgtcgtggtgtgagcggttttggtacactctatccctttcctacttgacgccgcagcggtgttgatcggtcacaaagaggggatagggcgacgaatcgagagcggattgaagccttatactgcaagcgttggctagaattcagttatatttttcaccccgtattgcaccctgtaactaaacatgctttattgaaatcagaaatacttttttacaggacgtggttatgtgtcgctggctggcttatcaagggagccccatctatttagagcagttggtttatcaaccagagcattcgttagttcaccaaagtctggaagcgcgtaaagcggtaactcgagtcaacgcggatgggtttggcctaggttggtacacagagcgcagcacgccgggacgcttccacgaagtgttaccggcttggggagatgagaatctacgctcattggctcaccatattcgctcacatcgctttatggctcacgttcgttcatcgacgggcacgcaagtatcgcgttcaaactgtcatcccttcatgtataaccactggatgtttctgcataacggccaaattggtgactattgtgcggtgaaatatgagctggagcgctcactgcctgagcatttatacattcggcgcatcggtacgacggacagcgaattgattttcctattgatgctcaaaaatggtttagagcgagatccggtggcagctattcgccaaaccattgcggaaatagaagccttgatggtcgtaaaaagcgtcgtgttaccgtttaaagcctctatttgtctctctgatggtcaacagttttggctggttcgttacagtaccgatggtcaaccgccgacggtttaccgcaaaccttggcaagatggaatcatcttagcctccgagcccttggatgcttgtcctaattggttattggtagagccacaaaccattacgcatgtgcttggggctgagtgtcagtcataccttatttaagctatccccttcctacttgaagctgcagcggtgttggctacgttagttctccccaaccacatagtctatctatgttcatggggattgtgagagccatccttggctctcaccaaaggccagccgatggctgtgcaaatttgttccagacaaatttgtcactcacttgccgcctacctgcaactccaagtggtttgggtatgaatcaaattcattaaatgaatcttgtagacccttgctattgataagaattggcgagggtttgtgcatttctaaattgttcaacgatatcttccctcacacagttgcattgccaagttggttttgattatagtacgcactctcttaatgagaataagtatcaaaatgattccacttgcttatctcaaccactttcggaaggaacatatgaaatctcgtattcattgggctgcattaggattattggctgcgtttgctgcacaagcagagacagtaacgattgaacatcgcttgggtaaaaccacccttgagcagaaaccgcaacgtgtagtggttattggtgtgggggctctggacgctatcgacagtttcggtattgagccggttgccgtttccaaatttgatggtactcctgactatcttgccaaatacaagagtgataagtatccaagtgcaggttcgttgtttgagccagattttgaaacgatttatacccaaaaaccggatctgattgtgattgggccgcgtgcatcgaaaagctacgacgagctatcaaaaattgcaccgaccatcgtttttgctgctgaagctgaccaaggttattgggaaagcactcaacagcagtggcgtaacctaggcaaagtgtttgcgattgagcctgcggtcgaagccaaaattgagcaagttgacgcgcaatttaaatccatcatgcaatacaaccaacaacataaaagtgatgcgatgttggtcatgagctctggcggcaacctgacgacttttggtgccaattcacgcttctcttcggtgtacaaagattttggatttagtgaaaccgtgccagtcagcaaagagagcagccatggtgatctgatctcatttgagtacatccgtgaacacaatccgaaaaccttgctggtggttgaccgagataaagtggtgactaaaggtgaaaccaatattcgccaaacctttgaaaatgatctggttaaagccaccacagcttacaaaaacggccatattgcttatctcgatgtgaatgcttggtacatcgctatctctggcgtgaaagcgacagagcagatggttgccgacatgaaagcgtcagttggtatgcagtaaataagcacggaggagggggaactctcctcttgctgacaggctgaggtttactttgaaaaagttattgcttgttttagttgttattagtttttgttccctgtttgttggcgtgggcaatttatccctcgcagccttgtttcaaggtgatgagtcagcttggcagttactgctgactagccgagtcccccgattattagcgattttgctctccggtgcgggtttaagcatcgcgggtcttatcatgcagcaagtgagtcaaaaccgatttgcctcaccatcgacttccggcacgattgagtgtgccatgctcggttacgtgcttagcctagttctgtttggccatggtcaaaacctctggttgattttcggcgtctccatgttgggtacgctggtctttgtgtttttcattcagcgcattcagtttaaaaacgtcattttcgtgccgctgatcggcatcatttttggcaatgtgattgactctttggcgacctttattgcctacaaatatgatgctatccaaaatctttccggttgggctgttgccaattttgccaacctgcttaaaggggattttgaactgctctatatcgcaatcccagtggctattttcagctatttgtacgccgcacgcatttctgccgtggggatgggaaaagattttgcgaccaatctgggtttgaattatcaacaggtcatgatcatcggtgtggccttagtctccatcatgtcggcgaccgtggtcatgattgtcggtcaactgcctttcttgggtttgattgtgcctaatctagtcagcctctattacggcgataatttgcgtaaaaatattccgcgcactgccattttcggggcgatgttcgtgttgttatgtgatttagtggggcgcgtcatcatcttcccgtatgaagtccccatctctatgatcatcagtattttaggtggttcggtgtttattgccttgattttgcgagggcagcgtcatgcaggatagaacgaaattactgctgctgatcgcgatttctctgctgtttgcggcgctgtttattggcgtcgggctcaatgcggacaactaccagtattttttatcgcgtcgtgtgccgaaagtgttggctatggtctttgctggcattgcgattgcgcagtcgtcgttggcgtttcaaaccatcacccataaccgtattttaacgccgagtattatggggtttgatgctttatacatgttcacccaagtgttggtcgtggtgctgtttgggggcatgagcagtattgcgatgaacgtgtactggaatttttcactgtcggtggcggcgatgctcagcttctcgacgctgctgtttactttttatttccgaagtgggcatcgcaacttgattgtgctgttactgcttggggtgattttaggccagcttttttccagcatcgcctctttctttgtgatgttgatggatccgaacgattttgcttcggtgcaggctaacatgttcgccagctttaataacgtcaacaccaagttggtgtatgtggtgtcgcctctgctgctattggcttgcgtgctgctgttccgtcagcatcgtgtgctcgatgtgttctggttagataaagataacgcggtgagtttaggtgtcgatgtacacaaagtgacgcgtaatgtcttgctgatcagcgcgctgctgatttcgatttccaccgctctggtcgggcccattctgttttttgggctgctggtgacaaacctgactcgcgaatggttccgctcttatcgtcactccaccttgctgcttgccacgtcggcgatgtcggtgtgcgcactattgtcaggccagtggatcatcgaaaaagtgtttcatttcgggaccaccttgagtgtggtgatcaattttatcggcgggatctatttcctctcgctgttacttcgcaataaagtggtttagcaatgattcaactggaaaagctcaccaaacattttggtaccaagcgcgtggtacatgacgccagtgctcagtttgataaagggcaggtgacggcgattatcggccctaatggcgcaggcaaaagtacgctgctttcaatggcgagccgtttggtcaatcgggatgccggtaaagtctggattgagcagcgtgagttggtggagtggaacaccaaggcgctggcccaaaagctagcggtgttgcgtcaatcgaatgtgctcaatatgcgttttacggtgcgagagttgacggcttttggccgttttccttacagccaaggaaaattgaccacacaagatgagcagatcatcaaccaagcgatcgagtatctcgatctcgaaaccattcagtatcagtatctggatgaactgagtggtggtcagcgtcaactcgcgtttatcgccatggtcatggcgcaagataccgattacgtcttcctcgacgagccgttaaacaatctggatatcaagcattcgctgcaaatcatgtctacgctgcgccgtttagcccatgagctgaataaggcggtggtggtggtgatccacgacatcaactttgcttcctgctacgccgataaaatcgtcgcattgaaaaaaggcgaagtcgtagccacaggctcggtgcgtgatgtgatccaatctgaagtgttgagcgccatttacgataccccatttaatgtgattgagatgcaggggcagcgcttatgtctctatactcttccgacgtgaggcagcagtacaagtaggggataagcttggccagaatcatggcaattaacccgcctgttttaattccacaaaagcctgcggagagataccaaaggcttttttaaacgctgcggtaaagttggaagggtgcaggtagcctgcttcatacgcggcctctgtgatggtgaccaaacctcgctctaattgctgacgcgccagttgtaaccgtcggtgccggatgtagtgtgcaatcgtcatattcaggcgagttttaaatttgcgttgtaagttggaaacgctcatcgcatggcgttctgccagttgctctaagcaaatctcttcatgcaaatgctgatcgatatagtgcagcaactgattaatccattgctcagattgtccctcttggtgctgagataacgaggtggcgtgtttagggcattgcaacacggcgtcatgcaccaagcgccaaaccgtggcttcccgagcaatatgcgcactgatggtgtggatcacacgacggttgagcagagactcaacggcttgccaactttcctcgttcagtgaaagtggaaccagtgctttgtcttgttgcagaaaatgttgcaatgggcaggagtgttgcgcgaatttttgcaatgtatcgggcgataaaacgatgttgagtttgcgtactgtcatcccttgatgcagacggcgatggaagatgcacggctgctccaaattgaccattaaagcttgtggatgctgattggcacacaattcaagtttgagatcatcataggcaaagcgtaaggtgccttccagcaagagaatgatgacaagggctggcgcgctggtggtcatcacatcgcaatcggccaattcaaggctagaccctccatgcaaggtaaacccgtttggactgacgtattccacaaagtggccttgtgccatcacaggttgattcaaattttgcgcaacaatttgctcatctcgctccttgaccacatgacgtgacaaggtgaccgtttggcgtgcgccgtttttggttaataccttatgttgattttgcgtgttttccataactgatgtgcgattttgcataatcaattcaacttctctattggttgagctcaatttaacatatatgcgaatcgttatcatttgtatttttgaggaattgagtcagtatggatatttgcaagaagtctgcgttatggcttgcgatcactgccgcgatgtcggccaacgcggttgctgagcagaaagcgacaccggagcaggaaaatgtggtgatctggggtacgaaagtatcgagcagctcggaatctctcaccacggacgatctatcactcaaacaagccgatcacatgtcggatttgctgcgtgatattcccggggttgatgtaggcggaacgcactcggttaaccaacgaattaacattcgcggattgggtgaaaccaacctggatattcgtttggatggcgcttcacagcacgccaatatgttccatcacattggtaacttaacgcttaacccagacattttgaaatcagccgatgtgcaggtgggtaacaactcagtgacccaaagtggcctcggtggttcggtttattttgaaaccaagaatgcgaaagatctgctggtgggtggtgagcagtttggtgcccgtatcttcggcggttatgcctcaaacgataaccagcaaggttcactcacggtttacggtcaattgagcgaaacggttgacgccatggtttatggtcaaggtatctcacgcgataactttgaagatggtgccggtaaagaaacttttggcgtgaaaggggatacctataacgttcttgcaaaagtcggctttgaaccggctgttggtcatcgattccaagtttcctatgatgtctatcgtgatcaaggggactatagcccacgccctgatatggcaggaagtgccaacctaggtttgagcaaaaaccgtttggttccgacgcattatgaccgcgataccatcactggctcttatgaactcaagcaagataagcatcgcggtaaagtcaccctctacagtagccaaaccgaaattgatcgtgatgaaagtgtgatggcgggtgtttggccgggcaaccgcctttcacgcaatacggcgacaaaccgcaatgttggcattaacgcgctcttccaatctgactatgaactggccgcgcaccgtaaccaagtaagctatggtatggattatgtcgatcaaaccagcaaagcgacctatggcagcaccccatttatggaagaatctgcagtttctaccgctgtgtttgcggagaacaaactgtatgtaaatgacgtttggtcattgaccgccggtctgcgttttgatgatttcaaacgtaaagctatgacaggcacgaaagattttgatgaggtgacttggtcactgggtacggaatgggatgtgaccagtgattggacgctgtttgccaacgcccgctcgctattcaaaggcccagagctgctggagacctttgttcgttaccaagatcaagctcgcttagcggataacatcaaacctgaaacgggcttaaacactcaaggtggtgtgcgctttgataaaacttatggcgatcactttgtgggtgccaacttcaccctgtttaaaacccagattgatgaccatattcgtactagtaacagttacctgatcagtaacgtaggggatatggaaatcaaaggttttgaactgagcacaacttacgcttaccaagccgcgagcgccaagctctcttacgcgcactcggatgcgaatgatgttacaaatggtggcccaatgctcaattccgttggtaacagcgccgatatgggtgacagcatcgcgctcagcttaggttatcaagcggattcgattgataccctgtttggctggacttcaatagtggttctggatgaagacaacgtagtggctggcgccgccaagaaagaaggctatgacgtgcataacctgtatgctcagtggacgccatattccgtcccgaacctagtgctgacgttcggcgtggataacgtgtttgatgagctttatgtgtctcatgcctcacgtgttggtttagcgaaaagctttgtagccgatgattacgagccgggacgcagctataagttatccgccgcttaccaattctaatcattcttactctatttaagcccgctttgtgcgggcttttgcactggagattttgttatgtcgtctcaatttcaagcgttgtaccaatcccaagccacgttgcactctgagcatgtggtcaaatatttagtcaccttatgtcgccattttgcccgcaaagtccctgcgacttgggatgaaacacaagggcaaatcgagtttcctgtgggagtgaccaccttaaccgtgtgtgagaaaaaccaaacgctgacgtttgtttgtcagggggaccgcgagcaaaatgtggccgcacaacgcgcggtgatcgattcgcatatcgatatgttttcacgccgagaatccattgcactggaatggcaagcgacatcgcttgcatagtggccctgcatcatcttgcccctcggcattcatcctatactgcatcagcgttcgtcatcttcggcgagcgctgttttctttgatgaaaaattgaaatatttctcggctaaaaagaaatctcttcttgcttaagatcaacaaaaaaacgtttctatcgcacaaaaaactaaaacaaagttgaaagattcaaaaattattgaataatgctatctctataatgacgaagcgaaaacgcttccccttaacgtctgaaacaggatacagcccccatgtcgaactcgtatgtgttggtcataaactctggtagctcatcattgaaatttgcagtgattgattcccaaacgggggaagcgctgatctcaggccttggcgaatgcttcggcatgcctgaagctgtgatcagttggaaatatcagggtgagaaaacggaagaggcgattaccgccgccgatcatcatcaccaacatgcgatcaaccgcattgtgggcttaatggaaagcttgggcttcgctcaagacttagtagcggtaggacaccgtattgtgcacggcggtgagaaattcacctcgaccgttcgtattgatgaagaagtactggcagaaatcgaaagcttgtccgatcttgctccgctccacaacccagccggtgcaataggtatccaagctgctatggccgcttttccaagcttgccacagtttgctgtgttcgataccgccttccaccaaaccatgccgaaaaaggcattcactggtgctatctctcatgaactgtacaaacaatacggtatccgccgctacggtttccacggcaccagccattactacgttagccgtgaagcggccaaaatgctcaacaagccgattgagcaagcgagcttcatctcggttcacttgggcaacggcgcttcagtttgtgcgatcagcaacggtcaatcggtcgatacttccatgggcttcaccccattggcgggcctgatgatgggcacacgttctggcgacttagatcccggcatcatcgaatttttgatgaaaaaaggctggagccaagagaaagtctttgaaaccctgaacaagaaatccggtttcttgggggtatccggcctgacttcagatgctcgcggtattttggaagcgatggaaaacggtcacgaaggggcgaaactggcgtttgaagtgtttacttaccgtgtcgctaaatacatcggctcttaccttatcccgctagatcatctggatgcgatcatcttcaccggtggtattggtgaaaactcactgccgattcgccgcgaaattctcggcaacctaaaactgcttggtttcgtggaagatgaaaaaggcaacgaagcagcgcgttttggtaaagcgggcatcatcgcaaaatctgagctgcttaacgccgtagccatggtgatcccgaccaacgaagaattcgtgattgcccagcagtcggttgagttattgtaatagttacgacgaaatatcgataaaaggcgagtcgttggcttaattcacctctggccagctttaccgtcggcgattcaacggtgcaaggcttacgcactgtaacccagcaaacagatttgacggagattactaaggcatggcctaactcggattttagttactcggatacctatgtgggtaaagaaactgttgtagttgcagcaggaacgtttgaagcttgtaaagtgacgcgtgaaactaagctgactaagcctgctattacagagacgagtgaaagctggttgaccaaccgcggcttcgtaaaacgtattcgtgatgaacaatcttgggatgcttatctcgtcatggaagcgaagtcattgcctgctattaactagttgctttttctcttacgatgagaaaaacccaaagtttataactcatctcaatcaatccgagcgcgtagtgcgctcggatattctgttatcccaaaaccaatatcggtgctaatggcatcacttcgcctgataaggcagcgaggagtggtgcagtacaatgcgcagttggccttgctcatctttcttaaaagcccagcttttgtctaccacggtttcctgccctttatcattcactaggaagacattgcctgtagtgagtgcaagatcgccatcaatgtaaaccgcggcattttcaaaacggtattccttccagccttttagggcaaagcccgaatcttgcgggtagcttttattgttgccaacaaagtaagagagtgcaccttctgtatcggtgcggaaggtttgcttgccactggctagggtcggtttaaacaatactgcgccttgttggtagccgtaggcttgatctaacacttggttcgcaagctcagttgccgctttgatgccttgtttttgataagtatcgctgattttaatcagcgcttcgccccatgcttgttgggcttttagcacatcttcatgagtgatgttgttattcacgacaagatcggcagcttgagtcgtgaaaggtaataagccgcacagaatcagggcggaaacggatagagtacgagtcatacgttgcataatctgccttccttaaatgtttgcagtaggttcagcgctactctacgaggtttcgatgaatgtaaaccgagcgcaaagattaacctcagattaacaagatttacccttgggtagaggatcacgtaatctgcatatctccttgctacttaacgcggtcttggcgacgctgattcatcttaaacaccgagtgtgtctatgctgatggagatggactcattggtcgcctatttgccactgcgagtagttgagactcatagaaagaagacaattttgggaaatgactatgtttcgatatcggcttgcgtttgtactcgcattactattgaccttgattttggcgcaggtcggggtggcttattggtcaaatcaagttgcgaatcagcatctgctgcgtgggcaaatctcaagccaaattctgcaaggttttatgcagttaagtaccgagaaacagcaacttaaagtctggctcgccgagtatcttctgattaaagatggcagtaccctgaaaagggatatgcgtttttccaaaattgaagcgctgctacacaagctcaatcttttgacggagcaagctcagcagcacagcttaaccgtgcaagatttctcagaaataaaccagcagatcaaggtaatctccctgtttgaaaccaacttcgccagcttaaaaaaggcgttgcgttcatgggaaattgccaaaattactgacgatgatgaacgctggctattgttgagccagtcgttcgatcgggtcgatgataccgatttacgccagttgttgactcaagccattagcctccagcagcagcgtacctcgcgttatgaagaagcggcgttggatgcgttatcgaatgtgagatcggtcatcaccagcttagcggtttttggcatggtgtcgggggctctgcttggcgtttggttattgcgtaccctttctaagccgctggctgagctggtgaaaagtaccaccgccctagagcagggccgattggatcaccgcatttcgatcagcgggcctgatgaacttaaaacgctggcgcgccattttaactatatggcgcaaagtcttgagcaagcgcagcaaaaagagcggatgtcacgccaattaattgagcgagaagtggcagaccgaacccaagagctggcgcaagctttacaaacgttggagaaagctaaacatcaacaaaaagagttcttcgctaatgtcagccatgaactgcgctctcctgccactgcgattttaggtgaggcgcaaattactctgcgcagtcggcacaatagtgatgatgagtatcggcaaaccttgctgcggatcagtgagtcggcagagcaactggcatttcggattgaagatttattgatgttgatccgacacgatgagcgcctgtttcatcctgcgttaaccgagttgctcttaggtgaaatttggcaagcggtggtgcggcaagccagtttgttgactcacgcgcagcaagttgagttgacggtgaatacgccagcacagggtgagtggcaaacacagctttgctatacggattgcgataaattgctgatggtgatccgtatcttggtggataacgctttacgctatgatccgacgcagcaaccgataggattgaatcttgagttggatgaagaggcatggcgtgtgcaattggtagatcaaggcattgggattgccgaagcggatctgagtgtgatttttgaacgctattttcgtgcagaaaatggcaagcggtatcgccctgatgggctaggcattggcttaacgctggcgcaaagtatcgtaaaacaactggatggtgaaatccgcatcgaaagtgtgctggaacaaggcacgacggtgacgttaacttttccgcgaggagaggagcaagatgcgaatcttattgattgaagatgatgaaagaattgcccgttttattgagcgaggcttaaaagcggaagggcaccaaatccaccgtttgaaagatggtcaatacggattagaaaccgtgaaaagcagcgagccggacttgctgatcttagatcgcatgttgccccatgtggatgggttaactctatgccagcaaatccgtgcgacgggtaatcaggttttaatcctgatgttatccgctttgggcgaggtggaggaacgcatccaaggattgcgcactggtgcggatgattacctcgccaagcctttccattttgaagagctgttggcacgcatcgaggcactgcagcggcgtaatattcaaacccacaccagcaataagctgcgttttgctgatttagagctctgcctatccactatgcgcgtgtatcgtgccgagcaaccgatagagctgacggcaaaagagatttcaatacttgagctctttttgcgtaaaccggggcatatttttagccgggagcgaattttggcgaatgtgtggggcattcaccaagatccgctgaccaatgtagtcgatgtctatatgcgtcgtttacgcaagaaaatcgatatgccttttgcccagccgctgatccaaaccaagcggggtatggggtattacttaggtgacgcttaaccctattctttcgacgccaattgggcaaacttgctgtagctactcacgcggccattgatgtattcaatgccgcagtgcacagggtgaggttggtggccgacaatttggtattcgacaataaactcgccgctgatcactttgacgaataaaaaaccatccatcactttccacaaaccatgcagcgctttgtcgctgaacatgtctttctcaatcaaggtgccgttgggtttaaaggtcagcagtgatgaaaaaccatcagcgttgaccttaatccacgcgtgttgatgcacttcataactgagaattttgcgccgtgttttgatccactcttcaagttcttgctgttgtgctgggctcagttgtggcagggcctctaattcaagtagggtgtggtgcttctcgtaccaaaacagctgaaggtggagtaatttcatgctaaccggttggaatttcaaacaaacagccgccactgtgcgccaaggtggatatgaagtcaaccctgaaggcgagcttgaaaaagtgcggtaggtcgggggaaacccaccgcacattccctgctgagggaatcgccgcgttgcgcggctcaggagcttaaagatgagggaacaagcgagggagttcggcgcgatcacaagcttggtttaatcgacgctgcgcggtgtgaatatgctgttgccactgttcatcgtgcgcccacatttcaatcactaacggcaccacgcaatccagcgcttttaagcggcagaacagttcatcaaagtcgacgtcgccttcgccaatcactaaatcacgaaactgtccggcgtactgttcgctcaccttgtaagtgtccttgaggtggatctgagtgatgtggggcttgcttaacgagagttcggtcagcaagtcataattccagcctgagatgttgccaacgtctggatacgccgtaaaaaagggcgattggatctgccgattcagcacttcaaatttactcagcgcattgagataaggggtatccatgatctcaacggctaacatcacgccagcgcgctcagctaaacgggcggcgtgttgcataccctcaataaaacgctgatgagtggctgagttggcgggctcgtaatagacgtcataccccgccaattggatggtgcgaatacccagtttgtaggcgagggttatcgccttttgcataattttcagcgcctcatcgcgcagcgcgggatcggccgagccaaacggaaacttgcgatgagcgctaaggcacatcgattgcagcggcacgccatactcctcacaaaggcggtgcaatgaataaatggtggcatcatcccaatcgaggcggctgcggcgctcgtcactttcatccaccgagatctccagaaaatcgaagccgagctctttggtgcaggccagtttttcctcccaacttaagtgattgggcagcgctttttcatacaagccaacgcggtggcgcagtaaatgttgatacatgctgcctcctgttatggccagaaacggtcgatttgctcacgcagagccgccgcggtttgttggccttcggcgcctgctaatgcacgtccggcaataaaggttttggttttgatcccttcaaacaggtaaatatcttctggtacgatgccgccggtgatcgaaagctcaatgcctagcgcagagagctggcgcattttgtcgagatcgtccgttgtccaaccaataccggccaattccgcatcgcgtgagcggtggtaaatggcttgagtgatgcctaaatcgacccatgctttagcatcttgcattgtccagttgccataaatctcgatttgaatttcgccatttaactcatccgccacttttttacacgcggcaatggtcgcgatgtgtgcggcagccgacacggtgatccaatccgcccccgcttcaaatgccatacgcgagagaatggctccgccatcggtggttttcatgtcacacaccagaatatgattcggatggttgtggcgcagagtcgacaccgctttcattccttccgcgaaagccaaaatggtgccaacttcaatcacatcgacgtaactggcgacattactcgctacggccacggcatcggttaggttggtttggtcgagggcgatttgaatcattggtttggtcatactgtttatccttgaatatgttcacgtatcagttgggcaagcccagcgtggttgttatcggttgagcaaaggctgcgcgcgtaagatttcacggtgtcatcggcattggccatcgccacgccgtggccggcatagcgcagcatggagatgtcattgtggttatcgccaatcgccatcacatggttggcggcgtagccaagctgagcaacgtattgcgcaaggcgcagccctttgctgttgcctttggcggcaaaatcaatgcggtttgaccaagagcgttcgccattaaagtgggcgttgacccaaggatgctctaggagtcgctcaaccgagcttggtaaaccttcgacgacaaatttccatacaaactcagagtcacgcgcagtttggtgaaaggagtcaatcgcataaatttgcggcggatgagtgagagaggccgcttgcgcccatttttccaatgcttgcatgtaggcgatggggctgcgctgcgagtacgtcatcgcatctttgatgtacatcaccagcttgagctgaaactcttgggccagatcgataaaggttagtgcatcttgtttgtcgatcgcattgtgctccagcaccgtttcgcttgcgtagtcatacacatacgtgccgttgcaacagatgatgggcgtggtcagacccagttcatcgtagtaagggcgcgcagcggtgtggtgacgacccgtgacgataagcacatgacaatgctgctgagctgcgcgaatcgcgtctttgacttgtggatggatggtgtgatcgtcactgagcacagtgccatcaagatccaaggcgagcactttatacatagcgattacctctggccgtagtaagcgttcgcgccgtgtttgcgcaggtagtgtttatcggacaattcgggctgaattttgatgccgctattgagcgagcgagtggcgagtgccattgcggagatctcttccagcaccacggcgttgtgcaccgcatcttcggcatttttgccccaagagaaaggcgcgtgtccggccacaatcacactcggtaccgccatcggatcgatatgacgatgacgaaactcttcgacgatcactaggccggtgtttttttcatactcaccagcaatttcgctgtgcgaaagcttacgcgtgcagggaatgtcgccgtaaaagtaatcagcatgggttgtcccgagcgcgggaatatcaatgcccgcttgagcccaaatcgtggcgctgcgcgaatgggtgtgcactacgccgccgatgtcgggaaaggcgcggtaaagttcaatatgggttgcggtatcgctcgatgggttcaatttgccttccaccactttgcccgtgaggtcgacaatcaccatatcttcggcgcacatcgcatcgtattcgacgccgctcggtttaatcgccagtacgccgcgttcgcggtcaatttccgacacattgccccaagtaaaagtcactaagccgtatttgggcaatttgagattggcgttgaatacgcgctgtttcagttcgctgtacatactccctcctacgcgatgtgcgctaattcttgttgggcagaagcttgttgcgagagggcttggtcaatcaccgcatacacttgctgtttatcgcggcagcggcgcagcttatccagatccactccggtggcgctgttttcatcatccagcacttgcgtcacttccatcagtccttccatatgctcatcggaggaactgccggctaaggtaatcagcacatccactggctcatcttcgccttcgaaatagatcggctcttgtaaggtcaccagcgcaaaagcagttctcaacacgccgttttcggggcgcgcatggggcagggcaagattaggagcgatgcagatgtaggggccgagctgctcgacactggcgatgatcgcctcgtgataggctggcgtgattgcgcctgaggcaatcaacatatcggtaccaattttgatcgcttcacgccagttattggctttggcttgcagttggattgagttgttttcgattaaggattgtttgagtcccatggttctatctccagagtagagctgatcaaaccagcttcttattgtcgtagggggcggtaggcaaccagagaggtgcggctgcccaccgcctgtcgagctagcgaattttcacaaaatggttatggataatgtcgagcagttcattgccaaaggaattcgggttcagcatgttctgcaccccgagcacaaacttgccttcgcccggttccatctcggctgagaggtgtttcgaggagacaatgatgtcggtggtcgcgagtttggatttgtaatcagacaccgcgcaagaatccatcacatgtggaatgcctttttgctccagatacttgccgattttcatcttcatcatcatcgatgaaccttggccgttaccgcacactgccagaatgctcactggacgagtgccttgcgcagcttgtagagcttgttcaaccgcttcaatcacttccggctcgtcactgaccgtgatactaccttgtgcatcttcttcggcgcgtaactgtttggaagcaaagaacatgtagaccaacgccagggcaaccagtacgaagaagaagagtttcgaggcggacaaaccttgcataatcggtgggaagaccaaagcccagtcggccatgcccatccagccgctgaattcggtgccttgttgggtgaagaggtgaattgcccatgcagagccgagcacttcgataatgcccatcacaaaacagatcttcatcaccgctttccaaccgccgaaatggttcgcaaagacgccaatcgttgcgttggagaagaacataggaatgaagccggggatgatcatgattggcgcattaaacgccagcatggctaagactgctgcaaattggccgagtgcgccccacataaagccaaacaccatggcattgggagagaaggcgtagatcgccgcacagtcaatcgcgagcacagcattaggaataacgcgctcggagatgcctttaaacgcttcagacagctcggcgacaaacatacgtacaccggccacaatcacttggatcgcgacggcaaacttaaggcccgtttcgaggatgtagatagtccagtgggtggagcccgccatctcttgcagattatccagaccgaaagagagcagaatgatgccgaagaacaccgtcatcacaatcgcggtggcagcgatgctgtcgtggaaaatatgcagccatttaggcagttgcaggtgatcaacactgtcttttttatcccccagtttgggagcgattttggtggcgatccatgaagcgacttgctgttggtggccgatggagaaacccgcgccgccagtgacttcttcggtcggtttgaacatgatgttagaagagatgccccagtagagcgccatcaataccgccgaataaatgatggtttcccacatgccagcgccgagcacaaagtagaacaccgcaatcaaacccgcttgctggaacatgatgtgtccagtcagcatgatggtacgaatgccggtgtagcggcgaaacagcaccaacagaatgttgatcgccagtgctagcagcacggcgtacccgacccatgaatagttgtcgcccatggtttccatggtggccatcatcgaggtgtaggggtcaatcactgatccggttaaaccgtggtattgcgacagcttttcaatcacaggtttaaagccagcgaccagtgtgcctgcgcccacttgtaccagcataaaaccgacaatggttttgattgaacctttaatgatggttgtcgcatcgcgtcttagcagccaatagccgattaaggtgactagccctagcagcaaaggggctttggtcattacttggctgtaaaaaatatagaaaacgtcgtacaagaactccatatctctacccttagttgttttgatgtaggaagagtgatttttggtggtgcgtaaaatcgctccttttgctcacggaatagactttaacaatcaaaagtaatcattcaatgctcatttgtgattattttgatttttatcaattttgcccaaaagaaaaccacataaatgataggtagatcaccttggcttttgttatttgattaaaaatcaataacttaaatttaattgtgataaatgtatgatttctatgtgcagaaagtttgacaagatttacgatgattaatagaatcaaaaccaatcaagattaatcaccaaataatcactaagtcgacattcggtgagttttttctcagttaggtgatggtatgaatgaagtccaacgacataacggtattttgtctctgcttgaagagaatcaagcgattaacgtttcgcacattattgagcgctttaatgtctcaccagccacggcgcggcgcgatatcgccaagcttgatgagctaggtaaactgcgcaaagtgcgtaatggggcagagcgcattgaaaatcaaaaaagaaaatggtcaccgctcaatatcaacagcacagagcattatgaagagaaatcgctaattgccttgaaagcggctgaactctgccaaccaggcgatagtgtggtgatcaactgtggttcgaccgcctttttgctgggccagcagttgtgtggcgaaaacgtacagatagtgaccaactattttccgttggcgagctatctgatcaatgaagatcacgatgatgtgatcatcattggcggacaatacaatcgagcgcaaagtattttcctcaaccccgcgccagattctcttggcggttatgcgggaaactggatgtttacctctggcaaagggctaaccgaagcgggattgtacaaaaccgatatgctcacagcggttgctgaacagcagatgctagagcagatcgataagctagtcgtagtggtggacagctcaaaagtcgggcagcgtactggcatgctgttttgctctaccagcaaaattgacatcgtcatcaccggtaaaaatgcgaatgctgaagtggtgaaagccattgaggcacaagggacgcaagtgattttagtgtagcgtttcactcacttttaccaaattaaaaaaactaacccaactggccagtgccaatcttcaggatttcggcgcttggttccctacatccaaaatttatcttaacgttgtgaaacaagaggtgttgttatgagtaaagtgaatgaaatcactcgcgaatcctggattttgagtacgttccctgagtggggaacttggctaaatgaagagattgaacaaacggttgtggagccaaatactttttcgatgtggtggctaggctgtacggggatttggctaaagagtgctggcaacaccaacctttccatcgacttttggtgcggaaccggtaaaaaaacgcagaaaaaccgcttgatgaatacccagcatcagatgatgcgtatgggcggtgtggaagcgttgcaaccgaacttgcgaacctcgattttcccactcgatccgtttgcgattaaagagattgatgcggtgctggcttcacacgatcacgctgaccacattgacgttaacgttgctgcagcggtgctgcaaaactgcggcgagcacgtaaaattcattggcccacaagcctgtgttgatttatggctaggatggggtgtaccgcaggagcgctgcattgtggcaaaagtcggtgatgtgcttgaaatcggcgatgttaagattcgcgtgttggattcgttcgatcgcaccgcgttagtgaccttgcccaaaggcgtatcgtcttacgacaaagcgattttggatggtatggatgagcgagccgtcaactacttgattgaaacctcgggtggctctgtgtaccactccggtgattcacactactcaaactactatgcgaaacacggtaacgattaccagattgatgtggcgttgctgtcgtacggtgagaacccacgcggagtgaccgataaaatgacctcttcggatgtattgcgcgctgcagaatcgctcgattgccaagttgtcgtgccattccaccacgatatctgggcgaacttccaaaatgatccgcgtgaaatcgaagtgctgtggaatatgaaaaaagatcgcttacagtaccaatttgcgccgttcttctggcaagttggcggtaaatacacctacccaactgataaaggacgcatgcattaccagcatttccgtggcttccaagatatcttcaaaaatgagccagaactgccttataaagcctttttgtaaggatgaatgatcaaaagccaccatgcgttggtggctttttctatgcttgcacctaataatttccgctaggcacaatggacaacatgagaggctaggatattaaccacggcctaacatacgagccatagtggcatctttatcaatcagatgatgcttaagcaccgccgcgatgtgcagcagcacgatagcgataataatgggaggcgcagttttgtgaacggctgcgccaagctcttgcaaccaaaccactttttcacctgccgcaaccagcgtataaccaaacacttccagtgcacgccctccgccgatattcatcgcgatcccagaaagtggcatcgccagtgtggcgagcaacaataaaccatgaaccgctttcgcgactttttcttgccaagctggcatcacagaggctggcggaatcgccccttctttgattcgccaaaagacccgcgcgagcgcgatcagcaagatcagcacgccaaaggatttatgcagcgccactagttccattttttctggcccacgcggtaagtcggatagataggctccgatgataaatacgccaataaaggccagaccaactatccagtgcagagcaatcgaggttttcgaataggtttttgtgttattcataatccatttccacaggtttcataaggtcatggctattatgcgcgattagcttagattgtgaacagtttgtctgagtaaatttaggtaaagctagcagtcaaggtaactaacgatgagtattgggagaaataacggaatgaaaaagagtgatcagagatcactcttgatggtgttacagcatccacatgcgcgcaacacgtgctgggatagttaacgtatggtagcgactgctcacgctaaaacggtcgtcacttaaagtatcttgataggtctgataccagttaaattcatgctgataagtatctatggtgacattttttgactcaccacatttattaatacctacgacaccttccttaccccgtttgaagagcatcaaacatgagtcgctatacataaccgtcataggtttaccttgcattgcgttatggaagcgcagcatatgttgcattgatggttgattccaaacattcgcccaacgaccattatctttatcttcgtgatcagccagatcatcactataaatcagcggtgttccaccatctttcccgagtagataagcgtaagcgagttgctcatcttgcgggttgaggatctgataacggaatccatcattagtgggaatatcatgggtaatcgcaaacgtgatggcgcgggcgtttggtaatgcttgtccataggcttgtggatcatgcaattgactcatcgaaccttgataagaaaatgcggcacgaatggaggcaaatagaggaaagtcgtatgcggcgtgtgtggtgttattcagataaggagctaggaaggcatcataactgccatcaccttgacccccacttgtgatcacttcgccaaacacatgcatgcccgaaataatctctggtgtgaagacttggtcaatgtggtattgactcatgtgcttaaccgcatcaattcgaaatcctctgatacccatttgcttaagcgcttgtaaataggctcgctgttgattgatgacccaagcgttggcatccaagtctggtagaccgcgatcacctgcgccaccgcatagcctccaatactgaacatgaccggggttgccccaatcagtaatacaaccttcaggatggaaatcattttgtgagaagagattgtgcgacaaatcaccgaacagtttctgttgttgatagtaataagcttggttagtgtagctggctagtacttcgctgcccggataattgagatcactacgcttccaactttcgtttgccatatggttaaacaccacatccgaatatacttcaacaccgtaatcttgcagcgttttgatcagtgtttgtaagtcggttttgttgccaagaggtgagtcaatgactcgcagatcttgaggttggtaacgagcccaccattcattgccgctggatttcaatgctggtgagatcagcacttttttataacctgcggcggcgatctgtgctgcattcgcagtgacatctgcatatttccagttaaaagcatgcaaaatggcttctgcttgtacgctgctagtaaaacttgctgccgcgaatgtggcacaaagaacaacatacgatgatttcataagatgcctctcttatttacggtattttgaagcatcataaagctcacattgatactgtgaatgttaagtgtgaagaatcattgatcaccttcaagctgtgtagggctgaaagtcaaaaaattgtggcacagttgaaaatttgtacagcttgttgtcggttatttgtatggctacaaatagtgatttatctctggttttgggtgtgtgcctaggctgtggtatctttagccgccgcttatttttggatcttgcatgaaactcatcccgttattaaaacagccccgaattcattgactttgcttattcgtatcattttttctgaataggtctacttgagagcaagtagaaagcgtctgcacaccacgaatttgaggtggaatatgagtcaaaagcattggtcaaaagtccaactgctgcatgaagtagtgaaaaatccaaacatcattatcaaaggtaaacacagctattacagcgattgctgggatgccggttttgaagcgtcggttgtgcgctatttacatggcgatgagattagccaacgttgggacccgttatgggaaatcgatcaactggtgattggtgactacgtttgtatcggggcggaagtcgtgattttaatgggcggtaatcatacccatagagccgattggttctgcctgtatccttttatggatgtgattgaacaagcctacgtaggaaaagggaataccgagattggtgatggcgcatggttagggatgcgcgccatgatcatgccgggtgtcaagattggtgaaggcgcgattgtggcggccaatagtgtcgtgaccaaagatgtggcgccttacagcattgtggcgggatcgccagcccagttggtgaagtaccgttttgacgcaaaggtgattgacgagctgcttgcgttgaaagtgtacgactggccgccggaaaaatttacggcgctcaaatcgtacttatgcgcattggatttggcggcactcaagcaagcggtcatccaatatgatgccgagccgcataacccattgagctagcttttcattgcttcagcacaaggctgtgaccccataaggtcacagccttgattgaactacccaatcgcgcggttttcgcacgcgatggttattcacttgattgttatttgtccgatttctatttaggttgccattgatgggtttgcccattcgccaattgagccaataggctgtgcggcgcgatcacttctcctcctgcgagcttaaacggctgcgcgctaaaattcgcactgagaatcgagccatcactaaagcgcgtttgttgcacttggccttgcttatccagccagcgaaaatcgaccaaggctttatcccacaactgctcatgcaagggcaaaaacccttgttgatagtgcttgagctgctcgatacgcgctggcggcactcaagcaagcggtcatccaatatgatgccgagccgcataacccattgagctagcttttcattgcttcagcacaaggctgtgaccccataaggtcacagccttgattgaactacccaatcgcgcggttttcgcacgcgatggttattcacttgattgttatttgtccgatttctatttaggttgccattgatgggtttgcccattcgccaattgagccaataggctgtgtggcgcgatcacttctcctcctgcgagcttaaacggctgcgcgctaaaattcgcactgagaatcgagccatcactaaagcgcgtttgttgcacttggccttgcttatccagccagcgaaaatcgaccaaggctttatcccacaactgctcatgcaagggcaaaaacccttgttgatagtgcttgagctgctcgatacgcgcggagtttttacgcgtttcatcgcggcttaaatgcaccatcgccggagtgttaaacagcatggcacgcaaatcacgcacggctttgacattcgaaaacttcaaactgtcgctgtgccagtggtggctactgatcagctcgtcatgaaacaccgcttgatagagcggcactttatactcaggggcaaacagtaagctgcgataaggctctttgacttgcgctgatttaaagaaaaaatccggcttttcatcgggataccagttccccaaataatagggtgactgcttgtcactcttcatcgcttggtctgtccagccaaagccgactgtttccataccatgagcaaacaccagcccttgagtggttagggcattgccatcttccgatcccaaaatcagcttcggcgtgtttgcaatatcctgcattcgggtgttaaaggcggctagcatcgcggtttcgttgctgcgcgagcggtaatcttcccgcgccatggcggtgccatccacatcgagaaacaggctgttaaagtgcccgaaatggagaatatcttgcacgcgctgtttaacgtaaccgagttcacaggcgggattgagataaaagccgttaccgcgaaagcccagttgcaacgtgccatcggctttttcaatcgcgcagttttcgcgcatgcgatccggcagctgcgcggtcagccaactgtcgttgatgcctttttcaatcgcggtgttgtatgagtcatacacgccaatcagatagccggcttgtttggcgctatcgaccacttgcggctgataaaaagctggcatccagttatcgagacctagccagagtttgcttaatcccgcttgctgtagggtgctgatcatgggttgcgctaacccttgtccccattgatcgctcggtttgaggtatgcgccagcgtgttcagtcagccacgctttgcgctgctgcgcggcttggtactgcgcttgaatggacgcctgattggcgttgaacttctggttcaaggcttggtttatctcaccgaccagcaattttttctgatactgattaagccagtcttggcctttttttaggctcgccagttccttttgtaattctggtgaaggggtaaactcagagcgccaaaaccaatcgcgcagcccccaccaatccaccacatcttgcactgcgattaaatcacgcccgaatagatagacgtggcttgcgccaatcattttttcgatctgcggatttgccttgcgtttttccgcaagtgaaacacgcagccccgccgcttcgcgccagtcgcgatacgctttggctccggccagcatctcatcgcccacggtgatgcgcacgctaaaaggctcactttggttcagcggggtaaaccagtgctccgcttgtaagtccagcttattttgctgctcactaaagtgcagctggttattggtggcgttgagcagttgatagctgatgaagtgttcgccctgctgcgcgctccagaacggcattttgagatcttgcgtggtattggcacccgaatgattgtctatcaaataacgtgtccaagtcgggttatcggttggcactcgcattccttcgtcaaacggcagtaaaagcgtttgggtcgatgcttcactgagatcaaaccagcgcagtgctttaggagcttggcgttcaatctcatgagcacttggccagcgaaaatcgatgttcaacccttgttgtaactgtgcagacacttgcacgccacttggcttaagtgtccatgtcgcttgctcggcgctttgggttaattgcgttgcctgttgtgtctgcccgtcaatctgtaggcagccttggttgatagcgaaagtttgtgagtcttgcttgaggatgatggccagtgtgtcggggtcaatctgccagtgctgatcgccctgttttaaggtcaacgcaaagctcggcgcgctcaccagcagcagtagccccagtgaggaaaaggttaatttcatatcggtctcctatcgtgtaacccagatatttaacctcgtccatcgataggttttgtcaccagtatgtctttccctcttttgcctgaacttagtcaatgggtatcgtcaggcgctgcatttgctccacgcgaatggtgccttggtattcactttggataacgctgaggctacgccagcgcgcttgagaaggggctatgggtggggcaggatgctgatcacggttgacggtttgtgagtgcagcagggtaaagttttgatcaaaaaattgccaacgagccagtgacgatgcgcagcccgaaggcgtggcggggaagcggatagtgagatcggccgcgctggattgttcaatccacggtgtgctggaaggggccgaaatcagcagcgccatgcgctgctcgcccagcgtgagccaatagacacctgcggcatacggcgagagaagatcgcgactttccacttcggcgtaatcggcaggcgcaagctctgctgctaacaaggttgcaccttgcgaagatgccagacgcaccgccagcggctggctgaggttttcggcgctcagcctcacttggtagccttgaaaggtctgattgaacttatgaataaaagtcaccgcaatcgcaagatcgttaagcgatgcacttggcagtgcttgtccacattgggtttgactgaggatggcctctttaattggttgccaaaaaggctcggctacgggcgtggtagacagtgtgtggatgagctcgtgccacgcttgcgtgggatgcccctcaaccaatagctggtaactgctttgcagcggtgtggtgcgaaaccaagcatgggtggggcttggcggcgtttccgctatcgcggcgccgcttagtaatgcgctgagtatgccaagtcgcgcaatgtgattgcgaaaagaggcgcagatcatacggaggctcctttgaggcgataaccgacgccgcgcagggtctcgatatccagttgtggcagtttttgccgcaaatgcaaaatgtggttatccacggtgcgtgtggtcgggaaatattgataaccccaaataagattgagcagctcatcacggtgataaacgcgccccggattttgcaatagcatcagcagcagttgaaactctttcggtttgagctcaaccggcgtttggttatgcagcacagatcgattagccacatcgaccacaatatccgcgtagctgagtacgctactgccgagcgggcgcagttgcgcttcgatgcgtgccagcaactcttggtgggaaaagggcttgagcacataatctttcgcccccgctttgagcccttcaatccgttgctccacttcaattttggcggtcagtacgatcactggcagggctttaagcatcaaccagtgcggcagatgtttcaggctgtcaccatcgtgcaattgccgatccaaaatcaccagatcggtactgaaccagtgcttttcgacctgttggctctgcgttacccactcgcatgcataaccatggtcatgcagataatcgcgcagaccttggccgagtaaggtgtcatcttcaatcagcaaaatacgcttcatagcggcagctccaaaatacaacgggttggatgacgacggataaccagtttgccgcccatttgggtgatgagttttcgcaccaactgtaagccaacgcccatgttatctgtgtttgggcgagagtgagtgtcttgatgcctcgaaagtcgtttgcacagacgttggtagaaagagggaaattcaccgcaatcttccacttcaatgcgcagcgtttgtgcaaccacactcaccgtcaggcgaatgggcggcacgccatgctgcttggcattgctgagtaagttggtgacgcacagcccaagccagtaataaggtagtgccagtattgagtcgtgtttgagatgaagctcaacctcaaagccctcgatacaatgctcgatgaagtcactcaactgcgctggatggcgcgccatggtgtcgtggcttgggctcaagtagtggcgactggtttcgctcagttgtgctagccgctgatgatcggccattaatcgccataagctctcttgcgccttgggggataactcatcaaattggctgcgtagtgattcgacggtaaaccctaaactggtgatgggcgtgcgcagttcgtgagtcagcagttgcaaaataaagcgccgctcgcgcccttcttgatagcgcagccaaagtgaacgcagcgcagcgccaaacgcaagcaacacgccgatcaccaaaccgctatacagtaacgcatgactgctgactcgctgattaaagcagaggttgctgtaacgctcatcgcaaggcttgtgcgcttgataaggctcaagcgtgaatggcagtggtgcggtgagtgcgcgccactgcacgctcgaaagcacatgccagcccgcttcgctgcttagccacagttcatcatttggcgcaagataaaggcgaaaaccgttgagcagtgcatctacccccgcagcgcccggtcgttgccacaaggtatgcaacggatgatagcggctcgccaaagtaaaacgtgttggatgcgtcgaagcaaagcttgcctgttctgaatccggtaagtgttcaatatagcgatctgcgtagctgcctcccgccggatgttgccacgcaacacgttgaaaccactctgcgccgagcggcgtttggcgacataacgccaactcaaattcgaccgctttcgccaaatacggcgaagaggagtttcgcggctggcactgcttggccgtggcggctaaatctgcgatgtcttgccaggtatattgagtaaaatcaggatattgactgtgactgctgagtagcgcaaacgggtattgattgagggtttggctcgccaccagtggcgtgctttgctgctcaagtgctgcgcgataaaaaatcgaccagcgctgagtttcaggcaggtcaatattggccagtgtgggcactgcccataagctacacagtaagaggcttaaccagcggtgagtcagcagcaacgtcatgatttaaatacttagaattgggttcatgccaatagtagccgcttcatcacaagatttgtaatttgggtgtcaacaaatctgctgatcaaacgccgtgatcgcttagaacggcccgttgttagcacgaagcctgtccggtaaaccatcgtgatcacccagctcgcgatcgggcacatcatgccagttgagcttgccaaggcgagcattacgttcgggatgaacggcgtagtgaatgcggttatcttctcgttcggtgtctccgatacacaacaagcggacgatctggtcggtattgttgataaaggtatgtgcgagaccatcccccgctttgaagccaaccgagtcgcccggctgtagtcgatagaggacgccatccagccagacatcgggtgtgccttccaatacatgcacaaattcatcttccgttttttccgcgtgaggccaactggtgcgatgtccgggctcgacaatttcatggtgaatgccgatccgcgcgaagccaaaatagtgaccaagcgcgcagccaatagacagcggctcttggctaccagagtagtaacgaggctccttttcctgtagttcactccaatgtttgatgcagggatgacgatccattttcttctcctgttgttgcgccagtgctggggtaacccaatttcaggcatagtaatgattttgcaattggatttgtaatccgagtgtcaacaaataggaaagaggagggaagttggcagcaaagtctgtttttatactctcctttgctgccaatagtggattaatcaccaccgatatagattgagatcaatcggttataactcgatgcttttcaccattcccgcttcagcgtggccggggatgttacaagcaaattccaccttgttatcaccttggaaatgccacagcagctctttggttttgccgggttttacggtgactgtgctgccgctgtcgtgttcatggttacccatttgacgcatcatttcacggtgtttcagttgctccacggcggagccaatcgaaaattcgtgatcgattttgcctgtgttcatcaccacaaactgaaccacatcgttaggctcaatggtgacgtcttttttgaatgtgatcttcatgtcatcactcaaaatgacgtgcaccactttgtttgctttcgcccccggtgcgggcatgcctacatcagacatgccttccatacccatcatttgagaatgatccatcggcatcgccccgtgatccatttttgagtgatccatcgagtgcgcaaatgctgtggtgacagtaaaagtcagtgctatcacaagcagtgttttttttatcatggttaggttccttgttcgggttttgttttgatcagttgtttaaattatggcgtgaaaatacacatcacgtttcacaggggagcagtgacaagcagagttgttgattgagttaagcgattggcggtcgatagagggattgctgcctttgaatcacggattttgtggattcatagggaatcaaagccagttggtattctgtaggtaggctataggtggtttgcgataaaagcgccaacacactcacgcatgcggcgctacaacaattatgtatagtgggactatcactcgtgcaatggtttgaacttatctccattgaggtatggttcatctgcatggtgggagacattttgcttgcatccatcatcacgcaaccggaaggcgcttcagcttcggattggtaagtggaggcactgatcattggccaagtcattaaaggcgcgcttgaagcaatactggaactcagcatggcaaacaggctgataagagcgatccagaagatgcgaacagaagaaaaacgcattgtgtgccttgaatgaaaaacttagtcgcactttaaagttttaccctaggggaaggtcaagtgatgaatatcaaataaaacccaagagctttccctaatttaagcctaccagtaaataggatttgctatcgcctctaagcatgtgggtttaccgctgatcggggtgatcgctttccctgttaacgattgagcaagccaaccttcaggataggacaaagtcaatggtgcttgaatcctctcttcattaatcgcagtaaatccgactttggagtaaaagcgaatatcgccgtaggtcataacaatactgacaccttttgtttttaacgcctctaatccaaaacggatcagagcttgtccaatgccttgaccgtgccatttcgttgccaccgctactggcgcgagaagaaacacgttttcctcattaggaaatgagagcttggagaaaaggatgctgccgacaacgcgttggtggtcatcacatgcgacaaacacgaaaagatcatcttcttgaaggggttggctgagaaaatcggagaccagcgttccgatcacagtgccttcttctgacccttcagaatcagaaaaggtgttttggaacaggttgataatctctggtttttgctgtgatttgtataaagaaaaattcattcttaagtctctagtgattaagtttcaaaacaaagtactgataagtaaaatctttggcagcacttcgttcatagatagcaatctccttttctatgtcagacaaggcttgggagtttgtcagccgaagttttaactcttggacgcggttttgcagcggtaaccagtagttttgccatgcatcgatgcctaatgagaaatgctccatcacctcataccccagttttttgaaaagcttgattcgagaaggtatcgattggatatctgggtattcggattgccaaaattcttgagcttccggttttggattctcagtgagccagaccaaatcactgaccatcaagatagcgttatcggctaaaaaaggtttccactgcttgagtgcgttctccatacccatgatgtagacacagccttctgcccagattgcatcaaagcttttcgctgcaaaggggagcgctgtcatggaacccaataccggggatatctgctctttccatggtgagtgctggcgttgcttctcaagttgctcaatcgcgatgggttcattatcgacggcagtaatgtgcgccgaactgttttcagccagcaggagtgtcgaaaggcccgtttcgcagccgatgtcgaggatgtgctgcatgttttgcatcgacatcaaggaaatggcttttaagctatcttgctcactaccggggccccagtgttgcaaagaggcaaaaaccgtcatgaaatcttgcatatagatgtcgtgttcattcatatctttcgataaccattttaatcggagcgcctctttttcactgtaaccttgcgtgtttagccaacttaagtaagcgtttggcgcatgtttactgagagagtggtgtaactctctttgtggacgttcgccgagcaaggctaaaagcaattctcgagcacgaacctttttctcaatttcatcatcgagttggcttaaacgtctttccaatagggttcggtctagtttcgcctgtaagcactcttcacactcttttaatgagagccccgcactctgaagctgttggataagaaacagttgctgcagatcactctcgttgtaatagcgatagccattatcaagacgttgtccccgaatcaaccctaacttctcgtagtaaagcagtgtggttcgagagagccccgccttaaccgctaattctgaaattaaatacatgctttatctgagctcaaaaggcagaatatgcggctagtatgaactgtagagctatagacaggtcaagcagtgttgagcgattttttacgcacacactcagagattctttcctcatgattaagatagtaatttgcgagaaatcgcgcataatcttgctacttactctgaaagaagacatgacctatgaccaattttcaatattactttcatcaactgccttgttttgactgtaaaaaaaccaccgttagtacggatttaggctggttaacggcggcgatgaaagaggatgtattagcacaagtggcagagctgattgcacaagacaacgttgagccagatctttccgtgaacgtgacttgtactaaagaagaagcgcgcgattacttattactgaacttctacggttactcagaagaagaactggcaaatcaagtagaagcggaagatgagcaagaagtcgcggatgaaatcgcagaacttgtggcagaaggtaatggcgcaattgtgtttgaacacgaaatcgcgctgcaaagttgtaccgattgcgatatggatgaagcgtaatccttcagcataacaacagaatgctttcataatttaaggcgttagcagagttcaatcggctaacgccttatttttataaagcttaagggtgtctggccagtctgttttttaaaaaaggcgatgaaggcactatccgatgaaaaaccaagccaatccgatacctgattcacgggtgtctcttttgaaagcagttcaatcgcttttaataaacgccattgttgtttccactcttgatatgacatccctgtttcggctttaaataaccgagtcacggttttgctactcgctcccactgagttggctagtgacacaaggtcgggtgcgaaaaacgtcgcttgcattaactgttttcggaataccttaaatcgacgatttgttggcaatgggaggtggaatgtctggcgttgagccgcatagaactcttcccaaaataaggtggtggtattgttcatgctctcttgtggggtatcccatgaccatagtgccatcttatcaatcagcgctttgagtaaagcgttcacttcaatcatggtgatgtggtctgggcacttaaaggcatggcaatcaaagtagattgaacgataagcaacgacattggtcatgatggcgcgatgtcgagtgccggacggtatccacaccgctttggtcggcggcagaatacagattgaatcgtctagagcgaagcgaatgcagccttgaggagcaaacagcaattgacctttctggtgctgatgtagcccagaatcgtgattgcctatgtcagcggcaatgcccactacgcaagcgggtaagcgatctgggtcgaatgaggtctgttgatcaataatggccatcttgtccgatttttgatgtttttggtatttatgttgttaatggggagagagtagtcctctttatactgcgcgccaagtaaattcatgaatgagggcttgatatgaagacgaagccttctctctggttgatggtgattatgttgatgtttccacaaatcgtcgaaaccatctatagcccggtgttgggctctattgcgcggtcattttcggtgagtgatgcccaagccgctcaaaccttgtcggtctattttttggcttttgcattgggagtggtgatatggggagtactcgcggataaatgggggcgtcggcctactatgttggtgggcctactgatttacgggagcgctacatttatcgcaatgcagacagacagtttcactatcttgatgttagcacgagtattcagcgcctttggtatcgctgtcggttccgtggtaacgcaaactattttacgcgatgtgttcagtggtcatgaactgagaaaagtttttagtttaatggggataggtatatctataagcccagtgctagggatgttgcttggtgggcagttagcgtttgcaggtgggcatcaattagtttttctggcgctattttttatagctctggtgctgttcgtttataacttgtgtcagcttcccgaaacgcaacaggtcaagccgaagatcgcattgggttgtttagtggctcgaatgtttaaagatagacaagtgctgctttcagcactgctagtggcgttatacaacgtggccttattttcttattaccagcttggtgcctttatctttagcgatttggggttagatgcggaacagtttggctatagtggtattgcacttggcctcggtagcttaatcgggagctttcttaacaaaacgttgcttgctaaacaggtgccacagcgtgcgctgcttttactggcagcactgttattaatcatgggaactataggcgtatctttgacgcttgattcgatcggttttgtggccgcaatgatattggttgtgatcgcttatggtatggcgattccgaatatcttgagcactgcactggtggagtataaatcgcaagcagggagtgctggagcgctgtttggcctgctctattatcttttgattggtagtggtttggcgctcacgggtttagtacaacgtttaggtgtcgtgcttctgatgtgcgctggtatcaccttgttggcaaccttagctcgctctagtcacatagcccgtctaccatgaggtttatgagaacctttgttgagagttatctttggcactcaacaaaggtgaactgacaccttcagataccctcatcgcataaaattcacgaatgataatattattgatattcatggttttaatttaattttgtcctccaaagcgctggatatttctgtgatagagcttgcatatcttgaatctatgaaccaacttttaaaggttggctaggtggctctcgtgtcatttcattctattactctaagactcgaccccacctgaagaggaaccgcaatcacatgcatgaaaacggcagggggagtcatgactctaggattcaaaggaagaatatacgccagtgtggtcattttagtgaccatatcgctgatggtgttaggtacgattaatatgctctctctcaaacgagagatgattgattcattaacgaccgaaacgcaaaacaagctcaattaccatgtgtcagaactcgagttttgggtgaaaagtcgttacgaggccgtatctcgtggtgcgaacttgtttactccagagttatcggataccgataacctcaataaagtacgacttttggcggaagcggcgcagatcaccaatgtgattgcggcctacgaagatggtcgctcttatatgtcgatggacaaagaggggggagtgacgacaaatcggtttaaatttactgaccgtgactggtatcaacaggccaaaagtcgtcgtagcccatttttgactgagatttatcaagatcaagtcactggcaaaaaagtgatcagtgcggttagcccgattcttcatcaaggccaatttgtgggggctttgctgggtgacttccagcttgatgacatcatcactcaagtgagtaacatgcgttttgccggaggcgcagcgacactgaccgataaaaatgcggtgttttttgccagtgatgatcccaacgatattggccgcaccccttcccaagtcagcccatcgtttcgcgaaatggaagctgggtttcaccgtcaagagagtggacatctttcgttcccgtacctagggattgaatttgatggttactacaaacgtgtcaatctaaccgatgatatgtactggaccttgatggtgtttgttgataaagccaccgcattagcggatgtcgatgtcgccgtagcgaatgcgatcacaactgggatagtacttatcgggatcagtgttggggtgattatcttcattatcaatcaaatctataaacctttgctgcgtttgaaagtcgcggttttggatttggctcaaggcagcggggatttaactcgtcgcttagaagtgaatggtaatgatgacttggcgcagatcagtgaaggcttcaaccgtttttcaggtaatttacaaaacatgatgctgcagatttccgatgcaacacagatcatatcaagcagcattgagcagttaagccagacggcgaaagagaacgaacagatgttgatttctcactcttccgaaaccgatcaggtggttactgcgatcacgcaaatgagtgagagtgcgcgcacggttgcggaaagcgtcacgcaatcaaatcagatcacagaagccgcgagcaaagaagcgcagcaatctttggtgattgtgaataatgccgtatctacggtgacttctttggtcaacgatgtggaaaatatgtccgaaagcatctctaacatgaatcgtgatgcaaacaaaatcagcgaagtgttgagtgtgattggcgcaatctcagaacaaacgaacctgctggctttaaacgctgccattgaagcggcgcgagcgggtgaacaaggtcgcggttttgcggtggtggccgatgaagtgcgtgccttagcggcaagaacgcaaaatagcaccacggaaatctccgatatgttgacgaaattgctggaaggtaccgacagcgtcgtgggtgcaatggagcgtactaagcagcagtgtcaaacgacggcggataaaacctctgaagtgtcaggcagcctgaatatgatgagtgcatcggtgagcgacattgatgatctcagcacacaaattgcggcggcgacagagcagcaaagtacggtggccgcagagcttagccgtaacatgctctcaatccgtgagatagtcgagtctcttgtggtcagcggaagacagaccgtaggcgcgacagaatcgctttctcactcgaatcatgaattagaacagctagtaggcaaatttaaactgcgttaattaaggtgttcaatcatgagtcatgtgttatctgatcgctggttggcgctgtctgccaaccagctcaatccgcgtttcgagcaacattacttcgccgtaaaagcgaagtttttttcccgcgatccggcattgtggccgctgtatcgttcgttggaaatccaaccgcttttgcagtcgcgtcgagagtcacccgtttacgatcatcatctgtttaaacaactgactactcgagaggaagtgccccctttttcacgttaccaaggcaagccatttgatgaagtggctctttatgccgctcagcattcgaaaaattgggacgatcctcgctcggtcgagaatgtgatttcaaccccgagtgatcccgctattcacggcgcattactggcgatgattgccaatcccaatttggtgtacggcgaatattcgggtatggcggcagagttagaaaagttggtggtacggcaaattgcttcactggcgggctattctaccgagcaggcgactggaatttttacccaaggggggacgttttgtaatttatacggatacctgcttgggctgcgcaaagcattacccagttccatttctcaaggtatctcgacaggttccttgcggatgctgaattcggaggcaggacactactcgaacatgacaaacttggcgctgctcgggatcagtgtgcaatcacaggtgatccgtgtccgagtcaatgacaataacgaaattgacttgattgatctgcatcgccaactcagtcgctgctttgagcaggagcaagttgtgccaaccatcatgctcacgtttggtacgaccgatacgtttgcgctggatgatatcaaagcggtgtatgacatccgtgaatcgctctgccatcaatacggagtgcgtcgtaaaccgcatatccatgttgatgcagcggtagggtggagtttgctgtttttcgcaagttacgatttacagcgtaacccgttggcgattaatgctgcgaccttatcggccatcaccgaatggctacctaaaattcgtgcgctgcagtgggcggattcatttaccgtggatttccagaaatggggttatgtaccctacacctccagtttggtgatgataaaaaataggcatgatttacaggcactcaaatctgatcccagttatttctcctattttgaaactgcgcggcaacaagaaacgcatttacaagccacgatagaatgctcacgcagtgcagttggggtgtttgccgcctattcagcattgcaaatgatggggattgatggctatcaaaccatcctcgcgcatggcttacaaaatgccagttatctgcgtgcgcagttggcgacactggcgcactgcaaactgattgcagaacaaaatcatggtccgagcgtggcatttcgtctctaccccccgagtgtaaaatcggctcatgacgcgttcgctctagagatggatctctgccaacatccagattatgtcgagaagatggtgactcacactctgtatcatcgtagccactttcttgcgcgtaaggggcaaaccttaaacagtaactgggttgaatcactaacgcgtacccattacgaccctgagggacactgcttgcatttgccgggagaaaaagtggtattgatgaacccgcataccatgcgcactcatttggatgctttcattgcagaaatgagcctcagataggcattcttcatgactgaccggctgagtgtggtgcgctaagccggttgggatctgtaacacaatgtaagtactcggcctgcaactgtaagagttagtaaagagaagctgtgctaaagtcgcagttggttatactgcttgcttagtattttattgggggacacgttatgaccagcaccaagtttctcgtcaggttttcaatggcttgtatggcatttgtgccaacgttaggtttttccgctttgaccgtcgtacccgagccgccacaattggccgctaacggttatgttctaatcgatttccatacaggtaaagttctggtcgaacacaacgcacatcaaaaactcaatccggccagcttaaccaaactcatgacctcgtacgtcgcaggacaagagatgaagcgtggcaatatccatgcggatgaccaagtgcggatcagcaataacgcatgggccaagaaatttccagattcatcaaaaatgttcattgaagtgggcacttacgtcaatttgatggatctttaccgcggcttgatcgtgcaatcagggaatgatgccagtgtggcgattgccgagcatgtcgctggatcggaaggggcgtttgtgagtctaatgaactcgtgggcgcagcaattggggatgaacaatagctcgtttgctaaccctcacgggctggataatcccgctctgtacagcacaccctatgacattgcgttactgggccgtgcgattattcgcgatctaccggaaatctacccgctgtacagtgagctttcatttacttacaacggcatcactcaacacaaccgtaatggtctgctgcgcgatcgcagtatgaatgttgacggcatgaaaacaggttacaccagtggtgcgggatatagcttagccagctcggccaccagtggcgagatgcgcctcatttcagtggtgatggggtcaaaaagcgtgaagagtcgtgaggcagaaagtaaacaactgctcagttatggtttccgtttttacgaaacggtgacaccacatcaaaaagacacggtgatccagaatcagcgtctctggtatggagataaaaacgaagtggcgttgggcagtgctgatactgtctacttaacactgccgcgcagcgacgtgaaaaaactcaatgctgtgatccaattggatcaaaacctcgaagcgccgatcgccaaaggtgatgtagtaggctcgattttctactacattgatgaagaaaaggtcggcgaggccaaattggttagccaagaatctgtcgaacagggcgggatctttaaacgtctgatggattggttcaagctgctcttctctggttggttttgatcgcagtctttggtcaattacccttatcgatagtattctcactacaaactgggattttgatctcagtttgtggttcgatgatcaacacacatcgcaaactcacaccagattgacacgttgctctaaaaattctggcatggtatcggccattcgcaacaacgacgaggagaggcagaaatggaactgaaccaagaagaccgtaaggcactgtacgacgtctggatgactaagaaagccaaaatgcacatgactcagatggagatgactaagcgccttggtgtgagtcagggagagttttcggagctactgcgtggtgatgcgccgctgtctatgtctttcgtcagtcgtttttgccagcacctccatgttgagccgcacaacgtattacctacgctaaaacgcaaaactcgctctggtgaaaagcttgtgcatctgcaaaaccgcgttaccgtcgatggggatattaaacgtgtttatgtcgaaggaaatcaggtgatcatcgagtacacccatctcgccaaataacctgactggttaagggctcgctcctcacggttggctttatagatactctctcatccagtggcagtaaaagatctgccactttttatcgatagacttacaattccgcgtaacgatacaagagttcggtcaactgggttgaccatgccagagcgttttctggttgtgtcgcgatcagtttttctacttccgcacaatgggtttctaaatccacactctgctctaaatgaaaggcaatggcataaaagtgccacatcaaaaggcgtgtcatgcgctgggtattttgcatcgcttgatctgagccttcaaacatcgcaggtagctggcctaaagcgatcgcgtgcattttcaccattgcatcaatatgtgccatgtgtgctttttcttcgccttcaaattcttcatcatcaaagcggtacaactcgcgtaaagtctcttcgctgatcaaacggtgcaaaatgcgcaaactgaattcggttagctcttgtttatccattgcacgcaggcattgataagtgtagtcacgctccatggcattactcttctttgggtcataacaggaggcgacattgtaaagagtttttgagtgagtgccagtcaatcttatttgagtaagttgtcgattacattcggccgtgatgagtttctagaatcttatattccgaacatattcattttgtctaccaatactattctgcatcatgtcaaacctaaaccatgattcaatcaaccagttaagtgagggactatgaaaaagacaacgtgggtattagcgatggtagccagtatgagcttcggcgtacaggcttccgagtgggggtatgaaggagagcatgctccggagcattggggcaaagttgcccctctttgcgcagagggtaaaaatcaaagcccgattgatgtcgcgcaaagcgtagaagcggatctacagcctttcacgctcaattatcaagggcaagtggttgggctgctcaataacgggcacactttacaagcgatagtccgtggtaataacccactgcagatcgatggcaaaacgtttcagcttaagcagtttcattttcataccccttctgaaaatttgctaaaaggaaaacaattcccactggaagcgcattttgttcatgccgacgagcaaggcaatctggcggttgttgcggtgatgtaccaagtggggtcggaaaatccgctgcttaaggttctcacggcggatatgccgaccaaagggaattcgactcagctcacgcaagggatccctttggctgattggatcccagaatcgaagcactactatcgtttcaatggttcattgactacgccgccttgcagtgaaggtgtacgttggattgtgttaaaagagccagcacatttgtcgaatcaacaagagcagcagcttagtgccgtgatgggacacaataatcgacccgtacaaccgcataatgctcgtcttgtcttgcaagccgactaaatacaaggcttagcaggcataaaaaatggcgtccaagaggacgccaaaaccttcgcagaaattaaattcacagaagttaaattgggacgagaaaagtctcacaacagcgatgataagccgtgtggctggtcatcctttactgccgcctgtcaacgttaactttgtgatttgacgagaagatgtctgttttgctgcgatttgatgacgtctcgaaaaaagctataaaaatccgccttcttagaaggcggttttaatataagccccctaaaagggggccacgacgctgttagtctctcaataactctaactgctgctcttgctcaagctcttttttgtcttgatgccgtacataccgtctaatgatttcttcatttacacctaccgtatccacaaaatagcctcgcgcccaaaaatgatttccccataactttttcctgatatgtggaaacttgttgaatagcctaattgcactcctaccctttaaaactcccatcaacgtcgaaatcgatactttgggcggaattatcgcaactaagtggacatgatctggctgaacattgagttccaaaacttcacaatctttcatattacaaagaatgtagatcgaacgatttagctctttggcaacattaccttttaagatcttaaaacgaaattttggtgtccaaacgatatgatatttgcaacgccaatagacgtgtgatgaacttctgtagtcgcccatgttatttgaatcctcttacttatggtgaataagagtttgtcttctaacatgggcgcattttcgggcaaaagcccctagggacaatcaccaccgctaaaagcggtggtttagggatgacaatgaaaaaggcgagcactctggctcgcctttgttaaacggatggtcatccggatgaccgattagtcctgataactgtcaatgcttgggcatgaacagacgaggttacggtcgccgtaaacgttatcgacacggttcaccgttggccagtatttgctggctttggtgtgtgccgatgggaagcaggcgatttcacgtgagtatggacgatcccatttctcttcgcgcagatccgcttgggtatgcggcgcatgcaccagagggttgctttcaagcggccattcgccatttttcactttgtcgatctcgccacgaatcgcaatcaatgcatcacagaagcgatccagctccgccaaatcttccgattccgttggctcaaccattaaagtgcctgctactgggaatgacatagttggcgcgtggaagccgtagtccatcaagcgtttggcaatatcttcttcgctaatcccagtttcttctttcagaggacggatatcgatgatgcactcgtgcgccactcgaccatttgcaccacggtaaaggatcgggtagtgcggacgcagacgctccatcacatagttggcattcaaaatcgccagcttggtggcttcagccagaccgtctgcacccatcatcgcaatgtaggcccaagagatcggcagaatggacgcgctgccaagatcggctgcggaaaccgcgaaatcagaaccctctacgccaccttcaatgtgtcctggcaggaaaggtgctaggtgcgatttcacaccgataggtcccatgcctgggccgccgccgccgtgtggaatacagaaggttttgtgcaagttcaggtgtgatacgtctgagccgataaagcccggtgaggtcagccccacttgcgcgttcatgtttgcaccatcaaggtaaacttgaccacctgctgcatgcaccatttcacacacttcacgcacttgctgttcatacacgccatgcgttgaagggtaggtgatcatgatgctggaaagatggtctttgtgcttttcaattttgtccgcaaggtcaaccatatcaatgttgccgttttcatcgcatttcaccaccacgactttcatcgacaccattgccgcggtagctgggttggtgccgtgtgctgagcttgggatgaggcaaacattgcggtggccttcgccgcggctttggtgataacgctgaatcgccactaaacctgcatattcaccggaagcccctgagttgggttgcagtgagaaagcatcataccccgtgatttcacacagtttttgcttcaggtcttcagccaatgccgcatagcccgcagcttgtgcttttggtacaaacggatgcagtgcgccaaactcaggccaagtgacgggaatcatctccgcggtagcgttgagcttcatggtgcaactgcctagcgggatcatgccgtgagtaagagagaaatctttgttttccagatgcttcatataacgcagcatctgagtttcactgtggtgtgtgttaaacacagggtgagtcaaaaacgcgctttgacgacggcaactttctggaatcgcggcgagctcattggtcgcaatgcggtcggaaagtgcatgaacctcttctttaataccaaagatcgcaaagagcgcttcaacgtcagccactgtcgtggtttcatcaaagctcacgccaagctgattaggcagtttacgcagattgatgttcgcttgttgcgcagcttggtacagagcatcggtttttgcacctgtattgatcgccagcgtatcaaagaaatgctgatgcgccagttcgtaacccgctttggttaagccagcagcaagaatcgcggtgaggtggtgagcgcggcgcgcaatagtgcgcagaccttgtggaccatggtacaccgcataaaacgcagccatgttggccagcagcgcttgcgcggtacagatgttggaggtcgctttttcacggcgaatgtgctgctcacgggtttgcattgccatacgtaaggcttggttacctttcgcatcaatcgaaacaccgatcacacgtcccggcatggtgcgtttgtgcgcatcacgtgttgccatgaaagccgcgtgtgggccgccataacccataggtacaccaaagcgctgagcagaaccaattacgacatctgcgcccatttcacccgcaggtttgagcagcacgctggcgagtaaatcggtcgctacggtgactaaggttttgttggcttgtgctttggcgatgatgtcagtcagatcgcgcacttcaccggttgtacccgggtattgcagcagtgcgccaaaagcttcttgttgggtgatgttgtcaatcgaatcgacttttacctcaaagccaaggaatgcggcgcgagttttcaccacttcaatggtttgtggatgcacgtcatcggcaacaaagaacaggttgcttttgctcttgcctgcgcgttgacacagtgccatcgcttcggccgccgctgtcgcttcatccagcagtgacgcgttcgcaatctccatcgcggttaaatccatcaccatctgctgatagttaagcagcgattcaagacggccttgcgagatttctggctgataaggagtgtaagcggtgtaccagcccgggttttccatcacgttacgtaaaatgacgttcggtgtgaaggtgttgtagtaaccctgaccgatgaaagtccgtttaagctggttaagtttggcgaacgatttcatcgttgccagcatatcagcttcgctttgagcgggcgcgagctgcattggcgcttctaaacggatttgggcaggcacggtttgggcgatcagcgcatccaaactttccgcattcaccgttttaagcatggtggcttgttcttgtttatctggcccgttgtggcgtgcaacgaactcattttgtgtgcttaggctgtgaagtaattctgtcattgtcctttaccttctttccatgtgagcatgcgaacaaccttggtggaatcaccactcacttggcgatcaaacatcactcatttgcggtgagtgactttgaaaaaaagccgccctgaagggcagctttctcatgcatattgcgtttagtcttcttcgattgaagctaggtactcttccgcgtcttttagatctttgagttcatcaggatcggacattttcactttcacgatccaaccgccatcgtaaggctcttcattaatcagctctgggctgttttgcagatcttcgttgacttcaatgacgacaccggtcactggtgcatagatgtcagaagcggctttcaccgactcaaccagtgaaaagctgtcacccgcatcaatttcggcatcgatttcaggtaactctacaaacactacgtcaccgagcatttcttgggcgtgctcagagatgccgatggttactgtaccgtcaccgttgtcgcgaacccattcatggctttctgtgaacttcagtgtcttgtccattgcgtattctccaaaaaatatcgtactgataaaaagctattgatagagcgggaagcgttggcacagtgctttcacttgtttacgcacttgttgctcaacgtctgggttgccttctgggctggccaccaaaccatccagaacgtccccaatccactcaccgatgagtttgaattcttcacgaccgaaaccacggctggttccggcaggcgtacctaaacgaatgcccgatgtaatcataggcttctcttcgtcaaatgggatgccatttttgttacacgtgatcccggcacgctctaaggcttgttcaacttggttgcctttcaaacctttaggtctaaggtcgaccaacatgagatgcgtatccgttccgccagtcacaatgtcacacccgcgagtttgcaacacttcagccagcacttttgcgttatcgatcaccgaatcaatataagtacggaattcagggccgagcgcttcaccaaatgccactgctttagcggcaatcacgtgcatcagtgggccaccttgtaaaccggggaacaccgcagaattgatctttttgtggatctcttcgctgttggtcaaaatcatgccgccgcgcgggccacgtagagttttgtgtgtggtagtggtgacgacatgagcatgcggcaatgggcttggatgtgcgccagttgctaccaatccggcaatgtgcgccatatcgaccatcaacagcgcgccaacttcgtccacaattgagcgaaattgagcaaaatcgatagtgcggggaatggcactgccgcctgcgatgatcattttgggtttgtgctctaacgccagtgcacgaacagaatcgtagttaatttcgagggtttggcgatccacaccgtattgcaccgcattgaaccatttacctgaaagagcagggcgcgcaccatgcgtgagatgaccgcctgcatctagcgacatacccataatagtgtcgcccggttgcagcagagcaagcatcacagcgccattggcttgagcgcctgagtgtggttgaacgtttgcgtattgacactgaaaaagcattttggcgcgttcgatagcaatctgctcaacgctgtcaacatgctcacaaccgccgtagtaacgacggccgggataaccttcggcgtatttgttagtcaggcaagtgccttgcgcctgcattacggctttagagacgatgttttcagaggcaatcagttcgatctgttcattttggcgggtgtattcagcttgaatggcggcaaataccgcatcgttggtcgccgccagtggggtagagaagaagttctcaaggctaacgttgggataagctttgtttagatttgcattcatagtagatggccttccaatctgataaccgcactaagatggggttatcgctcctttttctgatcgcgatactcatcgcgatcggctgagtcattcctaatcttgattgccctaaaccttggcaacataaccccaatgagcgggatcgaaaactcgcggaaatcgactggtcattcagcctaaagcagcgagtgattgcatctcttcatctaacaagtcgataacatactctttgcttacagaacaatcaatcaaaaatttcctataggaaacacggtttctgatctgcttagcaaaagtacttttatttctttgtgtgctctttaatcaacaaatcgcttcatgccacaatgcttggtagacaggaagttttataaccagagggaaagcatgtcagaagacatttatgatgagtacccatccatcactttggctcgcgaatcgggcgagcaaggtatcgagccactcaagctgggtcagcggatcaaagatattcgcacgcgattaggcatcacgcttgaagaggcgagccagcgtactggtctcgctcgctctacactgagcaaaattgaaaacgaacagatttcgccaacctttcaggctatgcaaaaattggcgcatggtttgcagattgaaatgccgcaactctttgagccaccgaagaaaattgtagcgacagggcggcgtgatattacccgtaaagaagcaggaaaaccgcacccaacccaaacctatgaacatgaattgctcgcgactcaactttctaacaaaaagatgatgccgttcaaaagccgcgtgcgtgccagagcctttgaagagtacagcgattgggtgcgtcacgatggtgaagagtttctgctgatccttgaaggtgaagtgatgttctacagcgaattttatgagccggtacatctggtggaaggggacagtgtgtattacgacgccaacatgggacacatgctggtttcagtgagtgaagaggatgcgctgatcctttgggtcaccgcaagatagtgagtttcctatccgaaacatccgcgtataacaacccaagacgtggagtgtgttggtggtggtttttgataaccattccttaacaatattgttaactgtgatggtgagcactgttttaatttgttgaatcctctaaaacgggctcggcttgtttattatcggaaacatagtttcctcactaaaggaatcttgccacggtagattgcgccaaaagcgcagctttggcttatatggagaacaagaatgactgaacaacacgaaaccttactgacgacaccgctacatgcgctacacattgaagttggcgcaaagatggtgccttttgcgggctacgatatgccagttcaatacgcccttggggtgaaaaaagagcatatacacacccgtgaagcagccggtctgtttgatgtttcccacatggggcaactgcgtttgtacggtgctcaagcggctgccgccttagaagccttggttccggttgatattattgatctccctgttggcaaacagcgttatgcgtttttcaccaatgcccaaggtggcattatggatgatttgatggtggccaatatgggggatcatctgtttgtggtggtgaacgcggcgtgtaaagcgcaagacattgcgcatctaaaagcgcatctgcctgcggatgttgagatggaagtgattgaagatcgtgctctgctcgcgctgcaaggccccaaagcggcacaggtgctcgcacgtttgcaacctgccgttgccaagatgctgtttatggatgttcaactccttgagatcgatggtgcagaatgtattgtcagtcgcagtggctacaccggtgaagatggctacgaaatctcagtgcctgctgataaagcggcggcactggctcgtaaactgacggattttgaagaagtggagtggataggccttggtgcgcgcgactcactgcgtttggagtgtggtttgtgtctctatggacacgatctcgacccaaccacaacgccagtcgaagcaagcttgctgtgggctattcagcctgtgcgccgcaaaggtggcgcgcgtgagggcggttttcccggtgcggagatcattctcagccagattgaaaccaaacaagttagccgtaaacgcgtcggtttgatcggacaaaccaaagcgccagtacgcgaaggcactgaactgtttgatgcgcagggcaacaagattggtatcgtgaccagtggaactgcaggcccaacggccgacaaaccagtttccatggcttatgtcagcactgagcacgccgctttaggcggtgaagtgtttgctgatgtgcgcgggaagatgctgccaatgactgtcgaaaaaatgccttttgtgcctcagcgttattatcgcggagcataatttcttcagtgtcattcttatgagtaacgcttattagcaaaggaagggaaaccttcctttgtgctttttgcaacggaggtttgcagtctcaactgaccgagaaagcggttgtcatttcagcatattgctttatgatgctgcgacgtacttaagctggtgcatccgtatttgcgccaaaatttgtaccgaattttttgaactcgttacgccgctatttattacagaatgaatttaaagcgtaattttttcacacaagtgttgcttggtgtaactcaccagtcacctttcattctctttccccgcacatcacacccattccaacctccacaaaaagtccatatctagcaatcagttagaaaaaattctattttcattttaattcttgccctatctatcaaattgaatataaacctattgcatcaaaagaaatcttgtaccaaatttgtaccaaattttctgatgcaaggtgagtatggcaataacggatgcatggttaagagcaaccaatggcaaaccctattcaggtaagactgagataagccacagatttgggcttggcgttcgtgttagccctaaaggcaagatcacttgggtttatcgggctaacatcaacggtaaaatgcagcgcatcaaattgggtgaatacccagcaatgaagctgcgcgatgcaatccaagccagagaaagccgagctgagttagttgagcttggttttgacccaagaaaatccacaagatctgctaacgatgactcaataatcactttgaacgatcttatcgattattgggcagagaaccatgcaagagacaacataaagcagtgtgatgcattgctgaaaatgttccacaccgatatcactcctacactcggtaattacccagcaaaacaactcgaactgatcgatttcatgcctgttttcttgaaggctaaaaggcgggtgagtgcaaagcattcggctaacctgatgacacgtttcaagcaagtactctcatatgcagtgcgtcatggtttgttgaaatacaacgtactgacggaacttaaaaaagccgatgttggggtgcccactacaccgaagagaagccgccaagacgaacaaggtgtcaaagcactttggaaagcgattgatgatatttccattcacgagagcaataaaaactttctgcgcttgatgctgatttttgccaaccgcagtaacgaattgcggctggctaaaaaagcagactttgatcttgagaaacgagtgtggacagtccccgaagagaataacaaggttcgtaagaagcaaggcggtgctattcgcagagctattccccctcttgctgaaaaaattatcatggagcaatttgccatttggccgaatcacaccatgatgttccccccggtgaatacggaacaagacaggccaatgtcagctaacgtgcctgtcgattttggcagcaagctggccgatagaattgaagaactcggtttcccgcgcacaaccaatcacgatatgcgaagaacggcgcgtaacatttgggagtcaatgggtgtgccataccacgtggcagagacaatgttaggccataaagtgcatactggtgttcagagtcattatttagggaagatgcgattaagtctctgatatgagatcatagcaaccatcaaaacagcaaggatgaggtgaccgatgagtcatcaactgactttcgcagacggtgagttttccaataaacgtcgacaaacccgcaaagagctcttcctcgccagaatggagaagctcctaccatggtctcagttgctcgcggtgatcgaacccttttatcccaaggcgggcaatggccgccgcccttatcctctcgaaaccatgttccgcatccactgtatgcagcagtggtacagcttaagtgacgaagcgatggaagatgcactctatgagatcgcgtccatgcggttatttgcccatctttcgctggacagagccattcccgaccgcactaccatcatgaacttccgccacttgttagagcagcatcagctgggacgcagtgtgttcgagccgatcaatcaatggctcagcgagcgcggcgtgctgatgaagcaaggcacgttggtcgatgcgacgattatcgaagcgcccagctcgaccaagaacaaaaccaaccaacgtgatcccgaaatgcaccagaccaagaaaggcaatgagtggcacttcggtatgaaggcacatattggtgtggatgccaaaagtggcctcactcatacactggtgactactgccgctaacgagcatgatctgaatcaattgagcaacctgctacacggtgatgaagaattcgtctccggtgatgcaggctaccaaggtgcacacaagcgcgacgagctgaagggggcagacgttgattggctgatagccgaacgtcccggtaaagttcgcgccctgaaaaagcaccctcgcaaaaacaaagtggccatccatatcgaatacttgaaagccagcattcgggccaaagtcgagcacccgtttcgcatcattaaatgccagtttggttttatcaaagcccgctacaaaggcctgatgaaaaacgacaaccaattagccatgctattcaccttggcgaatctggtcaaagtcgaccaactgatacgacgacaggcgagatctgcctgaaatccgccaatagccggagaaaacggctgaaagtggcttgaaacgctcggaatcgacaaaataccactcgttttacgagtaaaaagtcagcgatcgcactgtcgtgcgacttggagcagttcagtcaccacttaatcgcagcttcccttggaaaattgcgggagcccaatgctgacatccgactttgtcaatgagtcgttagggtgagatattagtcaccaaatggcagtttgaccatagagcaatatttagtatattgataataactaattgatttgtatggatgttggattgtgaccagagctcgtaataaaaatactggggaaatagaagaggccagtcaactaaatcggtataagaacgttaacgctattcctaaaggtcaatatgaatgtcctaatatgctatgcagatatcctgctactccatgggctgttaatactgaaaagcgttcaccggcatttcagtataaaaagcatcatgctgaaggctgtcattttgagacgatgactggttcagataaacattccaatagcgatgcaggatctagttcgtttaaactaccttatgtgactgattttatagaaccaagaaaacaatcaggagacggtacattaggatctggtgggaaagtatctgtcaagaatactagcggtggtagaacgaagacaggtatatcgagaactgccagaaaaaatcagtattcgtcaatgttaggggcattggttgatttctatttggaagatccagacaagcacggtcctttatatctcaatttattaaaccgcccttttacctatcgcaaatctttccaagaaataacatcaaagcggaatattggatacaaagacaattttgtattctattgtgaaattaaaaactctgtaccgattgttatcaacgaagagcatttcacaatagagttgatgcgaaagcatcaagatgttcaaaactataaagttagttttgatactgatggatggacagagcatcaaaagcaatcgttaattgaaagcctaaagtacgtacgacaattatctactgaagcattcaaagacagaatacaagaaacagcatacatcttcttcatcggcaaacaagacaagtctgaacgacatgtctttcattgtgtacattcacaatttgctcacccttattttggggtaaagccaagattattatcgaatgtatggggaacatttaagttagaaacagaaatatctgtagcctcctcagaagttgagaatcaacttgttgattttgaatcaaagactttagaggatttcgtaccagaaccagaaccagaaccagaaccagaaccagaaccagaaccagaacagaaccagaaccagaaccagaaccagaaccagaaccagaaccagaaccagaaccagaaccagaaccagaagttaacaaagtagaattcgtagctacctccaaagaaactcaagatggtacacaaaaaccagttcagagagttcatcggaagaaaggggtattaagttggttaaaaggaatatttgtatcttggtagatatgtatttggtgtgacgtttttattttgttagatattgaatctcataacctaaggttatgagtttcattgattatcatgaacagttcaaagagaattgtgcgcaatagttttgaagttactgaatgctgtatagctacacccaatttataagggtgtagctataaattgaagccttacccgataagttcggaaagagtcgccatgtgatgcattatgttcaactctttaggtatactcaattgtgagaatggcttacgaactaatgattctagacctttgtaccttaaagtagttttatcaacgtatgattcaccgtttgcagacgtcacaaaatcaattagctggtgaacggggttgcaagttaggcaattcgttgctcgatttaggctaaaaattgcctagctaggcaatttttagttgcatataagccaaattctggaagctacatatcaaatatcaattgggtatgttttttgtacagaaatgagccatctcaataaacagtagaagtttatctatggtaaaggcagttattgtcggtgatatcggcaccgatcatgatgggtttccgccaacaaagattaccagtggctcgcctaatgttaaatttgactttatgcctgcagctagattaggggatccattagaacctcattccaaacctaaacatccacctcatgggagatccatttcgtctgggtcttcaaccgttatgatcaatggaaaacccgcagctatcacaggtggtagtatttcttgtggtggtgtaactattggcagttcatcagtcaatataggcgattcgcatactcctgcaccaagttcaattttgagtaaaacactgtatgacatcaacgttaaggtaaaagataccaatggttccatatgcccatttatggaggtcttgtgcttgtttgatgatggttcagagctagtgatgaagactgatgctaatggtgaactaaaaggtttagctaaaggcgacaagatgaaaaaagtatcagtgaagccaaacaaaacaaaaaattggttattgagggatagctaatgactgacactgtatcatcaactccagtagccgatacaactccatatgagatatttctttcaggtaatgacgattttttgatacctgtagtatttcctgactacctaatctcagtcgcagatgaacaatcttttgagttatggggtgtaaaaataaaaactcctgcagtgaaggccccctaccttggtcacgctggagttattttgattaatggtgaaacaggtgttactcgctattatgagtatggccgttacaagaaccctaaatcggatatcccaggaaatgtgaggaaggttggggtatcaaatgtaactataaaaagtggtctaattactgaaagctcgttactgaaggttcttaaagaagtgtccctacgttctggacaggaggggagaatttcgggagtggtattaagaggaaagtttttctctgaagcagattcatggttaaggggaaaaatggatcttaataatagccctgataagataccttatgacttggatagccataactgcatgacatttgtcatagatttagctgatgcaatggggttagacccggcttggaaacctcctgttgttgtaccaagcgcgtatattgaacagtttcagttaagtgaaattgatttagattatgactataagaccaacaaattaacggtatctgagtgatatgaaaaaaatcataaagtggtttgcaatcttactggtatcaacctgtcttgccgtagtgctcttggctacgtttctttttaaatttgaatattcggtaccaaatgctcagattattggacaaatgatttggttcccagagcccacagcaacgggtctcagtattgtagagaataaacatcctatctatacgattcgtataacgtgtggctctccggataatatttgccatgaaggcctatttgagtacaaagggaacacactaagcaaaattgagataagagattttgctagctatttaggtgaagaaatcaccttaacgaatggtgaaaccttagaacctatgaattgagagtatctctaagaagttttgcgttgtattagaaacgcctactttaagtgggcgtattttgtttctgcgcttttgtgatattgattgcgctttcatgtcgattcgttagaatgcaatccaagtacttaagctggtgcatccgtatttgtaccaaaatttgtaccaaatcttcaaaaatcgttacgcaaaattcataaagcattgaatttaaagcgtattttttcacacaagtgttgcttggtgtgcaacaccactgtaaggataatacatgcctattattactcttcctgacggtagtcagcgtcattttgacaacccagtatctactctcgaagttgcccaatctatcggcccaggtcttgcgaaagcgaccattgccggtcgtgtgaatggtgcacgcgttgatgcttgcgatctgattgaacacgatgccagcctagaaatcatcaccacgaaagatgaagtcgatggtttagaaatcgtgcgtcactcatgtgcgcacttgcttggccatgcactgaagcagctttacccaaatgcgaaaatggcgattggtccaaccatcgacagcggtttttactacgacatcgatctcgagcagtctctctctcaagaagatcttgagaaaatcgaagctcgcatggttgagttagcgaaaaccaaatacgcggttgtcaaaaagaaagtgagctggcaggaagcgcgcgatacctttgaatcgcgtggcgaaagctacaaaatggaaattcttgatgaaaacgtggcgcgtgatgatcgcccgggtctttaccatcacgaagaatacattgacatgtgccgtggtccacacgtaccccacatgggcttttgtcaaaactttaaattgctgaacattgcaggtgcatactggcgtggtaacagcgataacaaaatgctgcagcgtatctacggtaccgcgttccatgataagaaagctctgcaagcgcatttaactcgccttgaagaagccgcaaaacgtgaccatcgtaaaatcggtaagcaacttgatctgttccatatgcagcaagaagcaccgggtatggtgttctggcaccacaatggttggtcaatcttccgtgatctggaaatctttattcgtcaaaaattgaacgaatacggttaccaagaagtaaaaggtccattgatgatggatcgcgtactttgggaacgttcaggtcactgggataaatacgctgatgcgatgttcaccacttcatcagaaaaccgtgaatacgcgatcaagccgatgaactgtcctggtcacatccagattttcaaccaaggtttgaaatcttaccgtgatctgccattgcgcatggctgagtttggttcctgtcatcgtaacgagccatcaggttcactacacggtatcatgcgtgtgcgtggctttactcaagatgacgcgcatatcttctgtactgaagatcaaattcaacaagaagtgacttcgtgcatcaagatggtgtatgacacttacacgacttttggcttccaaaatatcgtggtgaagttgtctactcgccctgaaaagcgcgtgggtagcgatgaaatttgggacaaatcagaacaagcgctgatcgattctctgaaggcaatggacattccatttgaaattcaggaaggcgaaggtgcgttctatggtccgaaaattgagtttacactctacgactgtttagatcgtgcgtggcaatgtggtacagtgcagctcgatttcaacttgcctacacgtttaggtgccacttacgttggtgaaagcaatgaacgcttaattccggtgatgatccaccgtgcgattttgggttcacttgaacgctttatcggtattctgattgaagaatacgcaggattcttcccaacttggttggcgccagagcaggctgttgttgtaaatatcacggataaacaagccgactatgctcatgaagtcgctcaaaagctacaaaaatgtggcattcgagcaaaagcagacttgagaaatgagaaaataggctttaaaatccgcgaacacactttgaagcgtgttccgtacatgttggtttgtggcgaccaagagatggaagctggcgaaatcgcagtacgtacacgtaaaggtaaagatcttggtaaatttaaattggatgattttattgcacatatccaagctgagattgcaagccgtaagcttaatctggaggaataaactattaaaggcggaagacgtggccaagttccggtcaagcaaaaccagcaccgtttaaacggtgaaattcgtggcgttcgtgaagttcgtttaactggcgcagacggtgagtctgtaggtatcgtttcgatccaagaagcactggctacagcagaagaatctggtttggatctcgttgagatcagccctaacgccgagccaccagtctgtcgtgtgatggactatggcaagttcctctttgagaagagcaaggctacaaaagagcagaagaagaagcaaaagcagatccagattaaggaactcaaattccgtcctgggactgatgtgggagattatcaggtaaaactacgcaacctgatccgtttcctagaagaaggcaacaaagtgaaagtaactattcgcttccgtggccgagagatggctcaccaagacatcggtgtagacgttttgaatcgactgaaagaggacactgacgaattcgcagtggttgagtctttcccgaccaaaattgaagcacgccagatgatcatggtgttagcccctaaaaagaagtaattaacggcattacaagtaatgaacctagccgttgaaaggcggctgggttttattcgccctgattacactgttatttaactactacaatgcggagttattcatcatgcctaagatgaaaaacaacaaaggtgctgctaagcgtttcaagaaaactgctggtggtattaagtacaagcacgctactaaacgtcacattctgactaagcgtactactaagaacaagcgtcagctgcgtccaaacgccattctgcctaagtgcgaactggctgctgtagcacgtatgcttccatacgcttaattctttttagtttaatattcgtttagtttaggagagacataatgcctcgcgtaaaacgtggtgtacaagctcgtgcacgtcataagaaagttttaaaacaagctaaaggttactacggtgcacgttcacgtgtttatcgtgtagcgttccaagcagttattaaagctggtcaatacgcttaccgtgaccgtcgcgctaagaaacgtcaattccgtcaactgtggattgcacgtatcaacgcagcggctcgtcaaaatggtctatcttacagccgtttcatcaacggtctgaagaaagcatctatcgagatcgatcgtaagatccttgctgatatcgcagtattcgacaaagcagcattcgctgttctggttgaaaaggcgaaaggcgctctgtaatagcgtgttattaagaaaggggagcatttatgctcccttttttctatctgtgaaatctcatgatttcgcaaagaacccatgctaaagacgggataatgggcttaaaacaccgcttgcacctctatcaagaacatgagtgtaaatctgtgtcgtttttacatcggtatgtcctagttgctcttgtacggtacgtatatcagcccccacttcaagcaaatgggttgcaaatgaatgtctgagagtgtggcaagtcacggtcttttcaatccccgcttcttgagccgatcttctcaccgctttttgtagtactgtttcgttcatatgatggcggcgcatcacatcggattccggatctagagataactgaaaagacggaaaaagatagtgccaacgaaactcataaggtgcatttggatacttttcttttaaggctgtgggcagccaaaccccgccgtagtttttttggtgcaagtctcgatcgtaatagcgttttgctagcgcaatttgctctttaagatgcggatagagttcttttgctaacgtgaccgtgcgatttttaccccccttaccttgccagattctgattgcaccataatcaaaatcgatatcttggactctcaagcgcatacactccatcaaccttaaccccgaaccgtagagtaacttgatgggaagttgatgcttaggatcgacaatttcaagtaaacgtcgaatctcatctctagtcagtacaaccggtaactttcgttctagttgcgagcgttgaaagcggatctcaagagaaaggggtgtttttagaatttctttgtatagaaaactgagtgagttcaaggctagtgattgagtctttgtggccactttaccttgcacggctaagtaggttaaaaattcttcgacctctttatctcccattaagctagggtgctttttattatgaaaatggatgtaacgagtgatccaatgaaggtaagcttctatggttttttttgcatagtatcgagtttgcataaattcgcgaacacttaacaaaaactgggatttcatatagttctcactgaatatttaactggttatttgtacagtatttgttggttgtttttatgtcaagaggctatacagacatcagcaatctataagctgagatttttgaatggtgtgatgctcaacatactgatttagaaggttgttatggtagtatgcacccagtggtctattaattagatagcggtagcctacctgttggaaaggtaagaagctgtctagaaagcgttaggctaatcagggagataaagatgtcactttgggttttggttccgctttcatttttccagcttggagtaggtagcattattggttttgggcttatatttctctcaggtatagatgctttctgagttcaacaataatgtttgtgtagcgctatggtttctatatgtcttttcggtgttcacgagtttcggactagtaatttatttttacttaattgatagccaagcatcgtattatctatggtatttaacgcaatgggtggtattggccgttcttgtcggttactggcgaatagcgagcgtaaaattagcctaacaaacagttcaagagggattcacaacgcgtggcatttttactatgcgttggttttagtgtttaaggcggtatgcagcggcttcggtattgcgttgttcaccccttaactgggcgttatgtggtcggagaaaaattatgaatccatcagcggttcttgttcatgtcccagatgtagcgaaagggcttgaatggtacaagaaagcttttccagaagccgttccggtttaccatcatgactttgacttcacagcgcttgacctaaatggtttctcattagaaatagtccaagcagacaaaaaagttggtgctggtaaaagtggtacagttgtttactggtcagtagataatttatgtgttgctctggctaattttgaagagctaggtgcgagtcttttcgtggaccaatggaaattgaagatgggctttcaatgtgccaagttgaggacccatttggaaacttaataggactacgtgggaaaaccacataacaaattgttcaagagggattcgcaacgcgtggcatttttactatgcgttggttttagtgtttaaggcggtatgcggcggcatcggtattgcgttgctcaccccttaacaaggcgttagttgccaacgagaaaaaagtacctaaagcagaatacttagggctaatgtccgtgtgtttttggctaggttttcgtatttcaatttctagttattaggtgttgtgaaaattgttctttggttccttgcgcgatttgggctttctgtttcagaggctgttagcttgttgaaagcctgctctgctgcattgtcgttccaaaaggtttgtttggtgttcaaagtccgttttctacggcgttgtaaattccaagtggtttcagtgacaggcgctttgaaactgcgcctgatttgagtttcttaatacacgtaaagctcgtgttggcaaagcggcaatccacttcaaatgaaagtgttaggtctggcaactaacaaagcattcaagagggattcacaacgcttggcagttttggtttgaatcagctttagtgtttactgcacaatagcttaggttgggtggtggcgttgttcaccccttaatgcggcgttagtttctatcaagaaaaatcatcaaaagctcaggttcaacgttttgaaaaatcagctttcaagttgtccgacttggtttttgagtttcaggctgatgttgcattggtagaaagtgttggaagttcaacagtttcaaaattgctgaaaatcagcaagcctcgaagcttcaatgttgttggattttccacacggtcagtttggtttcacaaatagctgcatcatcgctgtgatctggctttctttgtcgccgactcttaaccgaggccaacttaaccttgatcgttttaagttttggctgccaacttcacagcttttggtgttggacgtgtgcttgttcgatgcatttgcgtaaaatgactttcaagcaaatgtgttaaaaaagtcattgctaaacaataggctacgaaactaacaaacgcctcaagagggactgtcaacgcgcggcgtttccagtcccattgagccgcggtggtttcggtggtttgtgtttgggtttggttgttatgcgttgtcagccccttaggcgggcgttaggtgttcatcagctatgtgaaccaaaagttgagcgtgaacgtaaaaccgattttcgaaacttcggttatttgagatggaactgaatacggcaatcgagtcaagaattatagaaatggcatgggaagaccgcaccccattcgaagcaatcaagcatcaatttggtctgaacgaagctgaagtgattaagtttatgcgcagtcgactcaaacctagtagttttaaattatggcgtggtcgtgtttcgggccgtaacacaaaacatgcgaagttgcgcagctcagaaattagtagaggctactgcccaacccagtacaagcatcgctaactggcacacacctaacaaactgcttaagagggattcgcaatgcgtggcattttcagcatgcggtgggttttgtgattaaggcggcgtgcggtagctttagcagtgcattgctcaccccttagcagggcgttagagctttattggagctaactatgaaaaatccgacagtagagaatctcaaagttttgacccaagaattcttttcattgcattggaatgccgtacttttaggctcggattatcctgagtggtcagatatctatgagtttactggttctatgcccaatcatgataaacagggtgtttatgcttttgttaaaaatggagtggttacatatataggcgtcggtgcatcatctaatggaacaggccgttatgcagggcatggtttagggaagcggtttcaatcatattcaaaagtagtggatggtcgacacgtaccaaccgatcctaggcttgttgatgctggtgcaatgattactatcggtttcaaaccagagcagtcgtacttagcttatgcacttgaaatgtttcttattggcaaaatgagtacagaacacaacataaatcgtccgagtaaataaagctctaacaaacgcctcaagagggactgtcaacgcatggcgtttccagtcccaatgagccgcggtggttgcagttgttgtgacggagtttagtagtatgcgttgccagccccttaggcgggcgttatgtgcttttaggaaaatttaaaaatgaacttctttacgtctccattttctgggattcccttagatcagcaagtaacaaatccgaacattattgtgggaaaacacagttattattctggttattatcacgggcacagtttcgatgattgtgtgcgatatttacatccagaaagagatgacgttgataagttagtcatagggagtttttgttctataggctctggtgctgtatttatgatggccggtaatcaagggcatcgcagtgattggataagtacattcccatttttctatcaggataatgataattttgcagatgcacgcgatggttttacgcgttcaggagacacaattattggtcatgatgtgtggattggcactgaggctatgataatgcctggggttaaaattggacatggagcgataatcgccagtcgttcagtagtgactaaggatgttgcaccttatgaagtggtcggttcaaatcctgctaaacatatcaagtttagattttctgatgtggaaatagcgatgttacttgaaatggcatggtggaattggccagaatcgtggttgaaagagagtatgcagtctctgtgttcatcagacattgaagggctttatctcaattggcagtcaaaagcacgcacataacaaacgcctcaagagggactgtcaacgcgtagcgtttccagtcccattgagccgcggtggttgcagttgttgtgtttgagtttagtgttatgcgttgccagccccttagtcgggcgttatgcattacatcaaattcagcgttaaaaggatgaataatgagcgttcaaaaagtagttgttattactggcggtagccgagggattggtgcggcgacagcaaaactttttgctcaaaacggtttttccgtatgcataaattacaaatctaatgctgaggctgctaatactctcgttgaagaaatcaaagcgttaggtggtcattgtattgcggttcaagctgacgtttccaaagaaagtgatgttgttaaactgtttgaaaccgttgaccaagagcttggtgttgtttctgttcttgtcaacaatgctggtatcttaaagaagcagatgcgcttagacgaaatgagtgcagagaggattaactcaattctcatcaacaatgtgacaggttatttcttgtgttgtcgtgaaacagtgaaacgaatgtcaactcgtcatggtggtttcggtggtgtcatagttaatgtttcttcgggagccgctcgaacaggttcaccgaatgaatacatcgattatgcagcgtcaaaaggtgcaattgacacgttaacaaaaggtctgtcgttggaagttgccgcggaaggtatcagagttaactgtgttcgcccaggattgatttataccgatatgcacgctgacggtggagagcctgaccgtatagaacgactcaaaaataaaatcccaatgcaacgtggtggtttgcctgatgaagtcgctgaggcaatttattggttatcgtctgaaaaatcatcattttccacaggtaactttctggatttagccggtggtttgtaatgcataacaaacgcctcaagagggactgtcaacgcgcggcgtttccagtcccattgagccgcggtggtttcggttgttgtgtttgggtttggttgttatgcgttgccagccccttaggcgggcgttagtttctctcaggaaaaatcatcaaaaattcacgcacaaggttctaaaaaatcagcttttagcgttcatgtttcacaattgggcttttgagtttttgacgatgctgattcggttgaaagcgctgaaagttcagctatttcaaagttgctgaaagccaacaagtttcgatgcttcaatgctgttggatgttcaacacggtcagtttggtttcataaaaggcggcatcatcgctgtgatctggttttctttgtcgcggactattaactgtggccaacttaaccttgaatgctttgagttttggctgccaacttcacagcttttggtgttggacgtgtgtttgtttgatgcatttgcgtaaatgatcttcaaacaaatgtgttaaaaagtcattgttaaacaatgggctacgaaactaacaaacgcctcaagagggactgtcaacgcgcggcgtttccagtcccgttgagccgcagtggttgcagttgttgtgtttgagtttagtggtgatgcgttgtcagccccttaggcgggcgttatgcgacctaggaaaaaggagtttcgagtggaaaaaataattgatgaattagttgcgcagggttatgaagtatctggtagcagttcaagtattcgagtgaatatgggtgcattaacgggcaaagccattattcgtaaaagtgtctattcaaatacttttgtagtgtcgactcatacttggactcaacttatagctttgacattggtattttcttcaattctatcgtcgattttcagtcagtggggacagcccgagctaagtggtgcaatgtggtttagtttttcagtcggcatccccgttgtgataactggttttgtatcggcaattattgcggaaattcagttacaacctattcgtcagatcgtacgaatggtaaattcaaagctatcaccaccagtcgcataacaaacgcctcaagagggactgtcaacgcgtagcgtttccagtcccattgagccgcggtggtttcggttgttgtgtttgagtttagtggtaatgcgttgccagccccttaggcgggcgttagcttcttaaaggctagaatcatcaaaatctaagctcatttgttgtgaaaattcagctttaagcgttcaagtcgcactatttggcttttgagttttgcctgatgctgatttggtcgaacgtgttgaatgttcagcagttttcaagtcgctgaaacctatcaagcttcgatgcttcagtgttgttggacgttcagcgcggtcagcttagttttacaaaatacagcatcatcactgtgatctggctttctttgtcgcggattcttaaccgtggccaacttagccttgagtgttttgagttttggcagccaacttcacagcttttggtgttggacgtgtgtttgcttgatgcttttgcgtaaaatcactttcaagcaaaggtgtttaaaagttattttgaaacaataggctacgaagctaacaaacgcctcaagagggactgtcaacgcgcggcgtttccagtcccaatgagccgcggtggttgcagttgttgtgtttgagtttagtggtaatgcgttgtcagccccttaggcgggcgttagcttcttaaaggctagaatcctcaaaatctgggtttaattgtcctgaaaattcagcttttagtgctcaagtttcacaatttggctttcgagtttttttgatgctgatttggtcgaacgtgttgaaagttcagtggtttcaaagtcgctgaaaaccatcaaacctcgatgcttcaatgttgttggatgctcaactcggaaagtttggtttcacaaaaggctgcatcatcgctgaaagtgttttttctttgtcgaggactcttaaccgtggccaacttagccttgagcgttttgagttttggcagccaacttcacagcttttggcgttggacgtgtgtttgagagatgcttttgcataaaatgcatttcaagcaaaagtgttagaaagccattgttaaacaataggctacgaagctaacaaacgcctcaagagggactgtcaacgcgtggcgtttccagtcccattgaaccgcggtggttacggttgttgtgattgagtttagtggtatgcgttgccagccccttaggcgggcgttagctacaaggagaatttatggtatctcgacatataccagaacgtctaaaaaagaaaatatatcaagaagctaatatgacatgccccaactgcggtgagcgagatgtatccacgtttgaaatacatcatatccagccctttgtagatgtaaaaaaacacgaagaacgcaatctgatactactttgtagtaattgccattctaaggctacagttggtgagctaactgaaattgaagtgttgaggttaaaggtagggctaattagtagttcttccggccaaagcaaagaaactatgccttcaaatgttatcactttggattcggttaaaaatcacggtgtaattgcaaatcaggttactttgaataattcaccagcgaaagtagttctgttaccagcagttggctctattgcaagcagcctcaaacatcaaaactacataaaatatttaattgataaataccatgcttacaaaattgtagaagttggtaagtcaaatatgaagtacccagtgttctacaatgcgctcaaacgaaaatttggagctaaatgggacatggttccaattgatagattcttggaattaagtacatacattcaagatcggatagagaaaacagtccttggtaaaaaattaaaggctcaagggaaaaaatcatattcgacatttgaagagtatctggccaaaaattgtagctaacaaacgcctcaagagggactgtcaacgcgtggcgtttccagtcccattgagccgcggtggttgcagtttttgtgtttgagttttgtggtaatgcgttgccagccccttaggcgggcgttataagccaaagttagttagtcaaaaagtaacaagagaaaaatatgtacgatagtgaagtaattgagtatgcaaaagagcaagagaacataatctccaagttggagtaccgagtatacaaacacgacgatggtcgttcggtgaatcgtcaagatttgatgcgtgattatgcaagagttttatactcatcatcttttcgacgtctacaaggtaagatgcaactacttggtgtggacgccagtaagttcaatcgaaatcgtctaactcatagcttagaggtagcacaaatagctcgctcaatcgcttatgatttagagcttaatcatacggttgtagctgaaacagcatcacttgcacacgatattggtaatcctccttttggacattatggtgaagttgtacttaatgatttaagtttggcttgtggcggttacgagggtaatgctcaagcatttcgcattttacgcactttagaaaagaaacattatgcgtatccagggcttaacctgaatgtacgtactctaatggccattactaagtacttctttaacaagcaccaaaacaataaaaaattcttatacgacgcagactatgaatttctaaaaactgagctcgatagtaagggggtcactgttaccaagagtatcgacgctgaaataatggatttagcggacgaaattgcttatgcagcacatgacttagaagatgcactaagctttggcatgatcagcttaggtgaaatagttcatgagtttagcattagcgacaagtttaaagatgcatacccaacgatgactgatattgctaaagaggcacaaaatgtcgctatgaaagccagtcgaagtggtacatctgaagagtatgcaattgttctgaagaaagaactgacgtcaatgatagttaatattctatgctcagatattggtttggttgatggttgtttgggctacaaacgacatgcaaaattagctgaaggtctaaaaaaactgttgtttaaggcaatactccgcaaaaaagatattcaactttatgagcgccgaggagagcagattattcgtggtttatttgaggtgtattctgacgaaaaatacaataaagataatatgttgttaccaccagaactgcgtgcaattaatgactgtaaaacccgtctagttacggattacatctctggtatgatggattcatatgccgcacaggagtatgagaagtactttggtaagggcagtgcagataagctttatttcaaatagagttggcttataacaaacggctcaagagggactgtcaacgcgtggcgtttccagtcccaatgaactgcggcgtttacggttgctgtgtttgagtttagtgttaatgcgttgccagccccttagccgggcgttatatgcttccatcaattaggtagttcaaaatgagtagaaaaaaatttatggagtctgttggtgctacttgcagcaactggaattggagctggtcgttcgttaatcacgaagaaaggtttgtggtttttggtcattgggatgtccacaaagacggcctaatttttgatgaaagttggaaagggccaggaagaaagcagtctctagagcatatatcgctgattcaaaataatggttatcgcctaaaaacctttcccatgcagtatgaccaaactgaaacaggaacagccaaaattaaaagttttgattggattcttgaggagaaacatttagccggagtcgatgggctttggtatgcattaaattactctgaaagcgttgatataacttcaatagaagaagtcgttcatccagaaacgtatattgaaggggcaacaaaagagatctcggtaaatgcttacgaacgtaacccagatgctagagccaaatgtatattgcactatggatgtaaatgttatgtctgtaaatttgactttcaggaagtttatggagacataggaaaaggctttattcatgtgcatcatgaagtttcgcttgctgagatcaaaaaagagtattccgtggatcctattaaagacctaaagccattgtgccctaactgtcatgggataattcataggacacatcctccaatatctgttgattctttaataaacttgttacgttctagaaactaacacgcatataacaaacgcctcaagagggactgtcaacgcgtggcgtttccagtcccaatgagccgcggtggttgcagctgttgtgtttaggtttggttgttatgcgtttccagccccttaggcgggcgttatgtggcaatccagaaagggagcccaaatgaagaaattcttagcattcatagtgttgtccaatctaattgcagtagcatgtgtttatctatttgagttcagttttggatacttaaaaattgcttttctcaaagattatgcgttttattcgatgcttattcttctggtgctaggggcatttttttccttctctggacatggtgttggttacagcgatccaagtaatgttgcgggagttgcagcgagtagcttgatcgacaacgattcagctaaaaagaccgtggttacaagactggagagcattggcttagggcatagatttttaatcgtcagtctgttgccattgattttttgcttcatcttatagctgtgctcggccacataacaaacgcctcaagagggactgtcaacgcgtggcgtttccagtcccattgagccgcggtggttgcagttgttgtgtttgagtttagtggtagtgcgttgtcagccccttaggcgggcgttagtttgcaatcggagactaagaaacaaagcgtgactgtttgagatgcttttggggcagttgtgattgccctaataccgcaacaatgagaatgaagtttgcttctttggtgtaataagccatgtgtttccccactggaaagtaaaaaccattttggtaaatatcttcacagctttttcctagtcctgggttatccgcaagagtttggaaacctgaaagcaaggtcgacttatatttttgccactgcgcttcagcgaaattttcaatggtgtagtgtttaatcttgagtaagtgctcttgggctaattggctgagcttatattgtttattttgcatattgaggtaaacgctcaatcaaagggtgtttagaaaagtggcaccatcaacggttttgccactatctaagtctttctgagcagactcaaagcagtgtttgagataatcgagtttcattgcttcaagttcttcaaagtccttaatggacatgacaacgacagtattcttactgtttttgctgatgatgacaggttcgcgttgtgcgcttagaagaagttcaccaaaatttcgtttagcatcatttgctgttagtgtgtgcataactaggctccttactcaaagtttgaaagagtatagcttatgatgcgaagtgtttaaaataattaaatcgcacgatttgggcgaaagcaaactaacaaacgcctcaagagggactgtcaacgcgtggcgtttccagtcccattgagccgcggtggtttcggttgttgtgtttgagtttagtggtaatgcgttgccagccccttaggcgggcgttatgtgtaattcagtcaaagagaactacatatgaatcatctagcgatggctgtcgtaataaagaataaccttgttttggtacaaaaacggttcagaaaaaatactgggatgatttttgagtttccgggtggttctattgatgccggtgagtcaggagagcaagcagctattcgtgaactctgggaggaaactgggctgagaaatttaaagctcattggcactcataagtccatcaacgagaatggcggcgatatttatcatgttgttttcagcgcttcgatggacgcagagcctaaagagatcgaaccttatcgacaacaaacgttttattggtttgaggcttcccaaattccactgaatgacttttatagtgctgatgtaaatttcatcaaggaacatttgggcagttacacataacaaacgcctcaagagggactgtcaacgcgtggcgtttccagtcccattgagccgcggtggttgcagttgttgtgtttgagtttggtggtatgcgttgccagccccttagacgggcgttatgtgtttttctgaaaaattttcacagctctgcgcttataattcagacgtgaggtgcactatgtctgaaaatcaaaaagttaaagagctgaaccaattgaaacttgttcatataaaagtccttgtgttcgtcattgttgtttagatgacaaagacatctgcataggttgtggtaggactcttgatgagatatgtcgttggagtagtgcaacaaatagcgaaaaacaagagatattaatcaatagcttagctagagttcagagccgaaatatatcgatatgaagcatcttagtcttgtgtatatgatggctttttatcgaatgctgtttggcataaatgcctttcgctacccctttaaatggaagggtgggcatcagaaacacacacataacaaacgcctcaagagggactgtcaacgcgcggcgtttccagtcccattgagccgaagtggttgcagttgttgcgtttgagtttagtgttatgcgttgccagccccttaggcgggcgttatgtgtcctcagtggaaataagacgaaactatgttcatagaatcattaaaaatcaggcttcgttcacttgaagtggaggatgcagaatccttttatcagtggtctggtgatagggaagtgacacaattcagcttatctgcttatgcctatccccaatctcgctcagatatcgctaagtggctgtcagagattaactcaagttcaaagacgatttcttttggtatcgagtgtaaagaaagccaaaagctgattggttatgctggtatttcggggattagctcacttaaccgaagtggtgagtattttatcctcattggtgataaagcattttggggcaaggggctaggaacagaagttacgcgtttagtcactaattatggattccgagagcttggcttacatcgaatagaattgaccgcatattgtgacaacgtagcggcagtcaaagcgtatgaaaatgcaggctatcagcatgaaggtatcaaaagagaatcgggctatcgcaatggccgattcatggacaaagtccaaatgtccgttttatcgcgagagtggccggccacataacaaacgcctcaagagggactgtcaacgcgcggcgtttccagtcccaatgagccgcggtggtttcggttgttgaggttgagtttggtgttaatgcgttgccagccccttaggcgggcgttaggtatttggagacatcatgagagctatctttttgattctttgcgctgttttattgaatggctgcttgggcatgcccgaatcagtaaaaccggtgtcggattttgaactgaacaactatttaggcaaatggtacgaggttgctcgactcgatcactcctttgaaagaggtttaagtcaggttactgcggaataccgtgttcgaaatgatggtggtatttcggttcttaatcgtggttattctgaagagaaaggtgagtggaaggaagcggagggcaaagcttactttgtgaatggctcaacagacggctatctgaaggtttcattttttggtccgttttatggctcctacgtagtgtttgagttagaccgtgaaaactacagttatgcttttgtgtcagggccgaatacagaatatctgtggttactttcaagaacgccgactgtagaacgaggcattctggacaagttcatagaaatgtcgaaagagcgtggttttgatacaaatcggctcatttacgttcagcagcaataaatacctaacaaacgcctcaagagggactgtcaacgcgtggcgttttcagtcccattgagccgaagtggttacggttgttgtgtttgagtttagtgttatgcgttgccagccccttaggcgggcgttagtttgctaaaggtagtggataactagcctaagcttgctctgatatcagcaatggtgatgaagagtttgttttcggcatcttgaaacgcttgaaacccatagcgctcatagaaatgttttgcaccatctttggcatcaacaatgacaacagggaacgctacactgtcactggctgcgagtagctttctgagagcgtcaatgagtagccactcaccaaaaccttttcctttgtatctatcgtcgacagctaaacgagcaatgagccctccagaggttgaggattggtgcttcttttgtaacttgtcgggcaaggctttcaaatcaatgggcgtcatagtcagagtgtaaaagccgatgatataagcactgttattgtcatcttccaaaacgaaggttctggtgttgtcttttttggcttgctgactcgccattacttttaagtaattgttgagtgcttcagtgccacaattgaaacggttcctatcgtgcttatctttatcgagaagtaccgtattcatcattgagttttgctctcataacgttcggatgccaatttgagctttgcatttactacagctggattatcaagagcttccatcagcaatacggcatcagcttggctaagctttagagcttgctcacgttcaatgacttgttttgctttttcgattgctgcattcaaaacaaatgagttaatactagacataccagcaagagcagcagccttagcgagtaaatcttgagtatcgacatcaactctagcggtgatgcgaggcaaagtcgttgccatagttttatctcctgttgtgtcaaactgtcacatgggcattatggcgttaaagtgttcaacaagcaatctttgtgtcactttggcacgcaaactaacaagcgcctcaagagggactgtcaacgcgcggcgtttccagtcccaatgagccgcggtggttgcagttgttgtgtttgagtttagtggtatgcgttgtcagccccttaggcgggcgttagtttctctcaatcaaaaatcatcaaaatctaagctcatttgcattaaacatgcagcttttagtatccaaatttcacaagttggcttttgagttttgcttgatgctgatttggcagaaagcgttgaaaacgcagtagtttcaaagtcgccgcaagccaacaagtcaagatgcttcaacgttgttgggtgttcagcgcggtcagcttagtctcacaaaaggcagcatcatcgctgtgatctggttttctttgtcgcggactcttaaccgtggccaacctaaccttgatcgttttaagttttggtagcttgcttcacagcttttggtgttggacgtgtgcttgcaagatgcatttgcgtaaaatgcttttcaagtaaaggtgttaaaaaaccattggtaaacaatgggctacgaaactaacaaacgcctcaagagggactgtcaacgcgtggcgtttccagtcccattgagccgcggtggttatggttgttgtgtttgagtttagtggtagtgcgttgccagccccttaggcgggcgttagccatacgaggtgagtatgtcggaatacaaattaacagaagaaatcattaagttgtctcaatcgcagctatgggatgtcgcaaaatctgaatggactctgcacgaaatatacgaagctaatgagccagagcgttgtttatgtgggcactttcctatcattgaaatttgtaatcttaagaacaagatcaactctaactatgcgattgttggaaactgctgcgttaaaaagttcattggtttaccttcagataaaattttccaagcaataaagcgggttagaaaagatgatcaaaaatcattaaatgcagaggccatatttcatgcttacgacaaaggttggattaatgattgggaaaaaagcttttacttagacgttatgagaaagcgtaaacttacgtcgagtcaacttaacaaaaaaattgaaatcaacaataagttagcaaacaaaatgaagcgtacataagtatgagagtgtaaaaatatctgtgtaagtggcattcttaacctgttgaaaggaaatacagaatgccaatatcagacaaacttatcgatcagcttctagaaggctatgattcccccgatgacatcctcggcgaagccggattactaaaacagctcaccaaaaaggttgccgagcgagcgttgaacgccgagatggagcaacatcttggttacgctaaacatgcaccggaaggcaggaattccggcaactccagaaatggtaaatccagtaaaaaacttcgctcagttcacggcgaaatagagctggatatccctcgtgatcgcaatggtagctttgaacccaagctcattaaaaagggcgagaagcagctcaacggttttgatgaccggattatctcgttgtatgcgcgaggtatgacaacccgtgatattcaggcgcacttcgaggaatcgtatggtgtagaagtctctccaacctttatctctcaagttaccaatgaagtgatggatgaggtaaagcaatggcagcaacgtccgctggatgcattatatcccgtcgtttacctggattgtttggtggtacgtagccgcgattccggtgcggtacagaacaaatcggtttacctggcgctcggtatcaacactgatggtgaaaaggagctgttaggcttgtggatggctcagaccgaaggcgctaagttctggttgtctgtgatgaacgaacttaagaaccgtggcgtacaggatatcttcattgcttgctgcgatggtctgaaaggcttcccggaagccatcgaggcggtttacccgaaaacacaggtgcaactgtgtatcgtacatcaaattcgtcactcgctgcgctatgttaactggaaacaacgtaaggttattgccgctgaccttaaacgaatttacggcgcagccacactggccgaagcggaactggctctggcagagttcgctgaaaaatgggatgaccaacacccaacgattagcctgtcatggcgtaataactgggcacgtctaagtgtcttcttcgactatccaccggaaatccgtaaggtcatttacaccacgaatgccatcgaatccctgaacgcgagcctgcgtaaaatcaccaagaccagacggtcgttcccgactgacgattcagtgatgaaaatactgtatctggcgcttcaccagatatcgaagaagtggacaatgccaataagagattggaaagcggccatgagtcagtttatgattatgaatagtgaccgtgtatcaatatgataaacagccacttacacagaagatcttacagtctcataagtatggctaacaaacgcctcaagagggactgtcaacgcgtagcgtttccagtcccattgagccgcggtggtttcggttgttgtgattgagttttgtgttaatgcgttgccagccccttaggcgggcgttatgtgcacaattgactcattagaataaatcactatgtgaaccaatgcgcgctagttgtagttgatcgttaaaaactcgatagattaacactaggtcgggtttaatgtggcagtctcgaaatccaacccaatttccagttaacggatggtcaacattcttgggttcaagcttttcgccgcgttgcagcttagaaataacattgccgacttcaatgatgtctgaaatcggcatcttagttatctttttgaaatctttcttaaactgtgtggagtattcgagtttatacatgcttaactttgccttcagtaagctcattcagcatagcttcaacggattcagctttatgtccttttccttcaacgagctcttgaattgcagatgcagtaacctcattaggctgtggaactcgcagctcaaaagggattccaccatgattaataaccgcttttgcaaataactttatggcctgtgatgtacttagacccatctcatcgcagacgtttgtgaacgcaattttcgtgtcgtggtcaatgcgcgtgctcagcatttctgttctcataaatagtacctttgtgcatgcaatgtattacatagttagacaaagtatatgtgcacataacaaacggttcaagagggacagccaacgcgcggcatttttactatgcgttggtctttgtggtttacggtgttatgcgttaagttgtcagtggcgttggctgccccttaaccgggcgttatgcttaatccataaaaatcagtaggttgtgtttgtcgattcccttggcatttcgttcatgttttgtcggcaattcaatattgtttttcgctgcctaatgaagtggcaatgtatctggcgctgaaaaatcgcagtgattgcctcattgtgttgttgagtctgcgtgaggttagtattgttggctcaagtcgctttgagcagtttggtgcctttacttacaggcttaaagtctgtcggcaattaagtattgttttgcgctgcctaatgaaacggcaatctgtctgtcgctgtaaatttcagtgtcattgcctcattgagttgtcgtgcccatgcgtggtgagtgagtttgtcggagaggttttccacattgacctagttgctaagtgaaagcctgcattggtcagctcataggtaaaagttgagccagttctaattcaagataattcgaagtttggtcaatgatttcagttggttatcattgatttgattcaaatgtaaagtgttgaagcttaagcataacaaacgcctcaagagggactgtcaacgcgtagcgtttccagtcccattgagccgcagtggttacggttgttgtgattgagtttagtggtaatgtgttgccagccccttaggcgggcgttatgcttaatccataaaaatcagcaggttgtaattgtcgatttctttggcatttcattcaggttttgtcggcaattcaatattgtttttcgctgcctaatgaagcggcaatgtatctggtgctgaaaattcagtgttattgcctcattgagttgtcgcgcccatgcgtggtgagtgagtttgtcggagaggttttcacattggcctagttgctaaatgaaagcctgcattggtcagttcataagtaaaagttgagccagttctaattcaaggaaattcgatgtttggtcaataatttcagtgagttactcttgagttggctcaaatgtaaagtgttgaagcttaagcataacaaacgcctcaagagggactgtcaacgcgtggcgtttccagtcccattgagccgcggtggttgcagttgttgtgtttgagtttagtgttatgcgttgtcagccccttaggcgggcgttatgtgttttcctagaaaatggagtttctgatgaaaattagtcaccttgatcatttggttctgactgttgcagatattccaacaacaacgaacttttatgaaaaagtgttgggcatgaaagctgttagttttggcgctggtcggattgctctagagtttggtcaccagaagatcaatcttcatcaactcggtaatgagtttgaacctaaagcccaaaatgtcagagttgggagcgcagatttgtgctttattaccgacacagttctgtctgatgcgatgaagcatgtggagaatcaaggtgtgactatcatggaggggcctgtaaaacgtacaggtgcacaaggtgcaatcacatcattctatttcagagaccctgatgggaatcttattgaagtatcaacgtattcaaacacataacaaacgcctcaagagggactgtcaacgcgtagcgtttccagtcccattgagccgcggtggtttcggttgtggtgtttgagtttagtggtcatgcgttgccagccccttaggcgggcgttaggtgttcatcagctatgtgaaccaaaagttgagcgtgaacgtaaaaccgattttcgaaacttcggttatttgagatggaactgaatacggcaatcgagtcaagaattatagaaatggcatgggaagaccgcaccccattcgaagcaatcaagcatcaatttggtctgaacgaagctgaagtgattaagtttatgcgcagtcgactcaaacctagtagttttaaattatggcgtggtcgtgtttcgggccgtaacacaaaacatgcgaagttgcgcagctcagaaattagtagaggctactgcccaacccagtacaagcatcgctaactggcacacacctaacaaactgcttaagagggattcgcaatgcgtggcattttcagcatgcggtgggttttgtgattaaggcggcgtgcggtagctttagcagtgcattgctcaccccttagcagggcgttagctctctttcaaagttcatcgtggagtccaaaaagccaagctggatttgaaattttttttagcgatatttcaggagatagtatgagcacaaggttttgtgaaaagtgtgggaagaacactgaacataaagaggtgatgaagcaaaagccatcgaagtacggtaagtcaaaaagagagcagttcaaggcatttctagatggattttttagtagttcggcagcctctttacctggtggcgtttcgctagaattaacagatagatatgttgtttgtgctatctgcggcagcgcaactttagaaaatcatggtgaacaatttcagtaacctattcgctaagctgagagctaacaaacgcctcaagagggactgtcaacgcgtggcgtttccagtcccattgagccgcggtggttacggctgttgtgtttgagtttagtggttatgcgttgccagccccttaggcgggcgttatgcttaatccataaaaatcagtagtttgtggttgtcgattcctttggcatttcgttcatgttttgtcggcaattcaatattgtttttcgctgtctaatgaagtggcaatgtattggcgctgaaaaatcgcagtgattgcctcattgtgttgttgagtctgcgtgaggttagtattgttggctcaagtcgctttgaacagtttggtgcctttacttacaggcttaaagtctgtcggcaattaagtattgttttgcgctgcttaatgaaacggcaatctgtctgtcgctgtaaatttcagtgtcattgcctcattgagttgtcgcgcccatgcgtggtgagttggtttgtcggagaaggtctccacattgacctagttgctaagtgaaagcctgcattggtcagctcataggtaaaagttgagcaagttctaattcaagataattcgaagtttggtcaatgatttcagtgagttattcttgagttggttcaaatataaagtgttgaagcttaagcataacaaacgcctcaagagggactgtcaacgcgtggcgtttccagtcccaatgagtctcggtggttacggttgttgtgtttgagtttagtggtaatgcgttgccagccccttaggcgggcgttagcttcttgaagcaagggttatcaaaatcttgagttcaatgctcttgaaaaatcagcttcatgctttgaaagttcacgaatcagcctttgcgtttcagtcggatatttaagtagcagaaagcgttgataattcaacaatttcaaagttgctgaaagccaacaagtctcgatgcttcaaagttgttcgatgttcaacactgccaacttggtttcacaaaaggctgcatcgtcgctgaaatcgcgctttttttgtcggaaattcggtaagtggccaactcaaccttgaacgctgtgagttttgacagctcacttcacagcttttggcgctggacgtgtgtttgcttgatgcttttgcgtaaaatgactttcaagcaaatgtgtttgaaaaatcattgctaaacaataggctacgaagctaacaaacgcctcaagagggactgtcaacgcgtggcgtttccagtcccattgagccgcggtggttatggttgttgtgattgagtttagttttatgcgttgccagccccttaggcgggcgttaggcaatatttcgtgagcttcggagggaaatcaatgtcagaacattcagcaatcgtgacttggaaacgtaaagattccgaagctttcactgataatcagtacagtcgtgctcacacttgggagttcgatggtggttcaaagatattagcttcagcatcacctcatgttgtaccagttcctctgtctgttgaagccaatgttgatccggaagaggcttttgttgcggcattatcaagctgtcatatgttggtttttttatctattgcagcaaagcaaagataccttgttgaaagttatacagacaatgcagttggtattttagggaagaacagcaaaggtaaaacctcagtaacaaaggttgtgctacgacctcaagtggtcttttcaggcacttccaagccaacgttacagcagctcgaaaagatgcatcatttggctcatgagaattgttttattgctaattcggttgaaacggaagtagtgactgaaattattgcctaacaaacgcctcaagagggactgtcaacgcgaggcgtttccagtcccattgagctgcggtggttacggttgttgtgtttgagtttggtgttatgcgttgccagccccttagccgggcgttaggtgatatatgttggtactaatacaattgatattaagtaaagttaaagagttttttaaagagtggatgccactaattgtatctattgcagcgctttatgtttcatataactcgtacaaggtttcagaaaatcaactgtctgttagtcgagtctctgtagagcctcacttctatgtagatgaaattccgcttattgatgaaaaaacaggctcagtgtatgagcgtgagcttaaagttttcaatataggctctcctgttgcaaacattaagaccacagtaagaacattctatgaagtcgatgattttgggcagataggcaaaaaacttattccactaaatggctactattatgcatccttcccaaccggcgagccggaaggacttattgcaacccacaaaggaaatgaaaacgcaacaaaggactttgatgcaacatttattcatttcagagggaactaccctaactacttgcaagtagagctgaagaacatagtttacattacctatatgtcctttgaaggtatagacaagcaagtttgtttcttaaattctacacagattgattgtgaacttgtttcttcctataagggattatttaatcaaagctatctggaacttgaaggtctaacatatcaaaagctagttgaggtatacgaaaagtttggaggataaatatcacctaacaagcgcttcaagagggacagccaacgcgcggcatttttactatgcgttggtttttgtgattacggtgttatgcagtaagttggtagtagcgttggctgccccttaagcgggcgttagccgtcatcaataaacaaagtttgcctaatgagtaaaaagggtgtagtttttactcatgattaaatttgaatttgatgaaaacaaaagcagaagtaatctcgaaaagcacggtattgattttcatacagctcaaggattgtggaatgattcagatcttatcgagatccctgctaacacgagtgatgagcccagatatttggttgtcggcttactaaacggtaagcattggtcaggagtaattacctaccgaggtacgaatatcaggatcatctcagttcggcgttcacggaaagcggaggtaagcctttatgaaagcgcatgaatttgatgccaagtttgaaagtgacgacgatgatatcgtaatggacttggatctatcgcaagctaaaagaccgatgcataagcaaaaacgagtcaatgtagattttccagcctggatgcttgagtccttggacagagaagcgagtcgtattggtgtaacacgtcaatcaatcattaaaatttggctggcagaaaggttagagagcgtgtctcatcattcaagtgtgagataaacggctaacaaagcatttaagagggactcacaacgcgtggcatttttgccatgcgtttgtttttgtgatgaatttgctatgcattgagtgcttttgtgcgttgttcgccccttaacgcggcgttatatttattggagattttggtgaaaataaagaatgtgttcgctattttactgatagtgtatctgataccaatagccgtatggtattttgtaatggttgttgttaatgattatgctttaagcacattaaattctgactggggagcgtttgggtcatttgttggcggtgtactatctcctatattttccttggtttctgttctttttgtaattaaatcaattaatgaaaataatacaaacaacaatattgaaattgaattaataaaaaaacaagatagaagaaactatcttattagtttaatagctatatttaacaataacatgctgtcaaatattgacagctatctaaatgcattcgatagacctattcaaattgctgataacaaatttcatatgtttactgatgaaagtgtaaaggtttctctaatgaagtatatgtctattaaggactctattaatgttaacaataagctaatttttgacatgattaataattttactgctaattgtgagatttcattcagcataatacttaaatatgytaattcaattgaaggtcttgatgaggtcaatgaatttatggatgtcgtagaagctgctttagataataattttattaatgcattgttaagttttaggctatatgagcaggcatgcggatggagtcaaaaatctccattgcttgatcagcttgtatctattaataataagacaagatataaatctgagtgggttgaaaggtatcaagaacaaattggtgctaaataaatataacaaacgcttcaagagggacagccaacgcgcggcatttttataatgcattggtttatgtggttactgtgttatgcggaatcttggtagtagcgttgtctgccccttaagcgggcgttagtttctatcaagaaaaatcatcaaaagctcaggttcaacgttttgaaaaatcagctttcaagttgtccgacttggttttgagtttcaggctgatgttgcattggtagaaagtgttggaagttcaacagtttcaaaattgctgaaaatcagcaagcctcgaagcttcaatgttgttggattttccacacggtcagtttggtttcacaaatagctgcatcatcgctgtgatctggctttctttgtcgccgactcttaaccgaggccaacttaaccttgatcgttttaagttttggctgccaacttcacagcttttggtgttggacgtgtgcttgttcgatgcatttgcgtaaaatgactttcaagcaaatgtgttaaaaaagtcattgctaaacaataggctacgaaactaacaaacgcctcaagagggactgtcaacgcgcggcgtttccagtcccattgagccgcggtggttcggtggttgtgtttgggtttggttgttatgcgttgtcagccccttaggcgggcgttattttgcttattcaaatcatggaggaaagcggtaagtgttatatgccaaagctttaagtattggagacgaaattggttttttctcaccatcttcaccggctacagcctttgctccaaatcgatttcaaagagcaaaagcttatcttaaggcacagggatttgagttagttgaaggttcgcttacgggaaaatctgattattaccgctcaggctcgattcgggagcgtgctgaagaattgaatcaacttattcgggatccgaatgtccgttgcatcatgcctaccattggaggcaataatagcaattcactgttgccgtatattgattatgaagccttaagaaacgatccaaagatcatcattggttattcagatgtcacagctttattgctcgggatctatgctcaaacaggacttatcacattttatggcccagccttagtcgcttcgtttggtgagtatcctccattggttgatgaaacctttcattcgtttatcgatctgttgtgttcagagacgaatcaatatcaatacactatgccctcgtcatggacagatattaagcacgattgggaaactcagcattcagctaagcccgtttatccgaatgaatggcagtttatcggtaaaggcaaagtgacaggcagaattattggcgggaacctcaacaccatggctgggatctggggtagtcgatacatgccagagattaaagttggcgatattttactcatagaggattctctgaaaggtatcgaaaatgtcgaacgttcttttgcacatctcgcagcttgtggcgtttttgagcgagtgagtgcgatcattttggggaagcatgagttatttgacaacaaaggtacagggagaacacctctggacgttttaatcgaagtattagcggataaaaatgtacctatattttatggttttgatagttgtcatacgcatccgatgctcgtcacaccattaggtgtgcgaggtacaatcgatttcgacaatcatacctttaagctagaagatcgttgggtaaaagcaaaataacaaacgcctcaagagggactgtcaacgcgtggcgtttccagtcccaatgagccgcggtggttgcagttcttgtgtttgagtttagtggcatgcgttgccagccccttaggcgggcgttatgcgctaattggaaaaattgacaggagttaacaatgaatcagcatggaaaactcaattatgtagaatttgcagcgaaagacttagagtcaacgaaagcgttcttttcaaaggtttttggctggagctttgttgactatggacctgaatatgcagcattttcaaatgaagggttagacggtggttttttcaaggctgagctttctagtcggactgaaaatggtggcgcattgttaattttctacagttcagacattgaagccactttagaaaaagtcgtgaaaaatggcggtcatatcatccgtcctatctttgagtttcctggtggttgtcgttttcattttacagagccaagtggtaatgaatttgctgtttggtctgaagcacgcgcataacaaacgcctcaagagggactgtcaacgcgtggcgtttccagtcccattgagccgaagtggttacggttgttgtggttgagtttagtggtagtgcgttgccagccccttaggcgggcgttatgcttaatccataaaaatcagcaggttgtgattgtcagttcctttggcatttcgttcaggttttgtcggcaattcaatattgtttgtcgctgcctaatgaagtggcaatgtgtctggcgttgtaaattctgagtgattgcctcattgggtttttgcgtccacgcgaggtgagttttgctctctcaagtcgctttgagcaatttggtgcctttacttatgggctgaaagtctgtcggcaattgagcattgtttttcgctgcctaatgaaacagcaatgtgtctgtcgctttaagtttcagcatcattgcctcattgagttgttgtgcctatgtgtggtgagtgagtttgtcggagagggtttccacattggcctagttgctaaatgaaagcctgcattggtcagttcataggtaaaagttgagccagttttagttcaagaaaattcgagttttggacaatgatttcagtgggttattcttgagttggttcaaatgtaaattgttgaagcttaagcataacaaacgcctcaagagggactgtcaacgcgtggcgtttccagtcccattgagccgcggtggttacggctgttgtgttttggtttagtgttatgcgttgccagccccttaggcgggcgttaggtgatataggcaaatatggaagaaacagattttctacaagaacttgcagatgagttatctgctttacctgatccgagctactggttctcaaagctaagagaaattgaggataaattgggtaaaaataagcgtgataccgtcgctatattagccaaaagggcgtggctcaagaagatatgcaattcgtcctatcccttacatcctgatgtgaaacgagatatagcgtataagcgttattttctatctgagagtgataatctgctcattttggcaacaatgattgctctgattgacggtgataactcagaagaacgttacaagaaatgtaaacaaaacattgagaaaaagtatggtgaagaagcttggctgagaatactcagaacggcgagaaagataaataatgtactatcgaactcaagctcaaatatacctacttcattgagtgtcatggctacacgaagtgtgactgtacaaggttgggtacaggatgaaaaactttcaaagttgcctaagcgcgtgtaatcacctaacaaacgcctcaagagggactgtcaacgcgtggcgtttccagtcccaatgagccgcggtggttgcagttgttgagtttgagtttagttgtaatgcgttgccagccccttaggcgggcgttatgtgttttcctagaaaatggagtttctgatgaaaattagtcaccttgatcatttggttctgactgttgcagatattccaacaacaacgaacttttatgaaaaagtgttgggcatgaaagctgttagttttggcgctggtcggattgctctagagtttggtcaccagaagatcaatcttcatcaactcggtaatgagtttgaacctaaagcccaaaatgtcagagttgggagcgcagatttgtgctttattaccgacacagttctgtctgatgcgatgaagcatgtggagaatcaaggtgtgactatcatggaggggcctgtaaaacgtacaggtgcacaaggtgcaatcacatcattctatttcagagaccctgatgggaatcttattgaagtatcaacgtattcaaacacataacaaacgcctcaagagggactgtcaacgcgtagcgtttccagtcccattgagccgcggtggtttcggttgtggtgtttgagtttagtggtcatgcgttgccagccccttaggcgggcgttaggcattaatcgttcgactatcaaatttagctgatacaatgctcttaatattcaaagtagtagagtttttaagtatggacataggcaagttaacgcgaaaagaactgatagaattaaatcataggatcgtagctcgtttggagcatctggatgaacttgaagttcaagccaaaaggcaagagttcatacttggttcgccggcgcagtttgtcgatgataaaggcactattcagctatgtgttgtcgttaagttcaataagaagtcagtatcagtgtcaacagcaaatggtgagcgttggaacattccagcagaacgaatactaccgttggcaaatgcctaacaaacgcctcaagagggactgtcaacgcgtggcgtttccagtcccaatgagtcgcggtggtttcggttgttgtggttgagtttagtggtagtgcgttgccagccccttaggcgggcgttaggtgttcatcagctatgtgaaccaaaagttgagcgtgaacgtaaaaccgattttcgaaacttcggttatttgagatggaactgaatacggcaatcgagtcaagaattatagaaatggcatgggaagaccgcaccccattcgaagcaatcaagcatcaatttggtctgaacgaagctgaagtgattaagtttatgcgcagtcgactcaaacctagtagttttaaattatggcgtggtcgtgtttcgggccgtaacacaaaacatgcgaagttgcgcagctcagaaattagtagaggctactgcccaacccagtacaagcatcgctaactggcacacacctaacaaactgcttaagagggattcgcaatgcgtggcattttcagcatgcggtgggttttgtgattaaggcggcgtgcggtagctttagcagtgcattgctcaccccttagcagggcgttaggtgtgttgcattcacagtttggctttatttttgttgatgcattctccctgattatgtataagtcgttttgaaaataacctttaacaccatgattacattagtttttgctaacctttaataacatggagaataaaggtggaaaaaagtaacgagaaagtacagttgctagtaaatgctattcggtttcgtaaaccctacacggctaatgattttcaagtaacagcatctgagctgaaagtgaaaaaagagagttatcacttaagtaaaatcaagagtattgaactgaagcgtcttggcttcaaagataacgtggttaaagtgacaacatacgccattttactgtcagcagcgacttgggcttttgtacctgagtttggtttttttgctctcctaattgctctgattttggctttggtttcgatgagaaagtatgagttgaaagtagagtttaaaggtacagatgaaacgggtgattactgggtatcaatagctcgttgttggacggaagatgaatttcatattctagagaatatttatactgaactgaaaagcagaatctagcacagaggctcgtcaattttggcgagcttttgagtttatggtcccgcacctaacaaacgcctcaagagggactgtcaacgcgcggcgtttccagtcccattgagccgcggtggttgcagttgttgtgtttgagtttagttgttatgcgttgccagccccttaggcgggcgttatgtgaattttgtgaacaacaaagagattggtaatggtaaattttactgctgggaagtggatttctgaaccgaaagtgagtgaagtcacttcagagtttgtgtcgataactaccgagccgaaaacagatttttggcaacgttcttattatggttttcgtaatgaaaatgctcctgcattattgattgactcaaaagacaatttcacatttaccgctaaggtaagttttgcttatcaacagctgtttgatcaatgtggattgatcatttatctcgataatgaaaattggtttaaagcttcgatagagtacgaaaatcaatcattttctagacttggtagtgtagttacaaatttagggtattcagattgggcaactaccgatatcccgcttcctaaagagatttggtatcgtttaagtcgtagagggccagattttcttatcgaatcctcgtttgatggcttggtttttaaccagatgcgtatctttcacttacatcggttgggagagactacgatagaaatgggtaaatgtaatccccctttaccgacacaaaaagtggtcagttttggagtttatgcgtgtagtccttcagaatcatcgtttacagcaaaatttaccgaaatgagcctggagccttgtaaatggttagctcactaggctcaaattcacataacaaacgcctcaagagggactgtcaacgcgtggcgtttccagtcccaatgagccgcggtggttgcagttgttgtggttgagtttagtgttaatgcgttgccagccccttaggcgggcgttatacctatgcaatcacttgagtttccataatatgcccacatattgatatcgccaattaatctaatgtagggatacacatgtcatttcagaatctaaatgctggcgatattgttgtcagcaacttcggtgtttatcagcactggtctctagtctcagatgctttatgcgaaaagggtttacctatgctcatttctgcaactcagcgaaatggcacagttcaagaagagacttgggatgttgtaactcaaggtaaacatacatatccagctaaagttacttacgaccgtccggtgtcagaggtgctcgaacttgctcgctctcaaattggaacgtggaaatactcattaacagaccgaaactgtgagcattttgttaaatgggctacagggttaaaaatgtcttcgactcaagttattgcaggtgcaacaggtgctgttttaggcgcaagcctagttggtttatattcagaaaatccgaagtttgctaaatttcttggtggtgctttagctcttggtagtttagctgttttagcgactaaagcagtcgagaaaaaataggtataacaaacgcttcaagaaggacagccaacgcgcggcatttttactatgcgttggttttggtgattacggtgttatgcggaaagttagtaatagcgttggctgccccttaagcgggcgttatgtgctttctcgaaaaatctcgaagtagtgtagaatccggcttttgaaatcttgagaaatcagcatgtctaaagtcgttcaacagcaaatcggcaatatcgcacttgtcgtagaaaactacgatgatgccattgagttctatacaaaaaagcttcagttcagtttggttgaagataccgatttgggtggtggtaaacgttgggttcaagtttcgccgccaaactcgaatggaacgaacctacttcttgctcaagcaagtaccgaagagcaagctcaatttgtaggtaatcagactggaggtcgtgtttttctgtttctacaaacgaatgacttctggcgagattatgagttgatgaagaccaagggtgttgtttttaatgaagaaccacgagtagaagagtatgggacagtggttgtgttccaagatctttatggaaacaaatgggatcttttggagttgaacaaggctcatcaatagcacgcatataacaaacgcctcaagagggactgtcaacgcgtggcgtttccagtcccaatgagccgcggtggttgcagttgttgtgtttgagtttagtggtaatgcgttgtcagccccttaggcgggcgttagttgccaatcagcaacaaatcagtcgtttggaaatttttgtttctgatgtagtacacgcattattcgaattttagaaccatcaacccaatacgaaacaatcattgatatctcagggataataagcaatctgcctctaatgccatcacgctgaacaccgattagtggttgctcaagcaaattttcgactttggcttctatgagctcatccgtttttttagccgctgctgggttaaagtcgtagagaaattcgaaaattttctcacgatcattgagagatgcttcttcccagaaaatcatgcgtggcctcgatttcggattttagctttacgttcagccattcgtgctttggcgatgtcatgttcaatgaatactgcttttcctgagtcgaacttctcaaatgcttgattcacttgttcagttagccatgcatcgtgagataatgccttgcgttgctgctcagctaattgttcagtgagttcacggcaagcatcgctaagagttcgaccttggctttcagccatttgttgagctaaacgttttgtttcttcgtctacacgaaattgaattctagtatccatggtgagctcctttgttgtgtgtacgaatgttagcactggtgttggggtagggcaactaacaaacgcctcaagagggactgtcaacgcgcggcgtttccagtcccattgagccgcggtggttacggttgttgtgtttgagtttagtgttatgcgttgtcagccccttaggcgggcgttaggtatttggagatatcatgagagctatctttttgattctttgctctgttttattaaatggctgcttgggcatgcccgaatcagtaaaaccagtgtcggattttgaactgaacaactatttaggtaaatggtacgaagtcgctcgactcgatcactcctttgaaaaggtttaagtcaggttacagcggaataccgtgttcgaaatgatggtggcatttggttcttaatcgtggttattctgaagagaaaggtgagtggaaggaagccgaaggcaaagcttactttgtgaatggctcaacagacggctatctgaaggtttcattttttggtccgttttatggctcctacgtagtgtttgagttagaccgtgaaaactacagttatgcttttgtgtcagggccgaatacagaatatctgtggttactttcaagaacgccgactgtagaacgaggcattctggacaagttcatagaaatgtcgaaagagcgtggttttgatacaaatcggctcatttacgttcagcagcaataaatacctaacaaacgcctcaagagggactgtcaacgcgcggcgtttccagtcccattgagccgaggtggtttcggttgtggtgtttgagtttagtggtatgcgttgccagccccttaggcgggcgttaagtgcactaactatgggagaatatgtgagtttgggaaatagagaagaagtatggagttcagcttggaatgcctactatgatgcatattattacgagatcatgatttcatcgcttggtcagcgatgggagttattagacactatttcaaaagttcttattgcattaacagcatctggttctgcaattgctggttgggagttgtggggaaaagatggctataaagtcgtttggttagcattggcaggaggtgcatctttgctgtccattgtccatgctgcattgcaagtacagcaaaaattagaatttcatactaaattggcatcgaatttcacaaatcttaggattgagctggaaacttttcgtgaacaaatgggcatatttccagaatttgatgtaactgagttcaacaaagagtttttgaagctcaaggcaaaacttaagttaaatacaagcaactataaacctgatgtattggcaacaagtggccttcaaataaaatcacaaaatcgactgaatcaaagattaggtatctgaggagataaaatatgagtaggcaaatccctaaagatagaggagggccccctaaccctcgtcctaccccaccgacaaggccaggtgcaaaataactgtgcacttaacaaacgcctcaagagggactgtcaacgcgcggcgtttccagtcccaatgagccgcaggggttacggttgttgcgtttgagtttagtgttatgcgttgccagccccttaggcgggcgttagtttctatcaagaaaaatcatcaaaagctcaggttcaacgttttgaaaaatcagctttcaagttgtccgacttggtttttgagtttcaggctgatgttgcattggtagaaagtgttggaagttcaacagtttcaaaattgctgaaaatcagcaagcctcgaagcttcaatgttgttggattttccacacggtcagtttggtttcacaaatagctgcatcatcgctgtgatctggctttctttgtcgccgactcttaaccgaggccaacttaaccttgatcgttttaagttttggctgccaacttcacagcttttggtgttggacgtgtgcttgttcgatgcatttgcgtaaaatgactttcaagcaaatgtgttaaaaaagtcattgctaaacaataggctacgaaactaacaaacgcctcaagagggactgtcaacgcgcggcgtttccagtcccattgagccgcggtggtttcggtggtttgtgtttgggtttggttgttatgcgttgtcagccccttaggcgggcgttatgccttttgggagacaatatgcagttttacaaagcagatgaatatcaggcatcttgtgaaaacctgtatcgtaagtacgaacttgagatagctgctttacttccagatgcatctattgagcatattggaacttcctctattcctaatgctgtatctaaaggtgacctagacatacttgttggtgttaacggcaaggaactagaaaatgcagtaaagttactttctactctaggtttcaacgaaaaatccgatacgttaagaactccggagctttgcatgctggaaaatagctcaggtgaggatgtcgcttttcaagttgtagctaatggttcggaatttgagttttttgtggggtttagagacaaactccgtaaaaatcctgagttagttcaacgatacaatgagctgaaaatatcttgtacaggttggtctcacgaagagtatcgtcggaaaaaatcagcttttattgagcgcgtgttagggcaggcataacaaactgtttaagagtgattcgcaacgcgtggcatttttactatgcgttggttttattgattaaggtggtatgcggaagcatcggtattgcgttgctcacaccttaacagggcgttatgccacagccagaaaatatggagaaaaggaaatggatcttaattcactactactgtttatagtcgcttgtcttgctatcaatatgataccagggccagacgttatctatattgtttcaaacacaatgaaaggtaagttggtcactgggttcaaagctgcaatgggacttggtgtaggttattttgttcatactttagcagcttcattaggattatctgcaattatcctcagctcagcggtagcttttagcgcagtcaaatggttgggtgctgcttatctagtctatttgggtgttcagtcgttactttcaatgtggcgtgggggtagcacattgaaagtaagtgaaagcgttgaaagtgacaaaaatgtatttgtacaaggcgtaattgttagtgtattaaacccgaaagttgcactgttcttcctttcgttcctgcctcagtttattgacacatcatcaggttcggcttcgatgcaattattgtggcttggtttgttatttagcgtactggttacaatgtgtaatatcctgtatgcgtcagtaggtagttgggtctttagtcgcccgaattctcagcgctactcgcgagggctagagggcgtatctggtgttttacttattgggctagcaagcaaagttgcgatcagcgatcgctagtggcataacaaacaattcaagcagaccctcaacgctcggcgattttggtttgcgtcgggtttggcgttgccgagcaatgcggtaggtgagccagggcgtttcgggctacttaattgggcgttatgaataaaggagatagtgtggaaaaatgttacatgtgcgatgcagagggaaacactaaggagcatgtacctcctaaatgtatatttcctgaggcaaaagatgttccaagtggggataattataaaaagaaccttataactgttcgctcttgtgagaaacataatacggcaaagtcaaaagatgacgtatatctattgttctttttagcagctaatgttgtgtcaaacgatcttgctcagacgcagtttggcacgaaaattatgagagcagtaaatagaacacctcatgtatttgctcagttcgctaagaaaaatacaccagtaactcttaaaggtgaaaatggtgaattgattcatactgctgccattgaaattgatcgtgctcgatttgatgctgcaattgaacatatttctcatgcattgcattaccacaagtatggagagacatttattggtgatattcaggttattaccagtgggttggtggacctatcaagtatcgatagtgtggaggtaaacgatagaattcaaaactttggtcaaatggttgatgagctgttagctgatgtagaacctgaaggtgataaccctgaagtattcacttataaggtgttaaaaacagatgaacctcatcaagtcattatccagatgaatttttatggtggttttaagatcgtttcgatcatgaagtactcttaaccaatattcataacaaactgttcaagagggattcgcaacgcgtggcatttttactatgcgttgaatttagtggttaaggtggtatgcggcggcttcggtattgcattgctcaccccttaacagggcgttaactggcaaaatggaaatgccaaaagcatctgagcaaaaggagtttgcaaatgtttcgttgtgggcaatgccgtcatttcgaaagagctaaaaataatctcaaggatctttgtggtgcttgggaacaacctacgactgcaacgcgtgaagcttgcggattttttatgctcagaaaaccagcccgagatgtgaaaacaccaaatgaagagtagagtaattttctttgtgttggttaaaagtgcagtgaaaatcataagcaccggccagttaacaaacgcctcaagagggactgtcaacgcgtggcgtttccagtcccattgagccgcggtggtttcggctgttgtgtttgagtttagtggtaatgcgttgccagccccttaggcgggcgttagcttcttaaagcaaaaatcatcaaactctgggtttaattgtcctgaaaattcagatattagtgttcaaattgcacaatttggcttttgaacttttcttgatgctgatttggtcgaacgtgttgaaagttcagtgggttcaaagtcgctgaaaactagcaagcctcgatgcttcaaagttgttggatgttcaacactcaaagtttggtttcacaaaaggctgcattatctctgtgttctggctttctttgtcgcggattcttaaccgtggtcaacttagccttgagcgctttgagttttggcagccaacttcacagcttttggctctggacgtgtgtttgtgtgatgcatttgcgtagaatacatttcaagaaaatgtatttaaaaatcattgttaaacaataggctacgaagctaacaaacgcctcaagagggactgtcaacgcgtggcgtttccagtcccattgagccgcggtggttacagttgttgtgattgagtttagtgatatgcgttgccagccccttaggcgggcgttaggtgaatggtcagtggattgaacaaggacagttttatgaaatggtttttagctttttggcttgttctcgcaagctttttttcggtcggcttgcatgccaatgactccgttttacaacaagcttataaatcgcaacaaagtgatctacaggttcaaggattcggaaaggtagtgaaagtgttacctgatgacaatgatggttcaaagcatcaaaaattcatcttaaagctcaatagcggacaaacattgctggttgctcataacatcgacttagcaccgagaattccaaacttacaggttggtgacagtgttgagttttatggtgaatacgaatggaacaaaaagggtggagttcttcactggactcataaagatcctcaaaatcgtcatgctcatggttggttgaaacacaatgggcaggtgtacgagtaaattcacctaacaaacgcctcaagagggactgtcaacgcgtagcgtttccagtcccattgagccgcggtggttacggttgctgtgtttcagtttagtggtaatgcgttgccagccccttaggcgggcgttatgcgccgaatattgggttcacatccatgctcttatgaagaattcggatcaccctgatttgttggctgccggtttgctgataaaagatgacgtgactcccttggggaaattttctgtatccctctcggatttcatcgcatgatttaccaatgtcgggattttccgctaaaagccaaaaggaatcatcgaattgctttaaataaacatttcgctgctcttttccccagcgtcgttgagtgaataaagcaatatcacgtaaatcggctttggcggcgacggtaagattaaatggtttcatcgaatgttttcactatcgagttcattgatgaagctatcaaggtcataatcagcgtcaccactttgctctccttcaataagtagttgacggagtgactgtagtttggtttcttggttttcgagtagacgtagcgcagagcgaatgacttcacttgctgagccgtaacgcccactttgtatttggcttgtaataaagccatcgaagtgttcaccaagagtgatacttgtatttttagccatgagctcatctccataaataccaaaaagtacctaattatggtatcaaatggcattttgggcaaggcgcgcataacaaacgcctcaagcgggactgtcaacgcgtggcgtttccagtcccattgagccgcggtggtttcggttgttgtgattgagtttagtgttatgcgttgccagccccttaggcgggcgttatgtgccatttcaaacatttaggaatattaggacaaaatgagtgtagagttaacatctgctgtatttgcaagcgacattgtagaattcaaagaaaacaacgataaaaatagtatcatccagcttgtgaagcatagatatgatgagcgatttatcaatccattcagagataattctcaaaaacatggctttgcgatgatggctgtatgctgcttaatggttgaatcactaatatctatgaagcgaggtattaatgaaacttcagatgcaagaaatgagcagggtcacaagatatactcaggtgaactattcgaagagttttttagcgagtcttcatatttttgtggtttttctgggttaggtagggatttctataaacatattcgctgtggaattctacatcaagctgaaactacaggtgggtggagaattagaagaaaaggtgaacttgttgataaaaatgaaaagataataaatgcaactaagttcatgaatgcattggaaagtgaattgaatgcctatctacacaaattagaaatagaagattttacggatcttgtatgggttaacctgcttaagaaaatagattttattgcttccaatgcagtcggcgactagcacataacaaactgtttaagagtgattcgcaacgcatggcattttgactatgcgttgcgtttagtgtttaaggtggtatgcggaggcttcggtattgcgttgctcacaccttaacagggcgttaactggcaaaatggaaatgccaaaagcatctgagcaaaaggagtttgcaaatgtttcgttgtgggcaatgccgtcatttcgaaagagctaaaaataatctcaaggatctttgtggtgcttgggagcaacctacgactgcaacgcgtgaagcttgcggatttttcatgctcagaaaaccagcccgagatgtaaaaacaccaaacgaagagtagagtaatcttctttgtgttggttaaaagtgcagtgaaaatcataagcactggccagttaacaaacgcctcaagagggactgtcaacgcgcggcgtttccagtcccattgagccgcagtggttacggttattgtgtttgagtttggtggtaatgcgttgtcagccccttaggcgggcgttataacgatttggagacgttagagtatgaaatatcgaagtaaatgggaactctgctttaatgcttataaaaaagagtgtactcgaattgtgattttcaaagaaagccttaagtttataagctttaaatttaaagcacttatttttatttcgatcattctctttggaatattcttagctttggcaataatctcagcaatcaataataatcgagatatgtactacgtatacctcgttgcatttttattttttgaaacctctagcttgatttctgtatttaaagcccagaaaaaatatactaatgaagagtattcagattatgagttatcccaagcaccaccggaagattataaagatcaaaaagctagatatttaaagtttcgtagagctcttaggctaaatgatattgagcaatctcacgtaagtggaatattggaaatccttgaatcaagaatcgctgtatgtgaaaacagtggagttagtgtacaaaaaatagtcggtttttctattacatttgcaatgtcagttttagttgcaacaatgaaaagcttaactattcagacaattgctcaaattggtgttattggggtgttttcaattgcttttgtttatattttgcataaattaacacccaatacgagagaacagttgtatgagttaaaatattttttaacaatgttcagttatgaagatcatgaaaaatcgttataacaaacgccttaagagggactgccaacgcgtggcatttccagtcccaatgagccgtggtggttacggttgttgtgtttgagtttcgttgttatgcgttgtcagccccttaggcgggcgttaggcgctttcttgctaatgttagatcaatcccttagaacaacttcttgtaatgattgataatcaactcaaatttatcctcaagatgagttaaatatgttgccatcaaaagaagaacttctggccttgcttagcaaagaatgcgaattatatgcatctatcccagatagtgaacagcagaagaaacgtaataaaaagcattttatcaatggtttaatgactgcctgccgagttgtagggatcagttttgaagaactcaacacaataattgaacagatgcccaagaaaccaatattcaaagacttagatgagcagttgtctgtcccaacctatgttcggaacagggttgatattaagctgtaaaaattggctacgcgcctaacaaacgcctcaagagggactgtcaacgcgcggcgtttccagtcccaatgagccgcagtggttacggttgttgtgtttaagtttggtgtcatgcgttgccagccccttaggcgggcgttagccatttgggagaactatggaaaatttaacaaatgatgtaattacaattttacagtatctgctcccggggtttgtgtctgcttgggtgttttatagtttgacctcttatcccaagccatcacaatttgagcgtgtggtacaggctctgatttttactatttttatacaagcaattgttgtggtggttgagttctcagtccgttggttgtgtgctacgtatgaaattacaggagtaccggacaagtttgggttagttggttctgttgtgacagctatcttacttggggttgcatttgcaggctttgccaacaatgacctattgcataagtgtctaagaaggtgtttgatcacaagagaaacatcatatccttcggaatggtttggtgcctttttacaggacgttacttttgttgtcttacacctaaatgatgaacgaaggttatatggctggccaattgaatggccttcagaaccacataaaggtcattttgttatcgcagacccgtcttggctcaacgatgatggcactgaggcagaaataacaggtgtatctaaacttgttattagcgctagtgaagtaaaatgggtggaatttctagagaaaaactgggagtagttatatgtcaaaaaaaggttcaaaccctccaccaccaagtggaagaactggttggactacagatggtgcaaatccagctagaacacctcagaacgtaaggcctagcccaccacctccgccgccaccgaaaaaaaatggctaacaaagcatttaagagtgattcccaacgcttggcattttcagtgctaatcgttgggttttgtgtttatggtggcatggttgagtctcgtgttagcgttgctcacaccttaatgcggcgttatacaaaaaggagaaaaacttgagtttagtttttggggttggctgaaaagtaacttgtctcacctgttttcattattgggtatcatcttaactatctacttttctatttggtatgttcctcaatattcggaagaactaaaatttaagcgtattgagagtgtacacaatgaacttgtaagtactattcaagagctcgtttataacaaccatgaggttaacgagcacaatattgagacattgatatctgggaaagaggtaaaaaacaatattgtttatccttttaccaagcaggagctgctgatacaggttcaagacgcttttttatctaatcgttttatcccactagacgcgcgaaagtcattggttgataaagtagatgagattagaaactctataaaacaatctgtagaaccagttgagccagcaaaatctaaagcttctagtctattgagtattgccgcaggtatatttggtagcttggctgctgcccttggcttctctagcttaactttcgttgccaagcgtcaacgtaaagaagaaattgagcttgaaattaacgatgctaaagagaaatatcaacaagtcatcaagcgtactattgcttttgaaagcaaagttcataaggtgttaatggcttacttcggtcgtaaaaacatagaacaagaaacagagcgagatattggcatagactttatcgttaaaaataacggtgttgctaagctaggtgtggcaatcaaagattacagaaaccaacgtgttaattctaatcagattcatatgctccactcagtatcagcctcgcttaaccttccaatattgttggttacaaactccccattaactgaagatgcgaagcaacttgttgaacgtttaaacgctagagacccaaatagagctcgcgttatggtgagtgattttgatgggcttggtgggcaattggagaattttgtataacaaacagttcaagagggattcagcacgcttggcatttttggtatgcattggtttcggtgttgaagtgcaatgctgtaacatcggtattgcgtgcttcaccccttaactgggcgttatggcgctttataacgaattgttgtttgctatgcgcttttttgcttagtgtctttgttgtatatttgatgccaaaatagttttacttattaaaaggttacttatgctgtcatactatgagcgaaatattgattatctcgaattggaacttaagtcaatcccaactaatgtaaatgtccgttttagtttaaacgaacatatcattcctcatttaaagaaggcggcggaagaaaaaacagctgtatttttaacaaaaaataaaaccgcatcgctacatgttcactcagtcgatgttgatgaattgaatgaaatagcagttatcctttttcattacaccgacactaaccttacggatccagcatttaagaatatgacgtcaggatccgttcggattgcgggaaaaacaaaaggtgagggtatcgcagtttcagcgcacctagtagtagacttgaatcatttcaaaggtcagagagcaccaattcatttagcgttgttggaagtcgtaccaggtataaccaaatctctaattgaacgagctcttactagcttgtttaacaagactattaaccggcctaaatggacatacaaatcaagcactgaaagcaaaagtaagccatgtcgcccaagttttagttttaataatctagcttcagagagtttatccgaaggcttgaaaactcgtcgcttaacaggtgtgacgttgatacacaagacaaatgaagatgacttcgacgaagacgatctgattactaaagagactcaagttagttatgcaataggtgctagtttgaaagaagaggcagccgaacagctcctttatcgactttctagaaaagctaaaagcaaaggctactcgactctgaaagtacaatatgatgatgaatatcgaggcactagaacaggtaagtttaactctttggaagaagaagctatcaaacgagcaactggagtattttgcaaacgaggtaaagtttatactgaaagccaaatacatcagtgtcaggacagtttgcattatcaattggtcaataaaatcaaggcattaatatgcaaagagtgtggggtggcatatgctgaaagcaacaataaagaagttactgaaaccactttattacctcaaaattaagcatgagcaaaaactatttatagatatatatctgccactaatggtggctgcattatttttgtttttgctttctcgtacttctgtagaaatcgcttttgtaggaaaaagtggtttagtgcagttggtgaatggtttgttgcaagttctgattggtttttttgttgcatcgttagctgctgttgcaacttttcaacgtccaggaatggatgagaacatgagaggtaaagctccaactttacaaggtaaaggtgttactcgaagacagtacctttgctatatgttcggctatctggcatttatgagtatcgctgtttattttggtagtggtgttcttgagttgaccatgaaagtctggaaagaaactttcggcagctattttacacaggtaaagttggtagcggtttttatctatttttcattggttagcaatattatttttacaacattgcttgctctacactttcttacagacaggatagttagagacaatgacgttgaacctgatgatgtagcgcgccaagataaaacgcttaaaatttcaagataaataaaattcagagaatcccatagtatgagatggcgatttcattttatcgatagttttcacctagttgataccagtatctggatctacagaaaatccttttggaaggtaagtaggcgtcacttttaccctatcgtccgaaacctctacttttaatttcatctctcctgcttgagctgcaagataagaactaggagttgatatcggactcctattatacccgcctgtcatgtattcggggggagacattggcttgacttcatactttgcagggtcagctccataatattgaacatcttgagcttgagcctccttatcaccaaaaaatgctttcatcttcgtagtgaactttgcatcagcctctctatagccgtcaaaattggatgacaacacactatcagttagatctgctagttcgtaagaagcccatccaatcaatggaatatttgctaaattacttgcattaaagagtgatttattgggctttttgttatctggaaagtttacgtcaggaccaccaagaccgccattaggcatattcacgacatagactggagttgcgcctaaagcactcaacgaaccagctcccgcagcccctttctttccgccaagaaccatatctccaatcatggctccacctttgagaaggggtgagcctattcgcagcattttgttaatggcgtaaattgaagccagaatttttgctagatttccgtaacctcccacagtctctgccaaactattagctgtagtggtcaactaaaattggccacggttttagagttttcccaatataatcgttctgattcattgggagttagaccaccgttatactgatgtggcctgagttggcagtaatatccgataatgtagcgggtgatctcttgttgagcctcagcgaagctacgataacccacagttggcacccattccgtcttcagacttctaaagaagcgctctatcggcgcattatcccaacagtttcctcggcgagataaactctgttttatttgaaagcgccacagtaattgacggtatttacggctagtataatgactgccttgatcgctatggaacatgacaccttttggctttccgcgagattcataggccatagacagcgctttacctgtcaaccgactatcaggcgacaaagacattgaccaaccgatcactttgcgggcaaaaagatcgataacgaccgctaaatacatccaccgattaccagtccaaatatacgtaacatcgccagcccagacttcatttggagccgtaacagcaaattgacgacttaagtgatttggaacgtcaatatgttcttgtgaagcctttctgtaacgatgctttggttcttggcagcttactaaaccaagagttctcattagctttgttgctcggtatcggctcagctttacaccctgatttgtgactatatctgcaatggttctcgctcccgcagagccattgcttgcggcgtgagcctcgctaatcaagctgcgcagttttattgtttccgcattaattaacgctgggcgtttaagccaatagtgataactacttcgatgaacattgaagacttcgcataatatttttacgctgtggctctgcttgagtttcttgattatcaagaattgttcagtgagtccgacatcaagagagccgtggctttttttagtatttcattatgctcttcaaggcgagccagcttctttttcaattcccgaatttctatttgctcaggggtcataggtgaagctttaggtgttttcccttggcgttcttctctaagctggcgaacccatttatccatcgtggacttgcccacattcatggcttgggctgcttccgtcactgagtaattttggtctaagactagctgcgctgcttctaacttaaattctgcgctaaatagtcgtcttgtacgttttgtcataatgtcacctgttaacttatgaggtgatgatatcacctctaactaagtgaccaaattcactatgccactacagttgcgaagttattgagtatctagaaagggacaataatcatatcaactgggcttttgattaccgtgtaaactttatgctcgaacgtaagccagaatatgagtccttgtgtcaaaatcttcatgagcttctttctggtaaatacatgaaaatagatcgcaatgaagtggttgaaatcgaaatataacaaacgcctcaagagggactgtcaacgcgcggcgtttccagtcccattgagccgcggtggttatggttgttgtgtttgagtttagtggtagtgcgttgccagccccttaggcgggcgttagcccgcaaatatgatattacgtcagttaaataggatagatatgtctagttttgattttcctaagtatcaagcaaatcaagaagtagggaacactggtgaagctttttttgagcattttgtaactaaggagttgggttgtatataccgaaaagttcaccgagaacatgattttggcatcgatgggtatattgatatcgtcaataatggtgtggtgagtggacgctcggttgcagttcaaatcaagtgtggtgatagctatatctctaaagtcacaagcggtggtattaaatacttgggtgataataagcacttaaatttccttattaatcataatgttcctgttattttggttgtgcttaacagtgactgtactaaagggtattgggtggaattttctgttaacgcaactaatccaagtagcaaatcatggtggattgaaattccgtttgagaatcagttaggcactttagatatgactagtctctgtgatatcgctggaattgcagaggattattccgaagatatcaaagtatcttgggcaataaattctgccatggatgaacagtctgatatatcttttgttctttctaaggaagaagttgaagagcttgatttatcggggataaatcaaatgatggagcgttacttcagaacgaaagatttgctaatttcaaatagaaacaaaactgtattttggatctttggatatgatgatgactcacgagaattatatgagattccagaagtaagaagatggtttaaatttaccttagaacaaggtgtgccttggttctacctcctagatgtaggtgctgaccatatgagtttacctattaatatgtactcatgctgtaatatttcagttaataaactaagttgtggttcaaagtcagtagttatttcaagtgtgtcagatattaataattgggtagaagtaaactttgaaaatttgaaccgtttcgctgatgaaaagaaaataccagataatattttaaaagaagtctctgaaaaagtaattacttcagttcaccgtctggttgctggctaacaaacggttcaagagggacagccaacgcttggcatttttactatgcgttggtttttgtggttacggtgttatgcggaagcttggtaatggcgttggctgccccttaaccgggcgttatgcttaatccataaaaatcagtaggttgtggttgtcgattcctttggcgtttcgttcaggttttgtcggcaattcagtattgtttttcgctgcctaatgaagtggcaatgtatctggcgctaaaaaatcgcagtgattgcctcattgtgttgttgagtctgtgtgaggttagtattgttggctcaagtcgctttgagcagtttggtgcctttacttatggacttaaagtttgtcggcaattcagtattgttttgcgctgcctaatgaaacggcaatctgtctttcgctgtaaatttcagtgtcattgcctcattgagttgtcgtgccaatgtgtggtgagtgagtttgtcggagagggtttccacattggcctagttgctaaatgaaagcctgcattgggtcagttcataggtaaaagttgagtcagttctagttcaagaaaattcgaagtttggtcaatgatttcagtggtttattcttgagttggttcaaatgtaaagtgttgaagcttaagcataacaaacgcctcaagagggactgtcaacgcgtggcgtttccagtcccattgagccgcggtggtttcggttgttgtgtttgagtttagtagtaatgcgttgccagccccttaggcgggcgttatggcgcaaggcatgacacacacatttataggaacgattatgaatacaatggaatttgttcgctcactattgatcgaaaagggtattagtgctcgtttagctaaaccttatccatatctattctacaaatttgctcgtttagatatgaagcctagggtgtttgaaagtccattgaaactatttgttctccaatcagtgcttggtactgtcttttggggtgggttcatgtggctcttagtctggcagtttcaaggctttgttgcttctcaagtttatgcgtcgatgttttttggtgtgattactggtttattacttgcggttgaggtcgctaggatacgccggaagtatggggtcaccgattttgatagttggcttaaggcaaatggtttgaaatagcgccataacaaacgcctcaagagggactgtcaacgcgtagcgtttccagtcccattgagccgcggtggttacggttgttgtgtttgagtttcgtggtaatgcgttgccagccccttaggcgggcgttagcttcttgaagcaaaattcatcaaagtctgggtttaattattctgaatattcagcttttagcgttcaagttgcacaatttagcttttgagttttgcctgatgttgatttggtagagcgtattgaaatttcagcagtttcaaagccgccgtaagctaacaaacctcgatgcttccattttgttggatgctccacacggaaagtttggtttcacaaaggctgcatcatcgctgaaagtgtgctttctttgtcgcggactcttaaccgtggccaacttagctttgagcgttttgagttttggcagctaacttcacagcttttggcgttggacgtgtgtttgcgtgatgcattttcgtaaaatcgctttcaagcaaaggtgcttaaaagttattgggaaacaataggctacgaagctaacaaacgcctcaaagggactgtcaacgcgtggcgtttccagtcccattgaaccgcggtggttacggttgttgtgtttgagttttgtgtaatgcgttgtcagccccttaggcgggcgttatggcgcaaggcatgacacacacatttataggaacgattatgaatacaatggaatttgttcgctcactattgatcgaaaagggtattagtgctcgtttagctaaaccttatccatatctattctacaaatttgctcgtttagatatgaagcctagggtgtttgaaagtccattgaaactatttgttctccaatcagtgcttggtactgtcttttggggtgggttcatgtggctcttagtctggcagtttcaaggctttgttgcttctcaagtttatgcgtcgatgttttttggtgtgattactggtttattacttgcggttgaggtcgctagggtacgccggaagtatggggtcaccgattttgatagttggcttaaggcaaatggtttgaaatagcgccataacaaacgcctcaagagggactgtcaacgcgtagcgtttccagtcccattgagccgcggtggttacggttgttgtgtttgagtttcgtggtaatgcgttgccagccccttaggcgggcgttatggcgcaaggtgaaaatgaaagccatcgttgatttaattagaaaagatcccattcgacatgaagcactagaatgtgtttatcagcttgaattgcctcaatgctacatagccgcaggttttgtgcgaaaccttgtctgggactctttacatcacaacgtaaagctgacgccattaaacgacattgatgtcattttcttcgatgccgattgtttagattcagattatgaaaaatcgcttgaactcaagttgtcggagcaaatgccccagctcaattggcaagtgaaaaatcaagctaagatgcacttacaaaatggcgacaatccttaccaaagcacattggatgccatgagctattggcctgaaaaagaaacggcggtagcagtgagaaaagtcgagcacgatcgttacgaatgtatatcagcctttggtttcgagagtttatttcaaggtttcatcacacataatcctaaacgagcatatggaatcttcgaaaatcgagtaaagtcaaagggttggttggctatgtggcctaacttgagaattgcgccataacaaacgcctcaagagggaccgtcaacgcgtggcgtttccagtcccattgagctgcggtggttacggttgtagtgtttgagtttagtgttatgcgttgccagccccttaggcgggcgttagcttcttaaaggctagaatcatcaaaatccaagctcatttgttgtgaaaattcagcttttagcattcaaatttcacaacttggctttcgagtgtttctgatgccgatttggtagaaagtgttgaaagttcagctggttcaaagccgctgaaaacccacaagcctcgatgcttcaaggttgttggatgttccatgcggcaagtttggtttcacaaaaggctgcatcatcgctgtgatcttgctttctttgtcgcggactcttaaccgtggccaacttagcctagatcgttttaagttttggcagccaacttcacagcttttggcgttgggtgtgtgtttgtgtgatgcttctgcgtaaaatggctttcaagcaaatgtgttcaaaaagtcattagcaaacaatgggctacgaagctaacaaacgcctcaagagggactgtcaacgcgtggcgtttccagtcccaatgagccgaggtggttacggttggtgtgttttagttttgtagtaatgcgttgcctgcctcttaggcgggcgttaggtttaaggttattcatggaaatcaaagagtttagtgcctgtaatctcgaatcgttgagaaagctctacttggactctagacgagatagtttcccatggctcaaggcggatagttttcggatagaagacttcgaccgcgatagtcaaggtgaacgaatttggttgtctgaggttttagggaatgttgtcggcttcatttccatttgggagcctgacaattttattcatcatctctatgtcgcaaccgaatatcaggggcaaggtgtgggctcgatgctgcttaacggcgcaaaaatgaaatatggcaacttaagccttaagtgcatggttcaaaatcaaaaagcactcaacttttattcgtcgcaaggttttgaaattgtgtcgcaagtggatgatgaattgggtggttattactacatgagcttcagcgcacaaacctaacaaacgcctcaagcgggactgtcaacgcgtggcgtttccagtcccattgagccgcggtggtttcggctgttgtgtttgagtttagtggtaatgcgttgccagccccttaggcgggcgttatgttgctaaggatggacgttggaataagatgctaaatttattgaggttttttctcataagtaatctcactgcatcagcagttgtggtcatgtttgagaaatctacgggtttctttggcctgaggtcttggcccgattatgcattctttgttgtggtgatcctttgggggttagcagccttattttttatgtacccaccagaaggcggttttggtggtgatagggcagaaagtgtagcgggttcaatggtggatagctcggtggctaatgaaattgacagtgagcgtttttcatcaaacacgatgctttgtatcaaactttttgtttcagggttacctgcatttctaacatgcataatagttagcaccgcaacataacaaacgcctcaagagggactgtcaacgcgtggcgtttccagtcccattgagccgcggtggttgcagttgttgtgtttgagtttagtgttaatgcgttgccagccccttaggcgggcgttagggctactatgagttgcaataactgtgtgagtattgggaaaaagcatttaggaggttttaaatcgccttctaaatatgctttatctcaaaaggcatgtgatgcacttgttatcagcaacatttgggtagaagagccttcatcaaatcagtttgataggcgttttaaatgtaagtgttgtggagaccagtggcgtcttgagtggcctgatccacctatatccggagggctttggcaaaaaacttctcggcaacagaaaattgccgaactttcccaaaaactcagaaacaaaccaagtgctacagtgtttaaaaaatggtagccctaacaaacgcttcaagagggactgtcaacgcggagcgttttcagtcccattgagcataagtggttacggctgttgtgtttgagtttagtgttatgcgttgccagccccttaagcgggcgttagtttctctcaggaaaatcatcaaaaattcacgcacaaggttctgaaaattcagcctttatcgttcaagctgcacaatttggtttggggtttttcctgatgttgatttggtagaaagcgttgaaagttcagcggtttcaaaaccgcggataaccaacaagctttgatgcttcaatgttgtcggacgttcaacttgatcagtttggtttcataaaaggttgaatcatcgctgtgatctggctttctttgtgcggactcttaacgttttggcagccaacttcacagcttttggcgttggacgtgtgtttgcgtgatgcttttgcgtaaaatgactttcaagaaaatgagtttaaaaagtcattgttaaacaataggctacgaaactaacaaacgcctcaaagggactgccaacgcgtggcgtttccagtcccattgagccgcagtggtttcggttgttgtgtttgagttttgtgtaatgcgttgtcagccccttaggcgggcgttagtttgcaatcggagactaagaaacaaagcgtgactgtttgagatgcttttggggcagttgtgattgccctaataccgcaacaatgagaatgaagtttgcttctttggtgtaataagccatgtgtttccccactggaaagtaaaaaccattttggtaaatatcttcacagctttttcctagtcctgggttatccgcaagagtttggaaacctgaaagcaaggtcgacttatatttttgccactgcgcttcagcgaaattttcaatggtgtagtgtttaatcttgagtaagtgctcttgggctaattggctgagcttatattgtttattttgcatattgaggtaaacgctcaatcaaagggtgtttagaaaagtggcaccatcaacggttttgccactatctaagtctttctgagcagactcaaagcagtgtttgagataatcgagtttcattgcttcaagttcttcaaagtccttaatggacatgacaacgacagtattcttactgtttttgctgatgatgacaggttcgcgttgtgcgcttagaagaagttcaccaaaatttcgtttagcatcatttgctgttagtgtgtgcataactaggctccttactcaaagtttgaaagagtatagcttatgatgcgaagtgtttaaaataattaaatcgcacgatttgggcgaaagcaaactaacaaacgcctcaagagggactgtcaacgcgtggcgtttccagtcccattgagccgcggtggtttcggttgttgtgtttgagtttagtggtaatgcgttgccagccccttaggcgggcgttataaagctcgaagaaagaggacattttgtggaaattcgaacaggtgaatttgaagatattgcgggcattaccgacatctttaacttttatattgaacaaaccaatgcacgctttgaggaatttccatttactctggaaaatcgtgaggaatggttctctcagttttctagaaccgccaaatatcaaatatatgtggctgtagaaaacggtgtgttgcaaggttttgcatgttcccaaaagtacagagcaataccagcttttgatgacactgtagaggtgagcgtttatctggcacaagaagctaaagggaaaggtttaggttcgaagctttatactcagctgttttcatccattcgtgcttatggcgtccatcgtatattgtcgggtgttgcattaccaaatgacgcatcagtagcattacataaacggtttggtttccgagaagtcggcatttccaacgaatatgccaagaaacatgggcagtacatcagctcgttgtggttagaaaaagcgcttaacgtagagtccgctttataacaaacgcctcaagagggactgtcaacgcgcggcgtttccagtcccattgagccgcggtggttgcagttgttgtgtttgagtttagtggtatgcgttgccagccccttaggcgggcgttaggtatcttggagggggcattgagcgacattattttaacaatcttagcttcagtaacagctagtagtgtggcttctgctgtaattgtttggctttcaaaaacttggattacagagagagttaaaagctcaataaaacatgaatacgacttgaagctagagtcttacaaagcaaaagttgaaattgagaaaacagcagcgattgaaaacatcaaatcggctcttaaagattcaacatttaaaagggaactgcgttttagcatgttacatggaaaacgctctgaagtgatatccgatctacatgctcatttacaagatacaataatgtttttaaggcattattacgatgctagctgctcacatggtgactttgataagctaaatgaaagtacattaaaactgtctaactttctccgtgttaatcggttatttctgcctgatgatattgaggttaaggttgacgatctttgcgataagattttagatagttcacagttagaaaaagatatcaactttgatgtagaagatgaaattaaacctctattttctgcaattaaaaaggaaatgaaaaagttactagacgatgacatatagaatataaatccaagatacctaacaaacgcctcaagagggactgtcaacgcgtggcgtttccagtcccaatgagctgcggtggttacgattgttgtgtttgagtttcgtggtagtgcgttgccagccccttaggcgggcgttatgcttagtccataaaaatcagcaggttgtgattgtcgattcctttggcatttcgttctggttttgtcggcaattcaatattgtttgtcgctgcctaatgaagcggcaatgtgtctggcgctgtaaattctgtgttattgcctcattggttttttgagtccacgcgaggtgagtttggctctctcaagtcgctttgaccagtttggcgcctttacttataagctgaaagtctatcggcaattgagcattgttttgcgctgcctaatgaaacggcaatgtgtctgtcgctttaagtttcagcgccattgcctcattgagttatcacgccaatgtgtggtgagttggtttgtcggagagggtctacacattggcctagtcgctaaatgaaagcctgcattggtcagttcataggtaaaagttgagccagttctaattcaaggaaactcggagtttggccaatgatttcagttggttatcattgatttgattcaaatgtaaagtgttgaagcttaagcataacaaacgcctcaagagggactgtcaacgcgtggcgtttccagtcccattgagccgcggtggttgtagttgttgtgtttgagtttagtggtatgcgttgccagccccttaggcgggcgttatgcttaatctattaaaatcaattgtttgtggtttttgatctctttggcatttcgttcagttttgtcggcaattcaatattgttcgccgctgtctaacgaagcggcaatgtgtctggcgctgtaacttctgagtgattgcctcattgggttgttgagtctgcgcgaggtgagttttgctctttcaagtcgctttgagcagtttggtgcctttacttataggctgaaagtctgtcggcaattgagcattgtttttcgctgcctaatgaaacggcaatgtgtctgtcgctgtaagtttcagtgtgattgcctcattgagttatcgtgcccatgtgtggtgagttggtttgtcggagagggtctccacattggcctagttgctaaatgaaagcctgcattggtctgttcataggtaaaagttgagccggttctagttcaatgaaagtcgaagtttggtgaatgatttcagtgggttattcttgagttggttcaaatgtaaagtgttgaagtttaagcataacaaacgcctcaagagggactgtcaacgcgtagcgtttccagtcccaatgagccgtggtggttatggttgttgtgtttgagtttggtgttatgcgttgccagccccttaggcgggcgttagcttcttgaagcaaaaattatcaaagtctggatttaattgtcctgaaaattcagcttttagtgttcaagtttcacaatttggctttcgagtctttctgatgcttatttggtagaaagtgtggaatcttcagcagtttcaaagccgctaaaaatcatcaaaccttgatgcttcaatgttgttggatgctccaaacggaaagcttggtttcacaaaggctgcatcatcgctgaaagagtgttttctttgtcacggactcttaacgtggccaacttaaccttgaatgctttgagttttggctgtttacttcacagcttttggtgctggacgtgcgtttgttcgatgcttttgcgtaaaattgctttctcaaaatcattgttaaacaatgggctacgaagctaacaaacgcctcaagcgggactgtcaacgcgtggcgtttccagtcccattgagccgcggtggtttcgattgttgaggttgagtttagtgttaatgcgttgccagccccttaggcgggcgttatgtacttttctgaaatccttcctacaaatcaaacttgtgcacagtgtcattatgcgttagtctttgcctatggatgcacaatgagacagtgcaagttgcaatggcattagaatttaaagataagtggttagagcagttttacgaggatgataaacgacatcgtttaattccaagtagcatagagaatgctctatttcggaagctggaaatcttagatgcagctcaagctgaatcagacttaagaattccaccgggtaatcgttttgaacatcttgaaggaaatcttaaaggttggtgttcaattcgagtgaacaaacagtatcgtttgatttttcagtgggttgatggtgttgcactaaatacttacttagacccacataagtattgaggtaacgactatgcgtaagacaaaacgtcgtccagttagcgttggggaaatgttaaaagttgaatttcttgaaccaatgggcatcacatcaaaagcgctcgctgaagcgatgggcgtacacagaaatacggtcagtaatttaattaatggtggtgtgttaacagctccggtagcaatcaagttagccgcggcattaggtaacacaccagaattttggcttaacattcaacatgcagttgatctttgggatacgagaaatcgttatcaagaagaagcaaagtttgtaaagccgttgtttgtttcgctggaacaaagcgcacgtacataacaaacgcttcaagagggacagccaacgcgtggcatttttaccatgcgttggtttttgtgatgatgatgttatgcggtaagttggtaatagcgttggctgccccttaagcgggcgttagcttcttaaagcaaaaatcggtttaattgtcctaaaaattcagattttagcgttcaaattgcacaatttggcttttgagcttttcttgatgctgatttggtcgaacgtgttgaaagttcagtgggtgcaaagtcgctgaaaactagtaagcctcgatgcttcaacgttgttggatgttccgctcggaaagtttgatttcacaaaatgctgcatcatcgctgtgatcttgctttctttgtcgcggactcttaaccgtggccaacttaaccttgatcgttttaagttttggtagccaacgtcacagcttttggcgttggacgtgtgcttgcttgattcttttgcgtaaaatgcctttcaaacaaatgtgttaaaagccattgttaaacaataggctacgaagctaacaaacgcctcaagagggactgtcaacgcgtggcgtttccagtcccaatgagccgcggtggttacggttgttgtgtttgggtttagtagtaatgcgttgccagccccttaggcgggcgttattttgcttattcaaattatggaggacagcggtaagtgttatatgccaaagctttaagtattggagacaaattggttttttctcaccatcttcaccggctacagcctttgctccaaatcgatttcaaagagcaaaagcttatcttaaggcacagggatttgagttagttgaaggttcgcttacgggaaaatctgattattaccgctcaggctcgattcgggagcgtgctgaagaattgaatcaacttattcgggatccgaatgtccgttgcatcatgcctaccattggaggcaataatagcaattcactgttgccgtatattgattatgaagccttaagaaacgatccaaagatcatcattggttattcagatgtcacagctttattgctcgggatctatgctcaaacaggacttatcacattttatggcccagccttagtcgcttcgtttggtgagtatcctccattggttgatgaaacctttcattcgtttatcgatctgttgtgttcagagacgaatcaatatcaatacactatgccctcgtcatggacagatattaagcacgattgggaaactcagcattcagctaagcccgtttatccgaatgaatggcagtttatcggtaaaggcaaagtgacaggcagaattattggcgggaacctcaacaccatggctgggatctggggtagtcgatacatgccagagattaaagttggcgatattttactcatagaggattctctgaaaggtatcgaaaatgtcgaacgttcttttgcacatctcgcagcttgtggcgtttttgagcgagtgagtgcgatcattttggggaagcatgagttatttgacaacaaaggtacagggagaacacctctggacgttttaatcgaagtattagcggataaaaatgtacctatattttatggttttgatagttgtcatacgcatccgatgctcgtcacaccattaggtgtgcgaggtacaatcgatttcgacaatcatacctttaagctagaagatcgttgggtaaaagcaaaataacaaacgcctcaagagggactgtcaacgcgtggcgtttccagtcccaatgagccgcggtggttgcagttcttgtgtttgagttttgtggtaatgcgttgtcagccccttaggcgggcgttaagctacttcagctattgtaagagtattgatatatgacagacgaaataagacaagattttataaaaagaattgatgagttgcgtatacaaattactagtcgttatagcactctaaatttagaggctatttggctctttgtcgcaacactgggctgctggagtgttaatcaaccaatagtccaaattattgcgttgatacttgttttagtgttttttcgtacaaagtatctgaagataaaacgtatagctctacgtttgttaaggttttaaaagatattaggaaggacatcgacaattcaatacttgaaggtgatgtgaagaaagcacgattacacgaagtagacgaaatagataaaaacttattaagcttcgtgtcaatatctaaatctacacctaagttcttattagggtatggtttttggacgttatcattatttatatttggttacaggctcttctatgctgcaccagtagcttaacaaacgcctcaagagggactgtcaacgcgtggcgtttccagtcccattgagtcgcggtggttacggttgctgtgtttgagtttggttgttatgcgttgtcagccccttaggcgggcgttatgtgtttacagaggtatcgtggaatcaaaatggatgatttaagaaggaagtgttttttctgtaaagatagaattgatggcaaaaagacactagagcacattattccaaatagtttgctcgggaaattaggcataaaagaaaaaacggtcactggtcaatttaacactattcaatatagcagagtaaaagttccagctcatgaaagctgcaataatcagtttggcagtgattatgaaaacagaatattaagcttacttgaaaatccggaacaactttataaccagttacttgaagaagctggtatcttaatgatgtacagccccgatagctccgtatctgcattgattacaacttggctatcgaagatctattatggactcttctactatgacttgatctctacgaaagcccctcaatggaaagatgtttgttcatcaattatacaaagtgataattttaaactcgtgcagagctcgtataaacaaggctatggttttcaactcccttcaagtctttatgttttcaaaaccaagaacactgaaaccgatctagtaacaatagtagaacctagtacattattgcttaaaattggttcgttaacatttgtgctctgtatatgtgacggctttctaaccaagaattatttgaatggacatccgctcaaaaaattacgttcttggatggaagaggaagagaagctggatcctcattttccagtacaaaagctcgcgctagctgagatcattgcacttagaaagtgtattcctaagaaccccaggtttgtctattcaaaagatcagataattaacatgagcttgtccacaatggctaaaaatcccgacattgcttatcaaatcaatgaggagcatctttcacacgtgcgtagagaggttttacttgaaatgggtatcaaaataataaacacataacaaacgcttcaagagggacagccaacgcgtggcatttttattatgcgttggtttttgtgattatggtgttatgcgttaagttagtagtagcgttggctgccccttaagcgggcgttataacctaatgggaaatcatgaacttagaagagtttcaagaatcggattttgacctgcttataaaatggattgactcagatgagttgaactatttatggggtggccctgcgtatgttttcccgctgacttatgaacagatccattcccactgtagcaaagcggaagtatttccctatctgctaaaagtgaaaggtagacatgccgggtttgttgagttgtacaaagtcaccgatgagcaatatcggatttgccgtgtctttatttcaaatgcttatcgtgggcaagggctatcaaaatcgatgttgatgttattaatcgataaagcccgattagatttttctgcaaccaagcttagcttaggcgtttttgaacagaacacagttgctagaaaatgctatgagtcattaggttttgaagtggtttcgacagaaattggtacaagagcttttaatggtaagttatgggatctggtgcgaatggaaaaacggttataacaaacgcctcaagagggactgtcaacgcgtggcgtttccagtcccattgagccgcggtggttgctgttgttgtgtttgagtttagtggtagtgcgttgtcagccccttaggcgggcgttaggtatttggagatatcatgagagctatctttttgattctttgctctgttttattaaatggctgcttgggcatgcccgaatcagtaaaaccagtgtcggattttgaactgaacaactatttaggcaaatggtacgaggttgctcgactcgatcactcctttgaaagaggtttaagtcaggttactgcggaataccgtgctcgaaatgatggtggtatttcggttcttaatcgtggttattctgaagagaaaggtgagtggaaggaagcggaaggtaaagcttactttgtgaatggctcaacagatggctatctgaaggtttcattttttggcccgttttatggctcctacgtagtgtttgagttagaccgtgaaaactacagttatgcttttgtgtcagggccgaatacagaatatctgtggttactttcaagaacgccgactgtagaacgaggcattctggacaagttcatagaaatgtcgaaagagcgtggttttgatacaaatcggcttatttacgttcagcagcaataaatacctaacaaacgcctcaagagggactgtcaacgcgtggcgtttccagtcccattgagccgcggtggtttcggttgttgtgtttgagttgagtggtaatacgttgccagccccttaggcgggcgttaaacttcatcagtcgtctagccgttgcagcgctttagtgtaaacttcgctgcgttctcgtttaccgacagctaaaacagtaactacgatgatgtcattttcaacttgatagactaagcgataaccagactgccgaagttttattttataaatgttctcagcgccagacagtttggctgatggaacatgtggattttcaaggcgttctattagtttcttcttgaactgctgttggagtggaacggctaactttttccattccttcaaagcactctttttgaactcaagcttataggtcatcgatatttaccgatacgctgtcttcacttaagcgttctttggcaatagccagtagctcaagatcttcaagcttatccatcatgatctcgtaggtgcttgcagggacgcagtagaaagccggctcatttcggttgagtacagcaacaggagcaccgaaggcactagttgcaactttcattgggtttgctttaaattcggtaatgcttgctgcaacatcagctaggattctagtggtcatttaatcggtcctttatgtggtctttaattgggtcattatagtcttgaaaatgcagtttaacaaacgcctcaagagggactgtcaacgcgcggcgtttccagtcccaatgagccgcggtggttgcagttgttgtgtttgggtttagtgttatgcgttgccagccccttaggcgggcgttaggcataaaatttataagcaattgcttgatattctccatattgcccatatttaaattatggtcattaaataaaaggagtagaccatatgccagatttaacgaaagctcgctgtccgtgtcgtggatgcaataaagttgcgaacaatgcagaagaggtagaagagctgtttggcctcagaaatatgggtgatggtacgattcgcgtacaatcatattgtcgcgaatgtcgaggcttgcattgtgaagctagtaatcctaaatgtaatcatcatgcctaggtattttgatgatttgttagataagaaaatgatataggttaatgacagatacgattttaacgtatctgtcatttcatgttaggttatgcgtttccctcgatattaggcaatttaatgtcaaaaatttatcaaatggatgcggttgattggcttaaaacacttgaaaattgtagtgttgatctgttcatcactgatccaccatatgaatcgctagaaaaatatagacaaataggtacgactacacggttaaaagagagtaaatcatcgagcaatcaatggtttagtgtttttcctaacactaggtttgaagagttgtttcgtgaagtttatagagtgctaaaaaaaggttctcatttctatttattttgcgaccaggaaactatgtttttggcgaaaccaatagcggaaagtgtaggctttaaattttggaagcctatagtttgggataagtgtgctataggtatgggatatcattatcgtgctagatatgaatttattctatttttcgagaaaggaaagagaaagttaaatgatttaagtgttcctgatgtgttggaatataagagagtttggaaaggctacccaacagaaaagccagttgaacttctggaggttttgattaggcaaagctcttcagaaaatgaaattgtagcggattcattttttggttcaggctcaactttaattgcagctaataatctctctagaaaatacattggttgtgatatatcaagttctgcacatgagtattttaagaatagagcttgaaactatttatgcctaacaaacgcctcaagagggactgtcaacgcgtggcgtttccagtcccaatgagccacggtggttacagttgttgtgtttgagtttagtgtaatacgttgccagccccttaggcgggcgttaggtgtgttgcattcacaatttggctttatttttgttgatgcattttccctgattatgtatgagtcgttttgaaaataacctttaacaccatgattacattagtttttgctaacctttaataacatggagaataaaggtggagaaaagtaacgagaaagtacagttgctagtaaatgctattcggtttcgtaaaccctacacggctaatgattttcaagtaacagcatctgagctgaaagtgaaaaaagagagttatcacttaagtaaaatcaagagtattgaactgaagcgtcttggcttcaaagataacgtggttaaagtgacaacatacgccattttactgtcagcagcgacttgggcttttgtacctgagtttggtttttttgcgctcctaattgctctgattttggctttggtttcgatgagaaagtatgagttgaaagtagagtttaaaggtacagatgaaacgggtgattactgggtatcaatagcgcgttgttggacggaagatgaatttcatattctagataatatttatactgaactgaaaagcagaatctagcacagaggctcgtcaattttggcgagcttttgagtttatggtcccgcacctaacaaacgcctcaagaaggactgtcaacgcgtggcgtttccagtcccattgagccgcggtggtttcggttgttgtgtttgagtttagtggtgtgcgttgtcatccccttaggcgggcgttaggtgaatggtaagtggattgaacaaggacagtgttatgaaatgttttttagctttttggctcgttttcgtcagctttttttcggtcggcttgcatgccaatgacgccgttttacaacaagcttatcaatcgcaacaaagtgatttacaggttcaaggattcggacaggtagtgaaagtgttacctgacgacaatgatggttcaaagcatcaaaaattcatcttaaagctcaatagcggacaaacattgctggttgctcataacatcgacttagcaccgagaattccgaacttgaaaggttggcgatagtgttgagttttatggtgaatatgaatggaacaaaaaaggtggggttcttcactggactcataaagatcctcaaaatcgtcatgctcatggttggttgaaacacaatgggcaggtgtacgagtaaattcacctaacaaacgcctcaagcgggactgtcaacgcgcggcgtttccagtcccattgagccgcggtggtttcggttgttgtgtttgagtttagtggtaatgcgttgccagccccttaggcgggcgttaggtttactgagtgaagtctgatggaaaagagaagaagacaaaaatatagcttgttagaaccaatagttgttcagtctggcaaccaatatcaaaatgctgcatcggtgcttgcaagcaccgatggaaatctgtgggtagcgtgtatcaatgcatcgttggctatagagatttatttaaaatcatttttgattacagaacatcaagtgcaagggtactcaagatttatgggaaccgttcataaatcacatgacctagcaaaattatttaagaaactacatcctcaaaaacaatcggtacttttagaggcagtcaaacatgttgctccaggcatcgatctagttgctgaactgactaaataccgaaatgtctttacgaatgctaggtatacttttgaaccaaataatgttccatctatgggttctgacctaataaatttagctagtgttttaagacgtgcggttatccatatcataaatgttcattatccagtgattaaacccataggtcttgaaaaagcggtcaatgagatactttcgacacggcaaacataacaaacgcctcaagagggactgtcaacgcgtagcgtttccagtcccaatgagccgcggtggttttggttgttgtgtttgggtttagtggtaatgcgttgccagccccttaggcgggcgttaggctaaaggaagtagcaatgaaaaatattaaatacattttatttatttgtgttgtagcgtacatgccatttgtaagtgctaatttatcgcatttggataaaagcataagtctccttaatacattaaattatcctgcaatatttaaaaatacattacttaaagagtgtgataaggggctcccacagttcgcttcactaaaaatttgtaaacaatcggaaacactatcggacgaaatgatagtcaggattgctgctaaacacttcatttcatatgtatctgagagtgataccgataaattaattgctttttggggtggaagtgacggtgtccgaatttcaaatggattagtcctctggcagcaaactggcagactagatgtattgacagatactgatttgtatattttagacaaatttaaccaaacagcagaaaataaagcatctatggcatttgccgacaatgttaatgtaagtgtgcaaataatcttagaaatcgaagaaattctaagcagtcaatagcctaacaaagcgttaaagcgggacttggcacgcgtggcattttcagtttgcggtaagtttagtggttaaggtgtgatgcggtcacttttgtattacgtgcctgcgccccttaacgcggcgttaggttgctcaacgaaaaggtgaattctgtgaaaatgttaacctttaaaaatgtttcacgaatgcttatgagtttggttttggtgggtgcgtcaccgcaagtttatgcaaagttaacactggatgaattttgcaaaatgcgatacgacttagcttttgcgtctataagcgatagaatggatccatctgcatctttaccagaactattaaaaaattttaacatccttgtagaggaagcaaaaacgaagcaaacttataataaaaaaatcttcaaaaacattacttatggtgactatatggaatgggggaaaacggtcatcttagaggcttacgaagagtcagttttatatagtgatgggtttaatgaccgcacaatcaaaagattctcagaaagagcaatggtagattgttatagaaataatggcgaactttaaacaattttgttgtcattcgtagagtaaattcaaaggaacaacacctatcacatgaaacccttgttcctttgataatgattctcaataatcgctctgtaatcaattttgagcgtttttattaatttgtggcttgttagttatggcatatcgtcttgggcttgtttttgagcctaaataggcggctaaattggcaagcctttgctttgatactgtatctgtatatttttctcggtcaaatggacgttgtactgttctaacttggttctcacaagtgtattttgcgagcactttgttaagcaatttcaaatcaagttcggcagtggtgagaatttgaatgtaaccgaccacaccatagttaggctgatgttttaatctcagcatccaaatcatattgatacttttgaatgcagcactgacaggttttttaatcttctgcatcaaatcattgaactcaatggcttcatcaaagttgttataaaatatcgctgtctgatgtgttggcttaatatctttgatgttatttatgagcttacgtttggttttattatgtgctgattctgtcatagtttatactccaataatcatatatctctatatccttataacttcacttcaatatgtgaggcttatcgtgtgattaatggtgcataagttgttgatttacagctattatgcaactgtgattttggtcgagcaaaggactgagaatcacgaaaatcggatagtagtgcggtgagaatcacactaaaacttagacactgcacctaacaaacagctcaagtggactgccaacacgtggcgtcttcggtacggttagcatcagtgattacggttgttaatgttgagtgtggctgtgtgttgtcagccccttagctgggcgttaggatttactcaagttgacagaagcagaaagctatagatttcagatttctgcctcatttttaaactaccttttacttaactgatcgaatattccgccttgcgaaaaatgtttcttatgggcttcatcccatccagaaaacttatctatagtaaataagtttagttctggaaactgcttggaatatttaatggctatgtttttatcccgaggtctataaaagtttttggctgcaatttcctgtcctacaggagaataaagatactcaagatatgcttcagccatagcgcgagttccttttttatcaacgactttatctactatcgatactgttggttccgctaatatcgacgtgctcggaattattatttctacattgtgattttcgatcttattaatagccaataacgcttcattttcccatgtaatcagaacatcaccaatttctcgttcaataaaggtatttgatgaacctctagcaccagtatctaggactttaacattgctatagattgattttacaaattgttgggcatagacttcgtcgttattactttttgtcagtgcgtagcccaaagctgctaggtaattccaacgagctcctccagaagttttcggatttggtgtgatgacttcaatattctctctggttaaatcatcccaatcttgaatgttttttgggttgcccttacggacaagaaaaacaatagtggatgtgtatggagccgaattatgtggtagccgagattgccagtcctttgctatttttcctgagctagcgattgcatcaatatcttgagccaatgccaaagttaccacatcagattcaataccattaataactgtaattgcctgtttaccagagcctccatgagattgatttatcttgatgtgttgtttttttggcttgcccaatatgtagtaaatgcctgattatactcttggtatagctcacgagtaggatcgtatgagacattgagtaaagtggaatcgtttgctagggctgtgcttccgaaagtgagcactgttaaaactaaaagtaatttctgcatcttaatatccttatgtgcgttgggttcacataaattagcatggtgcttatgtattaattacttattttatctgatttcatattcactttggttatattgatgccgtaaacctaacaaacgcctcaagagggactgtcaacgcgtggcgtttccagtcccattgagccgtggtggtttcggttgttgtgtttgagtttagtgttatgcgttgtcagccccttaggcgggcgttatgtgcatggaggcagtaatgaacattggtatctatatttacgatgaggccgaagttctcgacttttcaggacctttcgaagttttcagtacagctaaacgattaggtgctggaagttggaatgtatttttagtctcagaaaccttggaaccagtgaaagccagaggtggttttactgttttacccgactattcgtttcagaattaccctcaaattgacctattaatcgttgttggcggtgtccataggaacgaaatgaataagtccaatgtgcttcattgggttgcatcagtggataagcatgctaaacatattgcatcagtttgtaccggagcattcatattagctaatgccggtttgctgaaaggacttgctgttacgactcactgggaggatattcctgagctgaaacaacggtttcctgacttagtcgttgtggaagataaacgttggataacagcaagcaagtacacaacgtcgggtggtatatctgcgggcattgatatgagtttgttcttggtatcaaagtttcatagtcaaagccatgctgaattggttgctcatcaaatggagtacaactggcaaaaatgcacataacaaacgcctcaatagggactgtcaacgcgtggcgtttccagtcccattgagccgcggtggttacggttgttgtgattgagtttagtggtatgcgttgtcagccccttaggcgggcgttagcttcttaaaggctaaaatcatcaaaatccaaacttcttgttctgaaaaatcagcttttagtgttcaaattgcacaatttggcatttgaattttgctagatgctgatttggtagaaagtgttggaagttccgcagtttcaaagccgctgaaagccaacaagtctcgatgcttcaaagtcgttgaatgttcaattcggtcaacttggtttcacaaaaagcaacatcgtcgctgaaatcgtgcttctttgtcggaaatgcagtaaatggccagcttaaccttgaacgctgcaagttttggcagctcacttcacagcttttggcgttggacgtgtgtttgagtgatgcttctgcgtaaaatggctttcacgaaaatgtgtttaaaaatcattgttaaacaataggctacgaagctaacaaacgcctcaagagggactgtcaacgcgtggcgtttccagtcccattgagccgcggtggttacggttgttgtgtttgagtttagtggtaatgcgtttccagccccttaggcgggcgttaggcacaatccgttgtttgacataagttataaatttttagagaatggagacggctgcgcggttcagagccgctgacatgtaaatgacagtgataaaattctactgaccaaaaggtagaagcctgaactctagccccaaattacaatgaaaaatatcaaatttaaaatatatcatccaacattagatcttgtttcagaccgtactcttcgctcaatacttaaaaagttctccacgttacttcgagagattcaatatcaagaagccttctttttaataaaccatagcaacattactaaatcagaaaaacaatctcttcaagaccgattgaaaggccccctcaatcatattgacgcttactacattgagcatattgaaaaaggtagcatcattatcgaagcagcgctgactgctacaggattgtggcttttaaaaaatacaataggtgagtcgatcaaggaagcttggaagcaatctgacatgcatgaatcgatagtttcttacctatcagaaccacttcagcgtgaaaaagtgattgataggaatgtagatagggttattgatgcatggaatatggatggttttttaatagagactacaacgaaagagaaagttgatgaagatactgtggtttttacagttaatctaaaaaccgatccattacttgaaactcatataaaagataatcttcaacgaatagatactgaattagttatccgagaaattaaatcagaaattgaacgattacgtagccagcagtaagtgcctaacaaagcgttaaagcgggacttggcacgcgtggcatttttggtttgcgttgggtttagtggttaaggtgtgatgcggtcacttttgtattgcgtgcctgcgccccttaacgcggcgttaggcaaataaaggggacaattatgtcagatggtaattctgttattaattttggtgatttagcgaagcctgcaacagttttaattgaaaaggtttcaaatgctatcggtgtactttatgagccaagaagaattcgcaaaaaagctgaagcagaggtagaagccgagaaaataaaggtgcttgctggcatagaactaaatgaaatccaacaaagaggcattgagagatttgtccagcaagaagcacgtaaacaagctaatattgaagcaattacggcacaggctgcttctcaattagatgaatcagctaaaactgataacttagaagaggattggattgcccatttctttgataaatgtgacaaagtctcagatgcagaaatgcaaacgttatggtctagtttacttgcaggagaagcccaaaacccaggaacatattcaaaaaggactgttgactttgttgctaccatggacaagaaagacgcagagctgtttactaatttttgtcagtttgtatggatggttggaggtgcaaccccgttgatatttgactttgaaaatgaaatatataccaaaaatggtattaatttcgcttcgttaaaacatcttgatgctattggtctgatttcatttgaaagtctttcgggatataggcgttttggattgcccaaaaaagctgttttcttctactacggtcagccgactttagttgaatttgaaaatgacaataataacgaggttcaaattggtaaagtcctttttactaaagctgggcttgaacttataaatatctgtggcgctaaacgtagccaagagttttatgaatattcagtttctgagctatctaagcaaggattaatcctgtcgagtttacttgcctaacaaacgcttcaagcgggactgtcaacgcgtagcgtttccagtcccattgaaccgaagtggttacggctgttggtttaagctgtgcggtagcgttgccagccccttaagcgggcgttatgcagcttagtgataataattaaggctaggtgttaaacatgaaaaggattctaagttttacattaattgcagctattcagggatgtgcaaatgaaccgagcgtgtcgcagccaatatcatctggactgtactgtgttgggagtacggctctaagtggtgagttaagcgataagttcacacctgttcaagatgaatcactactttctcaagcaatcggagaaccattacaaggcaaattgtgtcaaggttcggtttatgaaagcacacaggatgtgattatctatcgtgcatggaacagcacaaatcctaaaagccaactaggtcaatggtggtcatttgagcttccgtctggttatacagcagactataggaagaattttgagatttgttaccagtggtcaccgttggataaattggcaaaatgcaccttgaaagcaggtacaaaggttgtcgtcggcaatggccaaagtgcaaaatgttcagagtatctaagttatccggtatccgagaagcagcaagtattcatttcagagggggccagcgtagtagaaaattgtcaggtttatgacagtgtaatgagttgggaataagccaaacgttgagccgctgcataacaaacgcctcaagagggactgtcaacgcgtggcgtttccagtcccatttagccgcggtggttacggttgttgtgattgagtttagtgttatgcgttgtcagccccttaggcgggcgttatgcaacattggggattaaaggtgagtgacttattttcgacaataattattgtggctattgggttaacaattttagctgtcatagtatcgtctattgttaatttttatagagattggccgattttatctacagcttggagtcgaatggaattattcgaaaaacgtttgttttatattgggatttcattttttattctcattccagcgctaaaagatcaccctgcagcgaacacctacatttcaagggtattaatagaaatccttccagctctggctggtagttttttcgttgctggagtagttagctttatgcggcaagttcacgatattcgcaatcgcaatggttgatcttatgcataacaaacgcctcaagagggactgtcaacgcgtggcgtttccagtcccattgagccgcggtggttacagttgttgtgtttgagttttgtgttatgcgttgccagccccttaggcgggcgttatgcttaatccattaaaatcaagtgtttgtggttttcgatttctttggcattttgttcatgttttgtcggcaattcaatattgtttgtcgctgcctaacgaagcggcaatgtatctggcgctgtaaattcagagttattgcctcattggaatgttgagcctgcgcgaggtgagttgggctctctcaagtcgctttgaacagtttggtgcctttacttacaggctgaaagttagtcggcaattgagcattgtttttcgctgcctaatgaaacagcaatgtgtttatcgctgtacgtttcagcgttattgcctcattgagttgtagcaccaacatgttgtaagtggggttgtcggagagggtttccacattggctgatgtgtaggatgaaatcctgttttggtcagttcataggtaaaatttgagtcggttctaattcgagaaactctgtggtttggtgaatgatttcagtgagttattcttgagttggttcaaaggtaaagtgttgaagcttaagcataacaaacgcctcaagagggactgtcaacgcgtggcgtctccagtcccaatgagccgcggtggttgcagttgttgtgtttgagtttggtgctaatgcgttgccagccccttaggcgggcgttagcctaataccaaacacaattaccattgtaaggaatcaatgctatatgcaagtatctgatataggtttaattttagatatgctagcagtctttttactagcaaagtattcgttgcctaaagagcccctttacccagatggaagtgaatcattagttgtaggacttacacagcctgagcgtactgctaacatcaataaatacatcacgcatagaacaatttctaactgggcttatgggcttttagcgtttggtttcatcttacagttatctctcgttgaaacgttcttaaattttgttgttcagagtctggagtaagttattaggctaacaaacgcctcaagagggactgtcaacgcgtagcgtttccagtcccattgagccgcggtggttatggttgttgtgtttgagtttagtggtggtgcgttgtcagccccttaggcgggcgttagcttcttaaaggctaaaatcatcaaaatcccaacttcttgttctgaaaaatcagcttttagtattcaaattgcacaatttggcatttgaatttttctagatgctgatttggtagaaagtgttggaagttccgcagtttcaaagccgctgaaagccaacaagcctcgatgcttcaaagttgttggatgttcaactcggtcaacttggtttcacaaaaagcagcattgtcgctgaaatcgcgctttctttgtcggaaattcggtaagtggccaacttaaccttgatcgctgcgagttttggcagctcacttcacagcttttggcgttagacgtgtgtttgagtgatgcttttgcgtaaaatgcatttcaagcaaatgtgtttaaaaagtcatttttaaacaatgggttatgaagctaacaaacgcctcaagagggactgtcaacgcgtggcgtttccagtcccattgagccgcggtggtttcggttgttgtgtttggtttggttgttatgcgttgtcagccccttaggcgggcgttatgtgttttcctagaaaatggagtttctgatgaaaattagtcaccttgatcatttggttctgactgttgcagatattccaacaacaacgaacttttatgaaaaagtgttgggcatgaaagctgttagttttggcgctggtcggattgctctagagtttggtcaccagaagatcaatcttcatcagctcggtaatgagttcgaacctaaagctcaaaatgtcagagttgggagcgcagatttgtgctttattaccgacacagttctgtctgatgcgatgaagcatgtggagaatcaaggtgtgactatcatggagggacctgtaaaacgtacaggtgcacaaggtgcaatcacatcattctatttcagagaccctgatgggaatcttattgaagtatcaacgtattcaaacacataacaaacgcctcaagagggactgtcaacgcgcggcgtttccagtcccaatgagtcgcggtggttacggttgttgtggttgagtttagtggtaatgcgttgccagccccttaggcgggcgttagctctctttcaaagttcatcgtggagtccaaaaagccaagctggatttgaaattttttttagcgatatttcaggagatagtatgagcacaaggttttgtgaaaagtgtgggaagaacactgaacataaagaggtgatgaagcaaaagccatcgaagtacggtaagtcaaaaagagagcagttcaaggcatttctagatggattttttagtagttcggcagcctctttacctggtggcgtttcgctagaattaacagatagatatgttgtttgtgctatctgcggcagcgcaactttagaaaatcatggtgaacaatttcagtaacctattcgctaagctgagagctaacaaacgcctcaagagggactgtcaacgcgtggcgtttccagtcccattgagccgcggtggttacggctgttgtgtttgagtttagtggttatgcgttgccagccccttaggcgggcgttatgcgacctaggaaaaaggagtttcgagtggaaaaaataattgatgaattagttgcgcagggttatgaagtatctggtagcagttcaagtattcgagtgaatatgggtgtattaacgggcaaagccattattcgtaaaagtgtctattcaaatacttttgtagtgtcgactcatacttggactcaacttatagctttgacattggtattttcttcaattctatcgtcgattttcagtcagtggggacagcccgagctaagtggtgcaatgtggtttagtttttcagtcggcatccccgttgtgataactggttttgtatcggcaattattgcggaaattcagttacaacctattcgtcagatcgtacgaatggtaaattcaaagctatcaccaccagtcgcataacaaacgcctcaagagggactgtcaacgcgtagcgtttccagtcccattgagccgtggtggtttcggttgttgtgtttgagtttagtggtaatgcgttgccagccccttaggcgggcgttatgtgtttttctgaaaaattttcacagctctgcgcttataattcagacgtgaggtgcattatgtctgaaaatcaaaacgttaaaagagctgaaccaattgaaacttgttcatataaaagtccttgtgttcgtcattgttgtttagatgacaaagacatctgcataggttgtggtaggactcttgatgagatatgtcgttggagtagtgcaacaaatagcgaaaaacaagagatattaatcaatagtgtagctagagttcagagccgaaatatatcgatatgaagcatcttagtcttgtgtatatgatggtttttatcgaatgctgtttggcataaatgcctttcgctacccctttaaatggaagggtgggcatcagaaacacacacataacaaacgcctcaagagggactgtcaacgcgcggcgtttccagtcccaatgagccgcggtggttacggttgttgtgattgagtttggtgttatgcgttgccagccccttaggcgggcgttatgtgcttttctgaaaaattttcacagctctgcgcttataattcagacgtgaggtgcacgatgtctgaaaatcaaaaagttaacagagctgaaccaattgaaacttgttcatataaaagtccttgtgttcgtcattgttgtttagatgacaaagacatctgcataggttgtggtaggactcttgacgagatatgttgttggagtagtgcaacaaatagcgaaaaataagacatattaatcaatagcttagctagagttcagggccgaaatatatcgatatgaagcatcttggtcttgtgtatatgatggctttttatcgaatgctgtttggcataaatgcctttcgctacccctttaaatggaagggtgggcatcagaaacacacacataacaaacgcctcaagagggactgtcaacgcgcggcgtttccagtcccaatgagccgcggtggttgcagttgttgtatttgagtgtagtggtaatgcgttgtcagccccttaggcgggcgttatagctcttatctgaactaattcttgccatctgtacgcttggtgcgtacacttcctatatgaaaagtgtatttgtcgaatcaacaatttttgaaaagtaccgagatgaatatctcagtgatgaggagtataggctctttcaagcagagctaatgctaaaccccaagctgggtgatgtgattcaaggtactggcggtttgcgaaaaattcgagttgcgagtaaaggcaagggaaagcgtggtggttcacggattatctattactttctcgatgaaaagaggcgtttctatttgctaaccatttacggcaaaaatgaaatgtctgacttgaatgcaaatcaaaggaaacaactaatggcttttatggaggcgtggcgcaatgagcaatcgtgatttatttgcagagttaagctcagctcttgttgaggctaagcagcattcagaaggtaagcttactctgaaaacacatcatgtgaatgatgtgggtgagttgaacatctcaccggatgaaatcgtgagtattcgcgagcagttcaatatgtcccgcggagtcttcgcgcggttacttcatacgtcttcgcgcacattagaaaactgggaacaaggtcgtagtgtgccaaatggtcaagcggtcactcttttaaagttagtacagcgtcatccagaaacgttgtcacacatagccgagctataacaaacgcctcaagagggactgtcaacgcgtggcgtttccagtcccattgagccgcagtggttacggttgttgtgtttgagtttggtgttatgcgttgtcagccccttaggcgggcgttataagccaaggagaaattgtggttacatttagggaaatggatatttccgattacaacgaagtgattgctttatgggctactactgaaaacgtatccctcagagatgccgattctcggccaaacatcgaagcttatttgaaaagaaatcaaggtttaagctttgtcgcagtttcagattctcttgtgattggcgctgttttggttggtacagacggtaggcgaggttacgtacaacatctggcggtctcatctgactttcgaggccaagggattggtaagtctttaattcaaaaagcgacagatgcactatcaagaataggcatttctaagacgcatttgtttgtgttgattgagaatgttgtggcacaggacttctataccaagttagattggtacccgagagatgaaatccgaatgttttcgtacaacagttcgagtaacccagaagtctagggttcgggcttataacaaacgcctcaagagggactgtcaacgcacggcgtttccagtcccattgagccgcggtggtttcggttgttgtgtttgagtttattggtatgcgttgtcagccccttaggcgggcgttatattattgccattctagtatttgggataaataaatgaaaaagacattagggattttaattttaactcttttatcagtacctgcgtattcagctattcgaaatagtgaaataagagaccttgagaaagagattatcaaaaaagagtggccagcatgtttaacgcctaaggaagctgcgattaagtggtgactgaactgctccaagtcgcacgacagtgcgatcgctgactttttactcgtaaaacgagtggtattttgtcgattccgagcgtttcaagccactttcagccgttttctccggctattggcggatttcaggcagatctcgcctgtcgtcgtatcagttggtcgactttgaccagattcgccaaggtgaatagcatggctaattggttgtcgtttttcatcaggcctttgtagcgggctttgataaaaccaaactggcatttaatgatgcgaaacgggtgctcgactttggcccgaatgctggctttcaagtattcgatatggatggccactttgtttttgcgagggtgctttttcagggcgcgaactttaccgggacgttcggctatcagccaatcaacgtctgcccccttcagctcgtcgcgcttgtgtgcaccttggtagcctgcatcaccggagacgaattcttcatcaccgtgtagcaggttgctcaattgattcagatcatgctcgttagcggcagtagtcaccagtgtatgagtgaggccacttttggcatccacaccaatatgtgccttcataccgaagtgccactcattgcctttcttggtctggtgcatttcgggatcacgttggttggttttgttcttggtcgagctgggcgcttcgataatcgtcgcatcgaccaacgtgccttgcttcatcagcacgccgcgctcgctgagccattgattgatcggctcgaacacactgcgtcccagctgatgctgctctaacaagtggcggaagttcatgatggtagtgcggtcgggaatggctctgtccagcgaaagatgggcaaataaccgcatggacgcgatctcatagagtgcatcttccatcgcttcgtcacttaagctgtaccactgctgcatacagtggatgcggaacatggtttcgagaggataagggcggcggccattgcccgccttgggataaaagggttcgatcaccgcgagcaactgagaccatggtaggagcttctccattctggcgaggaagagctctttgcgggtttgtcgacgtttattggaaaactcaccgtctgcgaaagtcagttgatgactcatcggtcacctcatccttgctgttttgatggttgctatgatctcatatcagagacttaatcgcatcttcccttataagggagatactgtaattggtaatgacgtctggttggggtatgagtcaactattatgcctggaataacgattggtgatggtgcaatcgttgctagtaagtcagtagtaacacaagatgtgccgccttatagcattgttggcggaaatcccgcaaaggtttttaaacatcgttttgagccacatgtcgtagataaattgttagcaattgcatggtgggattggagtgcggagaaaataacggaaaacctaaaagcaataacacaatgaattagatttgcttttagcggaaagtggctcataacaaacgcctcaagagggactgtcaacgcgtggcgtttccagtcccattgagccgaagtggttacggttgttgcgtttgagtttagtgttatgcgttgccagccccctaggcgggcgttataacctaatgggaaatcatgaacttagaagagtttcaagaatcggattttgacctgcttataaaatggattgactcagatgagttgaactatttatggggttgccctgcgtatgttttcccgctgacttatgaacagatccattcccactgtagcaaagcggaagtatttccctatctgctaaaagtgaaaggtagacatgccgggtttgttgagttgtacaaagtcaccgatgagcaatatcggatttgccgtgtctttatttcaaatgcttatcgtgggcaagggctatcaaaatcgatgttgatgttattaatcgataaagcccgattagatttttctgcaaccaagcttagcttaggcgtttttgaacagaacacagttgctagaaaatgctatgagtcattaggttttgaagtggttatggttgttgtgattgagtttggcggtatgcgttgtcagccccttaggcgggcgttatgttttttatcacgttttggggctataatcggcctaacctttattgatagtaggtgtgatatgaatcgaaaagttgaagcttacggcgttgatgctgttgaaagaccgaaaattaaggctagtaaaaagcttgatttgactggtgatgctggtcgtcaaattgtgaagtctgaaactaaacttgctttgcgtactcatcagaagacattcactaaattggctgatatgtaatggatatcatctgttttccttttgaacgagtgatcgagattaatgctttcatcctaaaaacagaaccaggaatgaaaggagccgttgatattcccaagcttcagggggcattaggtcgaatcgataatgccatcgtttatgaaggactggatgatgtttttgaaatcgctgctaaatacactgcttgtatagcggtttcacatgcgctacctgatgcgaacaaacgcacaggtttggctgtggcacttgaatatttatcacttaacgattttgagcttacgcaggaaaacgatttacttgcggatgcagttcgagatcttgttatcggcattatcaacgaaacagattttgccgacattctctacgcacaatacgcaaaagaacaaaattcagctctctaaacataacaaacgcttcaagagggacagccaacgcgtggcatttttaccatgcgttggcctttgtgattacgatgttatgcggcaagttggtagtagcgttggctgccccttaagcgggcgttatgtgctttctcgaaaaatctcgaagtagtgtagaattcagcttttgaaatcttgagaagtcagcatgtctaaagtcgttcaacagcaaatcggcaatatcgcgcttgtcgtagaaaactacgatgatgctattgagttctatacaaaaaagcttcagttcagtttagttgaagataccgatttgggtggtggtaaacgttgggttcaagtttcgccgccaaactcgaatggaacgaacctacttcttgctcaagcaagtaccgaagaacaagctcaatttgtaggtaatcaaactggaggccgtgtttttctgtttctacaaacgaatgacttctggcgagattatgagttaatgaaggccaatggtgttgtcttcaacgaagaaccacgagttgaagagtatgggacagttgttgtgtttcaagatctttatggaaacaaatgggatttattgcaactgaacaaggctcacaaatagcacgcatataacaaacgcctcaaagggactgccaacgcgcggcgtttccagtcccattgagccgcggtggtttcggttgttgtgtttgagtttagtggtatgcgttgccagccccttaggcgggcgttgtgccgctgtcgcaaaaaaacaactaccacagaattaaattaaggtctaaaattaggtctgattttgatgcttatatggtgttttatgagacaagttttagcgaattgctctgcaagtatttcagagttaaagaagaacccaacagctttgttgaatgaggctgatgggtctgcaattgcaattttaaaccacaacaagccagcggcttaccttgtgccagcggaaacgtatgagtatctcatcgatatgctcgatgattatgagctttcccaaattgtcgatagtcgccgagctgacttagcacaagctgtggaagtaaatattgatgacctataagttaaagtttctgccggctgcgcaaaaggaatggagtaagttagctccgacaattcagagtcagttcaagaagaagttaaaggaacgattagaaaatccgcacgtcccttcggctaagcttcgaggatacgacgctgtttacaagattaaacttcgtacggcgggttatcgtttagcttatgaggttattgacgatgagatagttgtctatgtccttgctgtcggtaaacgtgacaaagatgctgtctataaaaaactggcttcacgcttcggttagcggcacaacaaacgcctcaagagggactgtcaacgcgtggcgtttccagtcccattgagccgcggtggttgcagttgttttatttgagtttagtggtaatgcgttgccagccccttaggcgggcgttatgaggaatatggatatcaaattacgaccaatagaaagtgaagagttcgatagtcttttttctgttgtaaagcagggaatttattcacacgttgatgctgtttttggttgggacgatgactttcaacgtaaacgtctaaaaagagactatgaccctagttggttttactgggtacaacaaggaggtcagcgaattggcatgttgtgtttcaaaccttatgacaatgtaattcatgttcatctacttgttgtttttcccgagtttcagaaccaaaagtttggggaaaagataatgagttatgtccataagctcgcggacgctgaggggagaaatcgggtgacgttatccagctttatccgaaatgaggccgcggtaagattttacaaatcgcttggttatcagcttattgatagtgacgagcacttttattctttgtcgcttcaaatttcctcataacaaacgcctcaagagggactgtcaacgcgtggcgtttccagtcccaatgagtcgcggtggttacggttgttgtgactgagtttagcgttatgcgttgccagccccttaggcgggcgttagtttctatctagaaaaaatcatcaaaagttcagattcatgccctgaataatcagctttaaacgttcaagtctcactatttggcttttgagtttttcctgatgctgatttggtagaaagtgttgaaatttcagatagttaaaagtcgctgagaaccaacaaacttctaagcttcaatgttgtcggatattcaacacggcaaatttggtttcacaaaggctgcatcatcgctgtgatctggttttctttgtcgtggactctaaacatgaccaacttaaccttgaccgttttgagttttggcagctaacttcacagcttttggtgttggacgtgtgtttgttcgatgcatttgcgtaaaatggtcttcaaacaaatgttttaaaaaagtcattgttaaacaatgggctacgaaactaacaaacgcctcaagagggactgtcaacgcgtagcgtttccagtcccaatgagccgtagtggttacggttgttgtgtttgagtttagtgttatgcgttgccagccccttaggcgggcgttagtttgctaaaggtagtggataactagcctaagcttgctctgatatcagcaatggtgatgaagagtttgttttcggcatcttgaaacgcttgaaacccatagcgctcatagaaatgttttgcaccatctttggcatcaacaatgacaacagggaacgctacactgtcactggctgcgagtagctttctgagagcgtcaatgagtagccactcaccaaaaccttttcctttgtatctatcgtcgacagctaaacgagcaatgagccctccagaggttgaggattggtgcttcttttgtaacttgtcgggcaaggctttcaaatcaatgggcgtcatagtcagagtgtaaaagccgatgatataagcactgttattgtcatcttccaaaacgaaggttctggtgttgtcttttttggcttgctgactcgccattacttttaagtaattgttgagtgcttcagtgccacaattgaaacggttcctatcgtgcttatctttatcgagaagtaccgtattcatcattgagttttgctctcataacgttcggatgccaatttgagctttgcatttactacagctggattatcaagagcttccatcagcaatacggcatcagcttggctaagctttagagcttgctcacgttcaatgacttgttttgctttttcgattgctgcattcaaaacaaatgagttaatactagacataccagcaagagcagcagccttagcgagtaaatcttgagtatcgacatcaactctagcggtgatgcgaggcaaagtcgttgccatagttttatctcctgttgtgtcaaactgtcacatgggcattatggcgttaaagtgttcaacaagcaatctttgtgtcactttggcacgcaaactaacaagcgcctcaagagggactgtcaacgcgcggcgtttccagtcccaatgagccgcggtggttgcagttgttgtgtttgagtttagtggtatgcgttgtcagccccttaggcgggcgttatatgaataggaaacatatgagtaaacagtacgataaagaagaatacataaagaaatttgagacagataaatcgcactctattttattacagtcggcatttgctcaagcttcagatatacgaaagtttgaaatcgagctttactggaaaagagcgacgtatttttgggcattgatagcggttgcctttgccggtttctttgccgtagcttcaggagattttaaaggtggtggtcagtcgctgttcctaacaataattgcttcaactggttttgtttttactttcgcttggttttctgcgaataaaggtagcaagtattggcaggaaaactgggaaaatcatctagatcttctagaagatagcgttacagggccattatacaaatcctttttggaacgaccgcctgaaagtgagttctgtaaaaaatatataacaggccctcaacgatactctgtttctaaaattaaccaatgggttgctgtctttacgttgtttatctggtgtgtgttagtgatcttttcactatcgacatacaaagaaaattgttcagttgggtttgtttttcatgtgttaattcctattactgcgttagcactgtgccgaataatgatctcaaaaggcaaaactcatgatggctcgcataaccctaagttttggttgcgagaagttaacgtgacgaaagattaaattcatataacaaacgcctcaagagggactgtcaacgcgtggcgtttccagtcccaatgagccgcggtggttacagttattgtgtttgagtttagtggtaatgcgttgtcagccccttaggcgggcgttagttttagaaaggagttaatctttggaaaatgcattaaatgccatagcggaagccataatatgtactaatgcagattctgttgcttatatatctgcgggatctggcgtgattgtagagtttatctctggtgtattcttctggctctatagtaaaacaacacaacaattgaaaggctatcacgatagcttagttgatattcagaatgtattactctcattcaaagttgttgaggatactgctgataaagaaacaaagcttgagatggctaaaataatgataacgtcattaaatagtgcaaaaaatgcataacaaacgcctcaagagggactgtcaacgcgtggcgtttccagtcccaatgagccgcagtggttatggttgttgtggttgagttcagtggtattgcgttgccagccccttaggcgggcgttatgtgttttgtgggaagttaaatgcaacatcttgataaattgcttgaagtagccaaacgaaaatctgaattcgacaagaataattcttggtatttaggctcatctacttatctggctgagattaaacaagaagtcgatgaagttgtcgaagaaatccctaagaatcgactctgttacctcgaagatgaattaggtgatgtgctgtgggactacctaaatacgatcctgtctctcgaaaaagaggcaggagttaagattgagtctgtagtccaaagagcatgtcggaaatatgaagaacgtgtatctgcaatcgagaatggtatttcttgggatgaggtgaaactcaagcagaaaaaagagctagaacaagagcaatcatcagcacacacataacaaacgcctcaagagggactgtcaacgcgtggcgtttccagtcccattgagccgcgatggttacagttgttgtgtttgagtttagtggtcatgcgttgtcagccccttagacgggcgttatattctccctcgccccgtaaactttccgtacgaattgaatgtgctttaagtttggcctataatcgctcaactgacggaatgtatccgtacgcaggaggggttatggcaacggcacgtttagatatccgccttgatgaagagatcaaggcaaaagctgaaaaggcatcggctttacttggtttaaaaagtctcactgaatatgtggtgagacttatggacgaagatgcgactcatgttattgaggagcatgaaagtattatggttaaagacagtgtttttgacgagtttatggctgcgtgtaataaagtaaaagcaccgaatcaagctttgcttgaagctgttaaatttacagagaagagcggtatcaagtgagttggggcaaagagtttgtagaacttagtaaatcaaagcatgaccgcgactcatttgactgtggtgagcaagagctaaacacatttatcaaaactcaagctgcaaagcacatgcaagcaggtattagccgaacaatggttttacctagtgctcacccactgttaaatcaaaaattcgctatttgtgccttttatagtgttgcaccgagctcaatcagccgagaaacattaccggcacaattagcaaagaaactaccgaggtatccaatccctgtttttctgttggctcagttagctgtgcacaaagaatttcacggttctggacttggaaaggtcagtctaatccgtgcgctgaagtacttgtgggaagtgaatcatcacatgagagcatacgcaatagttgtggattgtctgacagattccgctcaagcgttctatacgaagttcggctttgaagtattgtgcgaacataatgagcgtattcgtatgttcttaccgatgaaaacggtagaacaactttttaatcaataggctacgaatataacaaacgcttcaagagggacagccaacgcgcggcatttttactatgcgttggtttttgtgattacggtgttatacggtaagttagtagtggcgttggctgccccttaagcgggcgttagccgtttgaaagcttgctatgcttagagtgatagaatagtatcactttagtatttctttggagcagctcaaatgaaagtagaacttgtgacgtcactaaaacgtcaggccactaagatccttgccgatcttcatgatacgaaagagccagtattgataactgagcacggaaaaccgtcagcttaccttattgatgtagacgactatgaatttatgcaaaatcgtttagcgatcctggaaggtattgctcgcggagagcgagctttagcggatggtaaagtggtcagccatcaagatgctaaggacagaatgtcaaaatggttgaaataatttggacggagctggctctatccgacttgaatgatattgctgaatacatcgcgcttgaaaatgtcgtggctgctaaacaactggtgcaaaccgtttttacaaaagttgaacgtttggccgattttccagagtctgggcgcgtccctccagaactagaacacctcaattatcgtgaagtcgttgtaagtccgtgtcgtgttttctacaagtatgatgatgcaaaggttcgtattctttttgttatgcgtgcggagcgagatttgcgtcggttaatgcttacgaaacagtaggtttgaaaaaaacggctaacaaacgcctcaagagggactgtcaacgcgtggcgtttccagtccaatgagccgcggtggttgcagttgttgtatttgagtttagtggtagtgcgttgccagccccttaggcgggcgttatgtttaatcagtatcacaaattgccactgtttttatatacagttttatgtgttcggctatcatctcgagctttgaacacattcgaagaattaaatatgaccaactatctagagcgtggcattaaagaactcgttgaagagttcatttctagtggaaaaccctgtccatcaaaacaaactatttctgagcgtcgggcaggttatctctcaagtacggttttggctggctcaagtcctgaaatggccgatgagtttgttgatgagctggatggcatacaagtcaaagtttataagccaagcgataaaattgatttgccaattacaatttattttcatggcggttgtttcattagcggtggttttgaaacacatgaagcacaactaaggcagttagctcatttatcagagactatagtagtttgcattaagtaccgcttagcaccagagcatgcatacccatcagctcatgatgatgtatttcaggccgcattaggtatcaaagaacatggtcataaatatggcggcgatactgaacatgtattctttgtcggtgatagtgcaggtgcacaattagctcttgctacagcacttcgtttgaaaataaaaagctgtggctacctgagaaacaaatcctaatatatcccatggttgaccccttgggggtgtctgatagttatcagaaaaacggtacagatttcattattactgcacaaatgttgttgtccggtttccagctttatgcgggtgagtcagagcggttggccagtgaaaaagaactgaatctattggcacgaaaggatcttcaaggtttacctccaaccttgattatcactgctgagtatgacccactgcgagatgaaggagagcagttgtacaggttgcttctttcccaaggtgttgacgcttattgtgaacgttacctaggtgtaatacatggtttctatcaactgtcgggtgtaagtgagtctgcaaggcgttgtattagaaatattgcaaatgcaatcaaaaattaaacataacaaacgcctcaagagggactgtcaacgcgcggcgtttccagtcccattgagccgcggtggttacggttgttgtgtttgagtttagtggtaatgcgttgtcagccccttaggcgggcgttaaatgcacaagtgaacagtttggatttacggatgaacagaaatatagagtttagaactaagaaattgcactcgaaaatagtgttgtccatggtggcgagttatgtggtttttactcttgtttttaactggttcaccgaaactgaatttcaactatggtcattccttgttggagtgacaactatggttgttatctatttatttttagccctattcctatttaagaaggcacatttgtccgttacgggaggagacgtttttctccatggtctaaaagccgagttgatagccaaaagaggtatatttggaacgcagtatattcaaattacctcaaatacagagaagggctatcatcggcttaaagttactaaggatcagattgctcttgcagactggaatcttttattaggaaagtgcatttaacaaacgcctcaagagggactgtcaacgcgcggcgtttccagtcccaatgagccgcggtggttgcagttgttgtgcttgagtttggtggtaatgcgttgccagccccttaggcgggcgttaggtttaaggttgctcatggaaatcaaagagtttagtgcctgtaatctcgaatcgttgagaaagctctacttggactctagacgggatagtttcccatggctcaaggcggatagttttcggatagaagacttcgaccgcgatagtcaaggtgaacgaatttggttgtctgaggttttagggaatgttgccggcttcatttccatttgggagcctgacaattttattgtcatccctaaaccaccgcttttagcggtggtaattgtccctaggggcttttgcccgaaaatgcgcccatgttagaagacaaactcttattcaccataagtaagaggattcaaataacatgggcgactacagaagttcatcacacgtctattggcgttgcaaatatcatatcgtttggacaccaaaatttcgttttaagatcttaaaaggtaatgttgccaaagagctaaatcgttcgatctacattctttgtaatatgaaagattgtgaagttttggaactcaatgttcagccaggtcatgtccacttagttgcgataattccgcccaaagtatcgatttcgacgttgatgggagttttaaagggtaggagtgcaattaggctattcaacaagtttccacatatcaggaaaaagttatggggaaatcatttttgggcgcgaggctattttgtggatacggtaggtgtaaatgaagaaatcattagacggtatgtacggcatcaagacaaaaaagagcttgagcaagagcagcagttagagttattgagagactaacagcgtcgtggcccccttttagggggcttatattaaaaccgccttctaagaaggcggatttttattcatcatctctatgttgcaaccgaatatcaggggcaaggtgtgggctcgatgctgcttaacggtgcaaaaatgaaatatggcaatttaagccttaagtgcatggttcaaaatcaaaaagcactcaacttttatttgtcgcaaggttttgaaattgtgtcgcaagtggatgatgaattgggtggttattactacatgagcttcgtagcacaaacctaacaaacgcctcaagagggactgtcaacgcgtggcgtttccagtcccaatgagtcgcggtggttacggttgttgtgattgagtttagtggtatgcgttgccagccccttaggcgggcgttagttttttcttgacttcagatgctcaaagtactaaattcttagtgggacgcgaggcgtggtttcacgaagcgctccacttccgaggctcgacattaatggtcgagctttcgtgtatctggaggctggtaaattgctttacattgtatatcttgacgaatttggtcacatcggcccttacttgtcttctaccgacaaaagccacaaaacacatcctgtatttgggttgggtggagttgtcctaccttatacagaagttagaaaattctcgacatacttctaccagcttaagaatcgcctgctagactacgagctaaaaaatagcggcattcaccctgcaaagtgggaaaagaaaggcgcttcattatacactgtgactaatgttaccaaatatcgacagttaaggcaggcgacttttcggctactaaataaggtaaaagcatctggaggctttataatttatgtcggtattgaaaaagagaggagagttgatggccatgattccaagcgactttatcactctgtattaagggaagtcataaagtgtattgatcaagagtgtgaacagcgtgacgcaaagtttatgcttattctagatcagcaagaagaaaacgttctccgtggtgaaattgttgaaactgcatctgttgcaatgtttggtgatgatgctcgttatcgcttgatagaacctccagtacaagtcgaaagccatttatatcaaacggttcaatgtgcagattggctgtgtggtctttttggaaggctagctcattatgaatgtgagcctaccgttaaagcagactacaaagcaattcatgactactttgataattgtatccatcaggtttcgactcgaagtggtatcaaaaagctaaagtctcgtccaactgctcataatctacaaaaattggtagataaattttcttcctagcgcccaaaactaacaaacgcctcaaagggactatcaacgcgtggcgtttccagtcccaatgagccgcggtggttatggttgttttgtttgagtttagtggtaatgcgttgccagccccttgggcgggcgttatgtttttcggagttaaaatggacttgtcactttatagcgcaaagggttccaacagctcagaaagggttgaatggatgcttaatttcaaaggtatcccgtacgaacgaattgaagttagctcggacgaccttgctacgacttatcgtgtgatgaatccatttggctatgtgccttcgttgttagttgatggtctagtatttactgagtcaatggctattgccgaatacctcgaagagcgatttccaacgagtccattgctaggtcaaagtcttgaggaaaaaacaaaaatccgctcagtttgtgaatacgtgaactccagtattcattcacctcaaaaccgaactgtgcttaacttttttaggcccgacctagatgaaacatccaaacggaaagttcggggagagtggattatgctgtgtcttgataagttaagtcagacgatttgtaatgaatcaggttttattattggtcggacttttagtcttgcggatatttttgtagcgtcaatttacaagaaagctctccagcatggttatgttgaaagtgagttttataataaccatctgatctacattagaaaaaatgaaagagtagccgtttcagaaccacaaacataacaaacgcctcaagagggactgtcaacgcgtagcgtttccagtcccattgagccgcggtggtttcggttgttgtgtttgagtttagtagtatgcgctgccagccccttaggcgggcgttatatgcttataggaattgtctcctaaaggatacgctgctatagtccctttagagcgatgaactagaggtggctatgccagagattgatgccctattaggtctttcattttgcttgtacttctttgataacaagcagcataaattacctcatattcacgttaagtacggtagttacgagctaattattgctattgaaacaggtgagtgtttagagggttacttacccaataagcaacgaaaacgtgctgaaaaccatattcttgaacatcgagagcaattgatggtgatgtggaataaagcggtgaatggtgaaaatccaggtaagttaggtgatttatgttgaaagtcatagatgttgattttgtctcagaccatacattagaactgacgttcaatgatggttaccaaggctatgccgacttgtcggtatactttaaaaaagcaccgttttcagaaattaaggactttaaacgcttttccttgactcgtgatggctcgttaaattgggatggtaatgagttaacggccgcgacactccgtgacataaccaagggctcacaaaagtcggtggagttaagttttaatgttcaagaaatggaagccgtcatcaaacaggcctcatgggaatcgatgatggaggggcgtcccgacatcttgcaagcggctattcgttcttacgtagagcagtttggtcatggtcaagttattgcaaaggcgggtataaaaagtcgtacgagtgcttatcgctccttgaagccagaaacaacgccaaactttggcacactagttcagttagggcacgccgtcatcgaactagcgaaagatagaacagtggcaaacaaggaaccacgcatataacaaacgcctcaagagggactgtcaacgcgtggcgtttccagtcccattgagccgcggtggttgcagttgttgtgtttgagtttagtggtagtgcgttgccagccccttaggcgggcgttagtttctctcaatcaaaaatcatcaaaatctaagctcatttgcattaaacatgcagcttttagtatccaaatttcacaagttggcttttgagttttgcttgatgctgatttggcagaaagcgttgaaaacgcagtagtttcaaagtcgccgcaagccaacaagtcaagatgcttcaacgttgttgggtgttcagcgcggtcagcttagtctcacaaaaggcagcatcatcgctgtgatctggttttctttgtcgcggactattaacagtggccaacttaaccttgatcgttttaagttttggtagcttgcttcacagcttttggtgttggacgtgtgcttgtaagatgcatttgcgtaaaatgcttttcaagtaaaggtgttaaaaaaccattggtaaacaatgggctacgaaactaacaaacgcctcaagagggactgtcaacgcgtggcgtttccagtcccattgagccgcggtggttatggttgttgtgtttgagtttagtggtagtgcgttgccagccccttaggcgggcgttagttgctcaggagaaaaaatgaacgattatgaccagaactcactaaaaattttagtcgtgggtccaggtaaagagtttttcgatgatgtttaccagtccgaattcagcgaatttagagaacacgatctctctctaaatgtatctgagggtttttccgcccccgcagtgacggaagttctaatttctatcggtgccaatgtcgttgcaggcttgagtgtttactacatatcaaaagtattcgataaaatatttagcgctaaggctagagctaaagaacagggacgtgaaatgcatatccacgtttcaatatcagaaaagctaattattaaaaacgttgagagcacctctgaaattgagcgctcagttaattttgttatcgaaactaaaggtgacaatgttcaaaaacgcagctaacaaacgcctcaagagggactgtcaacgcgtggcgtttccagtcccaatgagccgcggtggttgcagttgttgtgtttgagtttagtgttatgcgttgccagccccttaggcgggcgttagttgccaatcagcaacaaatcagtcgtttggaaatttttgtttctgatgtagtacacgcattattcgaattttagaaccatcaacccaatacgaaacaatcattgatatctcagggataataagcaatctgcctctaatgccatcacgctgaacaccgattagtggttgctcaagcaaattttcgactttggcttctatgagctcatccgtttttttagccgctgctgggttaaagtcgtagagaaattcgaaaattttctcacgatcattgagagatgcttcttcccagaaaatcatgcgtggcctcgatttcggattttagctttacgttcagccattcgtgctttggcgatgtcatgttcaatgaatactgcttttcctgagtcgaacttctcaaatgcttgattcacttgttcagttagccatgcatcgtgagataatgccttgcgttgctgctcagctaattgttcagtgagttcacggcaagcatcgctaagagttcgaccttggctttcagccatttgttgagctaaacgttttgtttcttcgtctacacgaaattgaattctagtatccatggtgagctcctttgttgtgtgtacgaatgttagcactggtgttggggtagggcaactaacaaacgcctcaagagggactgtcacgcgcggcgtttccagtcccattgagccgcggtggttacggttgttgtgtttgagtttagtgttatgcgttgtcagccccttaggcgggcgttatgcagttatttgagcatggatgaaaaagtgattattagaaaattaacagtcgaagatgcagagtcagtattgtcattaatgtaccaattagatcgagagtctaaattcatgctgcttgaaccagaagaaaggacaaccacactggagcagcaaatccaaattattcactcattcaatgattcatctaataaggtgatatatttactgaccaatgatgaaaaggcttttggtttcattgtcggtgtaggtaatacagccaatcgcaataaacactgcatgtctttggtcattggccttctccaagctgttacaggccaaggatttggaaaagaattagtaaacaagcttgaaggttgggcgatttctcatggatatagccggctagagttgaccgtaatgcagcacaacgagagagctaaaaggctttatgaatcatgtggttttgaagttgagggtttaaagcgccattctctggttgtcgatggtgagtatgttaatgagctgtacatgtctaagctattaaccgcataacaaacgcctcaagagggactgtcaacgcgtggcgtttccagtcccaatgagccgcggtggttatggttgttgtgtttgagtttagtgttatgcgttgcctgccccttaggcgggcgttatgtgctttctcgaaaaatctcgaagtagtgtagaatccggcttttgaaatcttgagaaatcagcatgtctaaagtcgttcaacagcaaatcggcaatatcgcacttgtcgtagaaaactacgatgatgccattgagttctatacaaaaaagcttcagttcagtttggttgaagataccgatttgggtggtggtaaacgttgggttcaagtttcgccgccaaactcgaatggaacgaacctacttcttgctcaagcaagtaccgaagagcaagctcaatttgtaggtaatcagactggaggtcgtgtttttctgtttctacaaacgaatgacttctggcgagattatgagttgatgaagaccaagggtgttgtttttaatgaagaaccacgagtagaagagtatgggacagtggttgtgttccaagatctttatggaaacaaatgggatcttttggagttgaacaaggctcatcaatagcacgcacataacaaacgcctcaagagggactgtcaacgcgtggcgtttccagtcccaatgagccgcggtggttgcagttgttgtgtttgagtttagtggtaatgcgttgtcagccccttaggcgggcgttaggttacaaattgcatgcataggtctcggtttgcatattgattttcccttatgatttctgtgcctaagatttttataggagacagttatggcatgtagttgttgtggaaaacgcctaaacgtaggaacaattcataaatcagaccccaagactggacagaaatttaagtcttgccctcactgttcagatgccaatggcggagaacatgtttttcattcatatccatcttcatttggaaaaactcctgcacgagtgacagctcgtaaccctgatggttatcaaagctactgcagtgattgtcgtagtttagctaaaggtgtagcctctcacgcatacccaaatgggcgaaagttgtagtggcatagtgaatttggtcacttagttagaggtgatatcatcacctcataagttaacaggtgacattatgacaaaacgtacaagacgactatttagcgcagaatttaagttagaagcagcgcagctagtcttagaccaaaattactcagtgacggaagcagcccaagccatgaatgtgggcaagtccacgatggataaatgggttcgccagcttagagaagaacgccaagggaaaacacctaaagcttcacctatgacccctgagcaaatagaaattcgggaattgaaaagaagctggctcgccttgaagagcataatgaaatactaaaaaaagccacggctctcttgatgtcggactcactgaacaattcttgataatcaagaaactcaagcagagccacagcgtaaaaatattatgcgaagtcttcaatgttcatcgaagtagttatcactattggcttaaacgcccagcgttaattaatgcggaaacaataaaactgcgcagcttgattagcgaggctcacgccgcaagcaatggctctgcgggagcgagaaccattgcagatatagtcacaaatcagggtgtaaagctgagccgataccgagcaacaaagctaatgagaactcttggtttagtaagctgccaagaaccaaagcatcgttacagaaaggcttcacaagaacatattgacgttccaaatcacttaagtcgtcaatttgctgttacggctccaaatgaagtctgggctggcgatgttacgtatatttggactggtaatcggtggatgtatttagcggtcgttatcgatctttttgcccgcaaagtgatcggttggtcaatgtctttgtcgcctgatagtcggttgacaggtaaagcgctgtctatggcctatgaatctcgcggaaagccaaaaggtgtcatgttccatagcgatcaaggcagtcattatactagccgtaaataccgtcaattactgtggcgctttcaaataaaacagagtttatctcgccgaggaaactgttgggataatgcgccgatagagcgcttctttagaagtctgaagacggaatgggtgccaactgtgggttatcgtagcttcgctgaggctcaacaagagatcacccgctacattatcggatattactgccaactcaggccacatcagtataacggtggtctaactcccaatgaatcagaacgattatattgggaaaactctaaaaccgtggccaattttagttgaccactacagcttgagtaagtgtcgctatcgaggtgctttataggcagatattgtcggctaagtccgctgctcttttcattggtttcatcgttctcatgaccgtatcaatcccccaatgtctacgtgttttgcgcatttcaatacttttagtagccatactgcatagaatgatgtgatagaaaaatgtttcaagaataaagagatatagagtcagaattacgaaacatgtgttgattcattatgttatcgaaggcagagtgttggtttttcaagcgctttaacctttaaattgacgcattatcaaactgaaataggaaagattatgtactcatctcatcaatgtaaaagactctcaataatggctattttgggatgtttacccttttcagtaaatggcgcagtggaatcaatgcctcttatgggaggcgtgtataactcggcgcatgtttttaagcatcaaatcaccaactcgttgagttattcaactcgattaacacgcgatactgcgctgtttactatcgctggtctcactttggatagttatatcctcaccttaccattggacgtaaaaacgaaagcgcgagtcataaagcaaatatccgatcccagctatgcaatcccgttgggatattttctttatcagtattatgaccgctacaccggcatggcaacggaagatcaattcaaaaattacttatccactgtgtatgatgagccagccttaaaggggtttgaacatagtttgtttcagcttggcaaacctgtagtgacagagcaaagccaacatagtaaagatcaagctcaccaggaaggaattaaagtcgacagtgaatttattgcgactatggtgaccttgtatgacgctctagttcagattggtgagtggcgtgatctcaaacaactgccttcccaataccagtatttgtcggatacgcctgctgataacgccttagtctcaaaaattcaaccacttgtcgtggatattctgcgtcaaacggccaacggcatggatgagggggagatgaaacatgcacttctgtcggttctagaagatgcgaaaccagaaaacgccaataaagtgaacaacaaagcgcaagcgattacggttagcctaattgattttgtgcgtttgaatgtgctgaaaggatatcgacaatttctttatcaggaagagcgcaccgcgcgtttaaaagagtggttaaacaaaacattggacagtgaccctgagcaattagtcacttttttaacttcacaacagcagcgccgttttgcggtacaagtgacagtggatggtttgcagcaaggcttgattgaagggcttgttcacccagaaaacccctttatcaaacaagtctatgcagaacatcaacaagctgaaaaaaaccagcattcaacgctgatggagccgctagaacataagcaacaagtccgtttcctctccaccttggctgagcaaaattatcaagatccttactatttgcccttcttcaaacagctttatcagcattatcgtcaaaccattgtgcaagtcggtatctcttcgacaccgacaatcagtgtgcgtaatttacctatcatcaaaactggcgctaaggtttctgggcttggtggtactggtattcccaatttccacttcgttgatcgtcaagcagatcgcgcttactacttttttggcaacgatgctttgcagctcgatcgcttggtcaatgaacgaggtgtgaagacaatgttcgatcgcctagattacttgaaaacactcaactgtaacgctcagtatgattggaatgcacatactacctacgatggactggtgaatcttggtgctggcgaagctctacgtgatttcggtgaaaagcgttgtttgcgagaattaaatgaaagggcggaggaggaacgtcaacttaccgcattaagagcgaaattaattgagcagatcaccgcttaccaaaattcgtcgaagtggatggtattgacgcgagcgacattaaagcagcgccttgagcaacaactggctgaatatgctgagcgggacatctttggcatgcccgattacacgctgatttataatccttggcccgaccattttgcccatttcgctggaccgtttagcgatgaggtgatcatgccaacgggagaattgaatcgcttagattactggttgagagaaacagaggccgcatacaaaaaagctggaatttatgagcgtactttatggggaatggcgggcgatcacggtttagctcccgtttacggcaccttaaatccagaacgtaaaatttttgagtcattacaaaaagatctggggattaagattgcgctggagaaaatttcctccgatgaaggagaggggccgaaattaaccaatgctcttaatgcgcccagttatcagaagattgatgttgtggtggcctcgactgccggaggtaacttcatgctcgatttctttaattcagcggcagggtgggcaacacaacctatttatcaagaattgacccagtggcaacccaaagagagtgacaaaccccttgatattgttagtgaaagccttgttcgtttaggggatagcttggattacttagtggttagagagaaaacctgtactgtggatgattgtgctgtgcgggtgatcggcatgcgagaaggtctgcgcttggatgagatcatacgcctagtgggtaataagcgtttttacacgtcacagcaaggccaacctcagctattacagctacagcaactgaatccatatttacctaagcctcaagccaatgctctcgaagagctcgcgcagttggtggacaaatgtctctatcgtgctgaagaagcgaacatagcgacttggtgtgatgagcaggaatggcggcagctaacccgcttcactcctcgtcctgactctgtgaatcagcttgcggcactttatgaagaagatcgtgccggcacgatgaatctcttccctaagcagggcgtcggatacaacaccaaagtgccgggacgacacgctggtgaaagctacttagaaaaagatgcgtttttgggattctggggtaaaccgattgggcctaatgcgatggcactacaatcggaacaaaatggctctttggctcctacactttatgagtatttaacaggagaaagtattgaggctggccatgatggctggggttatccttcattactcaataagttagatattcagtaacgtctcactttacgccgatctacaatgtcaagtcgcttgggtacagtgttgtactgtagcaagcggcatgattgacgtgcgggagctcatgcttgagcggtcatcagaaaatgagaacttaatcggtattctagacgttaaactcggggcgtgtatttcgcacttttccagcggtttggggattcactcaagcgtagcaatgcgtctgacaatacttcattgagttcaaggttgccccatcacaaaaatcacgattttcaaggtttctttctggtttgagatcttccccaataagatcgcattgatcttgttcattggtcggttttcgttgatctaaatcaatactctcacttgatgcatttcgttaaatacgccacaacatatagtgtcagtcgcagaaaaattagccctatatagtgtatttgtggataactctgtgagtatgctgggtaaggagagaaggtgaaacctatcgtaatcaaacgtgatggctcaaaagcgccattcaacagggatcgtatccaagctgctgtagaaagtgctgcggaacatgccgatcaggaaatcgctatctacgcactcaatgtggcattagccgttgaactcaaactgcgtgattacgatgaggtacacatcaccgagattcaaaccttagtagagaacgagctaatgcaaggtccgtacaaagcattagctcgttcatacattgaatatcgccatgaccgcgatgtcgcgcgtgagaagcagagcaagctgaccaaagaaatcgaaggtctgatccaagaaagcaatgcggatttgctcaatgaaaacgccaataaagatggcaaagtgatccctactcagcgcgatttgttggcgggtattgtcgccaagcattatgccaaaacgcgaattttgccacgtgatgtggtgcaagctcatgagtcgggcgatattcattatcatgatctggattacgcgcctttcttcccgatgtttaactgcatgttgattgacttaaaaggcatgctgactcatgggtttaaaatgggtaatgctgaaattgacacgcctaagtcaatttcaaccgcaacggcagttaccgcgcaaattattgctcaagtcgcgagccatatttatggtggcactaccatcaaccggattgatgaagtactggctccttatgtgacagcaagctacgaaaagcatttagagattgcccgtgaatgggatattcacagccctgaagcgtttgctaaagcgcgcacggaaaaagagtgctatgacgctttccaatcgttggagtatgaagtcaacacgctgcataccgcaaacgggcaaacaccgtttgtgacctttggttttggtctgggcacaagctgggaatcgcgcttgatccagcaatcgatcctgaaaaatcgcatcgcaggtttgggtaaaaaccgtaaaacggcggtattcccgaaactggtgtttgcgattaaagatgggctcaaccacaaaacagaagatcctaattacgacattaagcagctcgcgttagagtgcgcttctaaacgcatgtacccagacattctcaactacgacaaagtggttgaagtgacgggttcattcaaaaccccgatgggatgtcgctctttcctaaatccttatgaggaaaatggggagttgatccatgaaggacgtaataatcttggcgttgtcagcttgaacctgccacgcattgccttgcaggcgaaaggcgatataaacaaattctatgctctgttggatgacaaactgaaacttgctcgccgcgcattagatactcggattaaccgtttagaaaatgtgaaagcacgtgttgcaccaatcctatatatggaaggtgcgtgtggtgtgcgtttgaaagcaaatgattcgattgcggatattttcaaacatggccgtgcttctatttcattgggttatatcggtgtacatgaaaccatcatggcgctgtttggtcagcaaaagcatgtttatgatgatgtgcaactgcgcgaagaagccgtgaaaatcattcaacatctgcgcaacgcggttgagcagtggaaaaaagagaccggttacgcgtttagcctctatggcacaccgagtgaaaacctgtgcagccgattctgccgaattgatgccaagcaatttggcgtggtggaaggagtgacggataaaggttactacaccaacagcttccatttggatgttcagaagaaggtgaatccatacgacaagatcgattttgaaatgccatatccggaaatttcaagcggtggattcatctgctacggcgaattcccgaacatgcaacgtaacgtagaagcactcgaaaacgtatgggattacagttatcaccgcgtgccgtattacgggaccaatacgccaatcgatgaatgttatgagtgtggttttacgggcgaatttgactgtaccagtaaagggtttgtttgcccgcgatgtggcaatcatgagccgaccaaagtctcagtgacgcgtcgagtatgcggttatttgggcagcccagatgcacgtccatttaacgtcggtaagcaagaagaagtcaaacgtcgggtaaaacacctgtaacagtatgaattaccatcaatattatccgattgatgtggttaacgggccggggacacgctgcacgctgtttgtctccggctgcgttcatcaatgtaaaggatgttataaccaaagcacgtggtcgctgtcgtctggacatcgctatacccaagagatggaagataaaatcattgcggacttgaaagacacacgtatcaaacgccgtggattatcgctctcgggtggcgatccgatgcatcctgccaatttatcagcggtgttacagcttgtgcagcgggtaaaaaccgagtgcccagataaagatatttggctctggacgggatataccttggcggaattggatgatagccaacaagctttactgccatacattgatgtgttggtggatggcaaatttatccaagagcaggctgatcctgggctagagtggcggggcagtgcgaatcaagtgattcatcgctttaccttgtaagtccttgttctcagcgctctagtgtttaaggggcgactgagaacaaaaaatccctttcggttttctcttatctggtttactttgtgagttgttacctgaatttcaaagggttgtgactttcatgtttactcatttaccagcaccagttttagatccaatactttctctctccgtcgcctttcgcaatgatcctcgtccacaaaaagtggatcttggaatcggcgtttataaaaacagtcttggcgaaacgccaattatgcgtgccgttgcgctggcgcaagataaagtggtggcaagccaaaaaaccaaatcttatgtcggccttgccggctgtgaagagttcaaccagagcatgatgcagctcgtattaggttcaaccttggatacggagcgcacgattgcaatccagactccgggagccagcggcgcgctgcgtatgctgggggatttgatgcgtgtggcgcaaccggatactaccgtgtggatcaccgatcctagttatgtcaaccacaagcccgtgatggaagcggctggtctgaaagtacgttactaccgttatttcagccgtgaaaccaaaatggtggataccgaacaaatgttggccgatctggcacaagcgggaacgaaagatgtggtgttactgcatggttgttgtcataacccgacaggtgccgatatcgatttttctgcgtggcaagcgatcactgagttggcgcagaaaaacggctttatcccttttgtcgacatcgcctatcaaggttttggtgacggcttagaacaagatgcacagggtttgcgttacatggctgagcgcatggaagagatgttgatcacgacatcctgctctaagaatttcggcttgtatcgtgagcgtacgggagcggcgattgtgattgggaaaaatcagcaagaggtgaccaatgcacgcggcaaaatgctgaccttagcgcgttccacttacactatgccgcccgatcacggtgctgctctcgtcaaaacagtgttaagagatgaacagctcacggcaatttggaaacaagagttgagtgaaatgcagcaacgtttgttaactctgcgcaaaaatttgtgtaatgagttgagaaatcaacacaatacgcgacaattcgacttcattgagagccatagaggcatgtttactgtactgggattcagtgcagagcagatgggaaggctgcgtgaagagtttgcgatttatggtgtcgcagatggcagaattaatatcgcagggctgaccgaaaaagacattccttatgtggccaatgctattattcatgtgtcgtaaatgaagatgacagcaatatgcccaatcaggaagggtggtatttgattaggtgaaagtatgagtcaaccactgaagttgttagtaccattaatgttaagtagtggattggtggcttgcgctaccaatccggtgccatctacaccggcacaagtgcctgaggtggtggagacgcaagctcagcctgtggtaaccgtgcctgaagagatcgtcgatcctaatgctcctctggtcgagactttacccttgcttgagcctgcacactcgtttgaagagaaagatgatttttcgacagcgacaaaaacttctgatggcaagatagtattaggcgataaagagtgggtttatctgccgggtttgaaagagagtttcaaagcacgaattgatactggggcgaccacctcatcgatcagtgcggtagatatcgtgccttttgaacgtggcggacaggattgggtgaaatttcgtattgagcacgacaacattcgcagtgaggagttaagtttacccgtcgaacgttgggtgagaattcgtcaatcgagtgccgaggaagcgcagcgtagagccgttgtggtggcatggatccaaattggtgatttgaaagagcaaacggagtttactttgaccgatcgcacgcacttaacttatccactgctactggggcgcagcttctttaaagatgtcgcggtagtggatgtctctcgccactatattcaacccaaacatccaagccctaaaaaatagtccgaatcttctcgcctaacttgagggcagtgaaagtgttggctatgttccgatcctcatgcacataggcaatcgatgttcatggggaagccacttggggttctttagggatagaaagctctttagatataaagaagttgtttagatataaaaaagccagcggaatttcactggctttttcattttcactgagcatttatgtcactaagtacgcctttcaccatgcactcagattaagccgcgaccgctttggcttgtgccgactttttcagcatagcgtagccaaaaccggtaatcgccgtaccgacagcaatcgcgaccaagtacagcagcaccgggcttatcgcattcgggatcaagagcacaaacagaccgccgtgtggcgccatcaatttcgcgccaaatagcatagagagtgcgcctgtcactgctccacccaccatacacgctgggatcacacgcattggatctttggcggcaaaaggaattgcaccttcagagataaagcataggcccagaacaaaagaggcttttcctgcttcgcgctctcccgcttcaaacttgtctttcgcgataaaggtcgctaagcccatacccaatgctggcaccatacctgccgccatgattgcggccattggcgcataagtttgtgaggcgagtaagccgacgccgaaggtgtatgcggctttgttcactgggccacctaagtcgaaacacatcatggcaccaagcacaataccgagcaaaatcgcgttggttgatcccatgttgtttaggaagctggtcataccgctcatgatgctcgacatggggccgcccacgacgtaaatcatcactaatccggtaaataagctggcaataaacgggatgatcaaaatcggttttagcgcggccattgattgaggcagttgcactttatcggcaataaatttggcgctgtaacccgcgaggaaacctgcaacgataccgccaaggaaaccggcgcccgttgagcttgcgagcattccgccaattaaacccggtgccagtcccggacgatcggcaatagaaaatgcaatgtaaccagcaagcaccggaatcatcagcgcaaatgctgaacctccaccaatctgcattaaagcagcagctaaagtgccttcttctttgaacgcttcaataccaaatacgaaagagagcgcgatgataagaccgccagcgaccacgacaggcagcatgtgcgatacgcccgtcatcaagtgtttatacacgccttttttctcttctgctttctcgttagtcgcgctgttggcagagcttgagaaagtttttgcttgcgcgaaggcattactgagctcctgcgcggttttcttcaacgtgaggccagtactggttttgtagagttttttaccattgaagcgatccagaggaacatcaatatcggccgcgatgatcacgagatcggcggcagcaatttcttgctccgtcagttggtttttagcaccgactgaaccacgcgtttcaactttgatctgatggccttgacgtgtcgcttccgcttctagtgcttccgctgccataaaggtgtgtgcaacccccgttgggcaagcagtaatggcgacgatttttttggcagaaacagacgctgtggcgggggagtcacagcgtgttgcctgctcggagctgagttcagtcgcttgttctgcggcttgcttaaggtaaccgacgggatcggaagtacaggcggtaatagggctttggtagacttttttaccgacaaaacgctgcatatcaatcttgccgttagcggccagtatgaccagatcggctttattgatttcctcttcgcttaaggtgtggcctgcaatcactgttgagtgacattcgatataggcttcccaccctaacgttttactggcttgctgcagtaaacccgccgcaataatgctattggcaacgccacttgggcatgcggttacaatggctattttcatcttcacgaccttctgtccttaggcacccatcgtaggatagagtgcggatacttgaatttgttgttgtagggtattgagttgctccctatcaccaagaccaacgccgacttgggttaccgcaagtgcagacaaggccgttgcgaaacggagcaaagattctttttccatacgttgcatatgtccccagcatagaccagcaaccagcgtatcgcctgcaccgactgtgctcaccacctgcattttgggtggttttgcatgcaaccattggttttcgtgaagccacatcacgccttcggcccccattgaaataacaatgttttcaatctgtttttgggcgagttcggcggcggcttgctggcagtcggttagggtagtcagctcgcgaccacaccattgagaaagctcttcatcattgggtttaatcagccaaggtttggcatccaatcctgccaacagtgcatcgcggctactgtcaaacagtacttttttattcatgctgcgcagttgggcaatccacccagcgcagcgctgtggtgagataccttgtggcaaactgcccgcgagcacgaaataatcatgatcctgtgctaggcgctgtaaggtcgcttcgaaagcctcaatatccgcttccgtcacctgaataccgggaaaattgatgtcactgactgcaccactttgttcaaccagtttgacgttaatgcgcgtcgctcccgcgatgcgaataaacgcatcctgtacgcccaactgctcaaacagttggcagaagagttcttgattatctcggccaagaaagcccgtgactgtcacttgtgcgccaagttcactgagtactttggcaacgtttacccctttgcccgcggcatgcagtgaactttggccaactaagctgactgagccaacgttaagctggtttacactgcccgttaaatcgagcgctggatttaaggtgatggtgaccactttttttgtcatgtgatgccccttaaccttcgcctaagccagcattgatcgccacgcctagcgcttgcaacgcggcttctgcatctgggccttctgcggtgaactgcaactgatgattgtgttttacgcccagtgcaatcactttcatcaagcttttggcattgacgacttgaccatcgccatccaggttagacacacggatattagattcaaacttcttggcttcggcgactaacatggcaccgggacgagcgtgcagaccatggctatttttaatgcggaaagtcgccgtatgagcgcgagcagaatcaggctccgccaccgtttctgcggctatcgtttcctcagtgatcgttcccacagctattgttcgctgagcgatggtttgttcagcgttgccgctaaacagattaagcagttgctgaacatcggcctgcaagagttgatcttgtttttgctcaaacacgcactgagtaatggtgttaagcagaggctgatggacgtcattacacaccgaaaacgcaatcagcgctttcaccgcttgttgctcatattcacaatggtttgccgtagtgacgatcgacatcccagtccgttttactgcgcgatcgctggctactaaccacaaaccgcgtccaagatgagtcggtgctttagtgactaggtcggcaacaaattcattttctgcgcagcccgtgtttttcaacaatccccccgcaacagcgctcatttgcaccatatcactggctggaaactgcaattggatcaacgaagcgtcaaaatctgcggttaactgggcttcacctttgataatggcaatgatttgttgcgctgttttggcttgctggagcgcttgctcaacgccatcggcagacagcactctggtcagctgctttagaatgcccaaatgttcatccgattttgcggcgataccgatggccacatacaccagattaccgtctccccaatccaaaccttgcgggaagtgcatggcggtgacacctgtctgtttaaccagttcacgggtatcggttgtgccatgcggaatcgcaatcccattaccgagataggtggaatgctgtgcttcgcgattgagcataccttgcgcatagccttctgccactaagcctttcgcggtcaacgcgtgagccagtccttgaatcgcagcttgcttattcgcaaagtgttgctgcaattgaatatcttgtgtagtgagttctaacattcttaactcctgtctgcctctataggcgagatgtgatgtatcgctgcaggttttcagttgaagcaataccttgtcattcatcccgtctcgttttcctttgagctgaatcggttcagcacaaagggcaaaaaaattcagcaaaacctcgaatactcacgatcttgctgctggatactcgacacaatctgacctttgtagtggacgagattgtgaatcaacggtacttttgctgaatcctttcagctttaatactgaatcgattcagcgtataattcaacactaggctaggatcaaaaatcgcgttctatgatcagacgcacataaaacgagacccccttatgacactggatgaaatcgcgaaattagctggcgtatcgaaaactaccgccagttatgtgatcaacggcaaggcgcagaaatatcggatcagtgagaaaacgcagcacaaagtgatggctgtggtggagcagtataatttccggccggatcatgccgcatcggcattgcgtgcaggcaatagccgctcgtttggtttaatcattccggatctggaaaacaccagttatgcgcgtttggcaaaattacttgaacagaactcgcggcaagccggctaccaaattttgatcgcttgttcggatgatgatccacaaattgaaatggcagcggctgaagctttagtctctcgccgaatcgacgctctgtttgtggcgagtggaattccgagtgccagcgagtattacctcaagttgcaacaatccggaacgcctgtgattgcgattgaccgtgctttggatgatgagtatttctcctgcgtgatcagtgaagactttggcgcggcatttgagttaacgcgttccgtgcttactcaggatgtgcacagcgtcggtttggttggcgcgctgcccgaactgaatgtgtcgcgtgaacgtgaacaagggtttgccatggcagttaagcagcgcggtttaccaaccactctaggttatggtgagcattttaaccgtgaagaggggcgtaaagtatttgccaaatgggtagcgaatgatcagttgcctgatgcggtggtggcaacatcctatacgctccttgaaggcattcttgatgttttgcttgagcagccagaattgatgcaaaaagttcgcttagcgacctttggtgataaccgcttactcgactttttacccatccgagtgaattctctgcctcagcaatttgaattgattgccgatagcgcattagccttggcgctgaacgcgtcggcgaaacgttatcaaacggggatcgagctcattccacgtcagttaaaggtgcgcacttaaacaaaataaaggtatgatatgcgccagttttcgtttcctcccacaggcaaggcatgaagtttctacatacttcggattggcatcttggtcgccaatttcatcaagtctcattattagatgatcaaagcgctgttctcgcacaactgatcgactttctgcgcgacaatccggtggatgccgtgattgtcgccggtgatatttatgatcggtcgattccacccacggcggcgattgatttattggatgaagtggtcagcgtgatctgtggcgagttgaagacacctttattgatgatcccgggcaatcacgatggtgcgaagcgtttaggctttgccgcgaagcagatgaaaaattcgggcttacatatctttgctgattttgaacagatgatgcagccacttgtgctgcattcaccgcaagcgggcgaggtcgctttctggggaatgccgtatcacgaccctgagttagtgcgccactactatcacaacgacatcaccacgcatgacgctgcacaccaatttttgtgcgagagtattcttgctcagcgcaatccgtcacaacgtcacgtattaatcagccactgttttgtcgatggcgcgatggagtctgaatctgagcggccattatcgattggtggatcagatcgtgttgaccatcgccattttttgccttttgactacgtcgcgcttgggcatttacaccagccgcaaatgaaaggcgcggaacacattcgctactctggctcattgatgaaatacagcttcggtgagcagcaccaaaacaaaggcgctaccttggtagagctgggtcagcaaggttttattagcgcaacgcatattcctctcatcgcgcctcatcaaatgcgcattatcgagggagagttggaggcgattcttgcagcgggagccaccgacccgcaggcagacgattacctgctagtgcgtcttttggataagcatgccattctcgacccgatggaaaagctgcgtcaggtttatccgaatgtgctgcatcttgaaaagccgggcatgttgattggtgtggatcaagagatgggcaaggcacgattggcgcgaggggaattggatatgtttcgtgattttttccttgaggcgaaacgtgaacctctgagtgagcagcaagagaaagtggtgattgaggtgattgcgcgcctgaaagcggagggcatttaacatgcgtccgttaaaacttatcctccaagctttcggcccttttgccggacgagaagagattgactttacgaagttgggtgatgctccactgtttttgatcaatggggcaaccggtgcaggaaaaagctcgattctggatgcgatttgctacgccttgtatggcgaaaccacaggcagtgagcgcaccggcgaccaaatgcgctgcgattatgcggcccctgagtctctcaccgaagtgatttttgagtttgagctggcgggggcgcgttaccaaatcacccgtcagcccgatcaagagatcccgaaaaaacggggtgaagggatgacgaagaaatcccattccgctactttggttgcactgaaatcggatggaaacgagctgattgccaacaagcccaatcctgtcgcgaaggcggtggtcgaattgatgggacttgatgttaagcaatttcgccaagtcatggtgttgcctcaaggcaagtttcgtgagcttttaaccgccaattcaaaagagcgtgagcagatttttggtcagctctttcaaacccagctctacagccaaattgaacgggcgctgtttgaacgagcagcgggtattcgtaaagagaaagaagagtttgatcagcagatcaaaggtacgttgagtgtcgtcggactggaaagtgaagagcagttacaaaccgagttgaccgaactggctccagtattaacccatgcgcaatcacaactcaaagctgagcaacagcagtgggatgaaacaaaagcgcactatcaagctgcgcttgagttagaacaacaatttatccgcaagcagcaattggtggtagaaatcgcgactcaccaagagcaggctacacacatcgaaatgctgcgtcagcaacgccagcaagcccaaaaagcagcgcgtttaaccgccgtccatcaacagtggcaccaagctcaaaaaaacctacagcaagccaaacttaaggttgagcagcagcagactctgttgcaacaggcgaaagctcagcagcaacaggctcaacaggccagtcagcaagccagtttagcctgtgaagaagtacccaaattaaacgagcaacgcataacgtggcagcgtgctgagcaaaaattgctggcacaagaaaatgttcagcaagcggtggccaaggctgagcgtgaactgcaactggcgacacaaaatgcgcttaatttgcagcaagcgagcgaaaagctagagcaagagctacaaaaccaacgactcgaatgggaacagcaacagcgccaattgacgcgcttagaagttcaaaaagcgcgaatgaatcagttggtgcagcaagttcaggctcgcgagcgagaacaatcgttactgaatgaattacaaactgctcaacaagctttattgcgctttgagcagcaacatcaccacatccaaactcaggccgaacaagcgaaactgaccgcggataaactggagttcgcatggcatacccagagggctgcggagcttgctctcgcactcacacaaaatgaaccttgtccggtgtgcggcagtttagagcatcccaataaagcgcaatattcgggtgacgttgtcaccaaggttcaggttgaacaagccagacagcagcaacaagattgggtgcagcgtcagcaagaggcattccatgcttggcaacaacaagggtttaaaaccgagcagatagcgcaaaatctcacgactttatcgagtgagctaactttgcagcaagtggctttattgaatgagctcattgaacagcaacagatacttcacagtgatattgctgcgctacaacagcttaaccctgatttgctgaaacggcagattgaagagggggagcagcggttagcgcacaccaaaatgacgctcgaaaaacagaatcaaaaccagcaacaagcttggcagactttggctcagttacaggcggaattggcgagtttgcgccaagaaatcccaccggagctgtccgatcttgatactttacgaagcgcgattgggcgtgtgcagaaccaaatagaaatcttacaaaaagcggagcatacggctcgtgaacagtgggtgcaggcgcaaaagcagtttgccagtgtgcaggcggcttatcaggcggcgattgaagcgcaccgtgagtctcagcgtcagcaggaggaaaccacaagcgcatggcagcaagggttactccattctggatttagcgatgagtccgcctatcttgccgctcgtttaaccgatgaggctatcgtcaatatcgagcgccaaatcgcccagtatgaagagcgcagtgcgatgctcagtggcgaacagcaagccttatcacgtaaattagcagagaaaaatcgcccagagttggaaccacttcttgtcaaagtaactcaagctgaagaaaaaatggcactggcgttgcaggcgtttacgcaacatcaatcgcggatggatggtttgcaacgtgtcgccaagcaactggcggatctgtaccagaaaaatcgtgcattagaagccgaatatcaggtcgtgggcaccttaagtgatattgcgaatggcaaaacgggcgctaaagtcagcttacatcgctttgtgcttggtgttttgctggatgatgtcttgttacaagcttctcaacgactgatgaaaatgagccgaggccgctatttactcaaacgtaaagaggaacgcgctaaaggtaatgtgggctcagggctggatttgatggtcgaagatagctacagcggtaaatggcgtgatgtggcaaccttgtccggtggtgaatcgttcatggccgccttatcgcttgcgcttggtttatccgatgtggttcaggcttacagtggtggtatccgtcttgatactctgtttattgatgaaggttttggcagtttggatccggaatctttagatttagcgatccaaaccctaatcgatcttcagcaaggtggtcgaacgatagggatcatctctcatgttaccgagctgaaagagcagatcggtctaagattggatgtgttggcgacaagaatgggtagcacgctgcgtttaatcacataagataaaagataggggtttgatggttatcactgacctctagctagcgaaacggtaaagtatgtgcatgttgatgattagcaagagaatgcaacggtagtgatagtgagcatggatgtaataaagagagtgtatcaatacgcagaacctaatctgtccttagtcggatggatgggcatgcttggctttcctgcctactacttcatctgggaatattggtttccgcaatcttacgaaaatttagggctgcgttgtgcggcagcggtgctgttcggtgggctggtgtttcgtgattcgatgcctaagaaatggcagcggtatatgccgggctattttttattcaccataggtttctgcttaccctttttcttcgcttttatgatgttaatgaatgactggtcgacaatttgggccatgtcgtttatggcgtccatttttctgcatattctcttagtacacgatacgagagtgatggcgttacaagcacttttctctgtgttggtggcctatcttgcggtatatggtttgacggattttcacccgacgactttgattgaatggcaatacataccgatctttttgtttacttatgtatttgggaatttatgttttttccgtaaccaaatctctcatgagaccaaagtgtcgattgccaaaacgttcggagcggggattgcccatgaaatgcgtaatccactcagcgctttgaaaacgtcgattgatgttgtgcgaaccatgatccctaaaccgcaaactgcagctcatacggattattccttggatgcgcaagagctggatctgctgcatcaaattttgaatgaagctgatgatgtcatctactctggcaataacgcgattgatttgctgctcacctcgattgatgaaaaccgtgtctctccggcgagttttaaaaaacactcagtggtagatgtgattgaaaaagcagtgaaaacttttccgtataaaaatgcagcggaccagcactcggtagagcttgaagtgcatcagccgtttgacttttttggcagtgatactctactgacttatgcgctatttaacctgttgaaaaatgccttctattaccaaaaagagcatttctcggtttgtatttccattgaacaaaccagtgagcataaccttattcgagtccgtgataacggtgtggggattgcgccagagatgttggaagacattttccgtgatttctataccttcggtaaaaatggtagctatgggctaggattgccattttgccgcaaagtgatgtccgcatttggggggacgattcgctgtgcgtctcaacaaggtcaatggacagaattcgtattgagctttcctcgttacgattccgatacggttaacgagataaaaacagaactgctgaaaaccaaatcgctcatttatatcggctcaaatcaagctatcgttcgagagttaaatcagctcgcagtagaagatgagtttggttttaccgctatttctgcgcagcaagcagtaagacgccaagattatgagtttgagttcgaccttattttgctcgaccttgatgacgctacggcgcagggagaactactgccgaaacttgaagggacattgagttttgcagaaggctgtatcggctatgtgtatgatccgggcaaaacgtatgcagtaaacattaaccgttatctgcgtatccaaccgatcagtattcactctattctcagaaagccgcggaaaatcatcgaacgcttgttgtttgagcaagaatccttatcgatgaatcgtaacgtgatccccttgcaaaagagtcggcatgaacgacgtattttggtggttgacgataatcaatcgatccgaacttttacggctattttgcttgagcaacaaggttatgaagtggtgcaagccaacgatggtagtgaagtgctcaagcatatggagagtcaaaacatcgatttagtattgatggacattgaaatgccgaatgtcgggggattagaagcgacgcgtttaattcgtaactctgagcatgagtacaaaaatattccgatcattggttacaccggtgataacagccccaaaaccttggctctggtacaaacctctggcatgaatgatttcattgtgaagcctgctgaccgtgatgtattgctaaataaagtggcagcttgggtgtagctatacccttcctacttgaagctgcaggggtgttggctacgttcgctcaccccaatcacatagtttatctatgctcatggggattcactctcttgccgcctacctgcaactccaagttgtttgggtatattttagagaaaagtgggagaacgaattctcccacggcttatgcaaggaaacgttaaattctttaggaataacgtttagcagtttttgttatttatgcatttaacgaaaataaaaatcaccgtagttgaccgcatcagagcaaacctcaattattttggcgatttgctcatcgttcacatcactattgagtgataagcgaataatgtttttattctttgaagttgccgggcggcagaatactgagccaaacactccattactttctaaataatcccgaactttttcggtatttcgttcatctcctgtttctagaccaataatttggctttcactgcgaatggttaatcccagctgggataatcctatgcgtaattttcttgccatacgatctaaatgctgacgacgattatccgcagattcaataatctctaaagtcgtttctaatcctgccgcttcataaggcagcaaagtagaactaaaaatagctggataactaataaaaggaacgcagcgattcacttcattgttacaccaaatggctcctgcgcgataagcaaaggttttggccaaacttgcggtcataaaatgcacttcacgagtgaggcctaattctgccaataaacctgcaccattagggccatgtgtgcccaaagagtgggattcatcgactaataaggcgcagccaaactctttactgatattgaccagttccgctagcggtgcaatcgtacctaaagtgctgtaaatcgagtctacgacaatgatcccaggaccatgacgttgaatcagcatacgtaaatggtcacagttattatgcataaaaggatgcgcctgagcattggcgtagcgcgccccttcccataacgacatgtgcgcgaaaaaatcaatgtaaacattcgtattgggctggcagatggtttgtaataaaccgacgtttgcattccaaccagattgagataatagacattcatcaaagcctgtgaacttagccagacgtttctcaatcatgggtttgtcatagtcattttgtagaaatgaggctgacataaataagctttgttgttcttccagtaatgacttcgccaaacgagctttgatcaacggatgattggccaatgcgagataatcattactttgcaaaataatgtcatcagggctggcttgtttacccaatacaaggtgtttaccgtttttgtttatatcaaaataattttcaatatagtgatctatcttgttctgaataaaatcaggaagttgaggcttgttcatcgcaatatatcctagttataaaaaatttaacgccagctgacgagtgatatattgcgtgattaaaaacgtctgtcatctgggaaaaattatttttattagcaacttagaataattaataattctcgatggtgaggggaggaaaaatcattaggggtagggactctaccccgaagaatattctgatataaaaaataatttaggagtttactgagcgatttttaaataattcaggccaatacattttgatatatccccaagagacccaggcaactaacaaagttgcaatcgtgacctctaaaaagccgaaatagtgtagccaataccagtgtggatgatcggtagcgaaaaactcggtcaatctttgcatggcaaccgcactgatgaccgatgggaaagtgactgccgcgatggagggctgaaattgtagtcgcagtaaacgcaggtaacagaggtagatgagtaaagtcatggttatggcaatgcccgctaaagcccctgtcagaatcgggtcgggctgcgcaaaattgaccagataagtggctaaggtcaggttaatgggtgcggccataatcgccagtgtggggcgagctcttttcggtaatgtacccgcaaacaccaaccgataaagtacgagcggcaacatgacgaaatagatagcgatacagacgttaaccatggtttccgaaaacagggtgtgtccaaattgggtgcctgcaagtgaactgctgatgacgccgacgggatacaaaaaccagctaggcacaatatttgcgagcttgaattgacgcaactgaaaatagaagaacagcgtcatcatggttaaatgcagtaataaggctgccgcccagatgggataggcaatgaaaggagatagaatcgcgagatagtcgcatagaatgagtaaagccatactcatcggagccattaaactccctgatacggggtgccgaagatcattaatgaaagtacgccaatgaagatatttgagcagtacagggagtagtaacaaggctccgctgaatgctaagtaggggcgaatcaccatgccaacggcaggataatagagcacccaagcatggccgagcccaatcatgcctaacgctaatgcggcttgtgaagggggcacgttctgtacttgggtaaatctatgccaattcaattgctactccttagtatccccttcctacttgatgctgcaacgccaagtcgtttaggtataaaaatcctgattttaaaatgataaaaagccgcttgttttgcgagcggctattatctgggttccctttactttaggcaaattgacttttatgagttggggctctgcggtggtaaatcttgttgctgtaatttttggtttttcagagtgcgatgtaatagctggctatagatgggttggccacccagtaactgggcaaaaatcaccgcgcctaagctggtaataatcagtggcaggatcaggtgatagttattggtcatttcgatcactaataaaatacccgtgataggtgcccgcacggttgcggcgaataatgcacccataccagcaatcgcaaacatcccaggttcaatattcagttctgggaaccacattttagcgatcaagccgaaggcataaccaaacagggtacctagtgcgagcataggagcaaaaatccccccgggcgcacctgagccaaagcaaagtaaagtggtaaaaattcggccaacaaacagtagcaataaaatacccgctccgtagccgccattcgtgatagtgggaattaagctgataccgccacccgttaactcaggcacatagagcagcaataacccgaagcagccaccgatcattgaacccgttaatagatagcgtttacggtcattgcgatgaaatttaacgaacagatcttgggcaagggtaattaaatagttaaacagcacgccaaatacgccaaatagagcaccaagaagtaagaataaccctagcgtcgacaattccggcgcatcgtattgtggcatcgtgatcaccgcatcttgtccgttgatcacgcgaaacacaatgttggccgctactgcagagatgatcaccgcacgtaccgagatcagggtatagcgaaattgcggtcgcatctcttcgatcacaaacataatgccagcaagaggcgcgttaaatgcggcagcaagacctcctgccgcacccgcagccagcaatgagtggcgcgtatcttcatttttgacacggaaaatatcggagatcatccgcccaacggcgccgcccatttgtactgtaggaccttcgcggccgagcaccatacctgagcccaacgcgcccatgccgccaaaaaatttcacgggcaatactcgccaccaacgcacggggcgcatgccatccatcgcgccttcaatttctggaataccagatcccgcagcttcaggagcaaagcggtggacaagaaaatagccgatgaaagcgagaaatgcgctgatcagaaaagcagccaaccagagtggtaaaaagctaccaatttcactttttagccaatcggtacgagtttctgagactagatgtaccgcctgttcaaaataggtgccgactaagccagccaaaataccaaccagcaatgataaaaacaaaactgagaaaggcgtcttatctttggagagaaattggttaatcacatctttaggcattttggccagcaaactgatcttaaacgtctctcttgttgacatactaatgacacctattgatgaattgggggaaaagatgtgccggaattatacgctgcatagggttcaactatagcgataaagttgaaatattgatttccatatatgattgatttgatggatcattctgaaaaaattgagatctacaccaaaaaatgagtaacttttctggaaaatccagcgttatgtaccatagttaaagcgtaaggttagtgagaacatttctgatggaggatatggaaccttacagacaatttggatggaatcaaaacgttcatatcagtacctcggctaagagacgcttgcatatatagccaagcgaattcgcaaaaactcacgattgagtctacgaggaaaaaggcgcgctctacagtgcgccttttgcatttaagcttttatgctgtccacgaaatttgaaactgtttctttaaaagcttttggatatacttcggccaaaaggagaatcagcatgatcaatcgagttccgaccaatattattacgggttttctgggcgttggaaaaaccaccgcgattttgcacctgctagccacgaaacctgcgcatgaaaaatgggctgtactcgttaatgagttcggtgagattggcattgatggtgccatcatgagcgagcagggtgcgatgatcaaagaagtaccggggggatgtctgtgctgtacggctggggttccaatgtctgttggcattaacgccttgttgcgtcaaaagcccgatcgtttaatcatcgaacccacaggattagggcatcctaagcaagtagtcgccacgttaatttctgagcagtatcagccttatgtggacttaaaagccacgattgcgttgatggatccacgccacttgagcatggataaataccgcagtaaccaaaatttcaacgaccaactggcgagcgcggatattgttttggggaacaaagtcgatcagtgcagcagtagtgacattgatgcctttaatgattgggttacggatcaaacgccggccaaaacctttagtcagctcatcaagcaagggcaattccctatagagttactggatatgccgcgtttagttggtcatgcatccactcatattgactcccatcatcatcaccatgctgccgatgagccgcaatttcagcttgcacctcaacagccatttttgcgcaaagaaaatcgcggccaaggctattttagttgtggttggttgtttggtgcggagtaccagtttaacttcgatctgttgtttcaactgctgaatgatttaaccgccgagcgagtgaaaggggtgctgaataccgatcgtggttgctacgctttcaacgtggcgaatggcgtggtttctgtgactgaaatgagcttagacggttttgaatcgcgcttagaagtgattgattcacaactgatgccttggagcgagttagaaagcatactgctcaagattgcaggcattccacaggcgtaaatcacaggcctttctttgcgaaaaaggcgagtcatactcgcctttctgttatgcgcggaatgattaacgcttgttacgcagataacgcttacggcgctcttctttacgtttggctttctcttcggctttcagcgcttcatcaatttcaacttgttgtaactcttcggtgatcatttctggacgctccaaggtgatttgtccaagcacaccttgacgcagctcatgcagtaggatttcagaggctttatgcagatccactcgcgcgcccgcacgtagcgcgccacgtttacgaccgatctcttccatcaattcaacatcggtttctggaagttcatcgatttggtaacgctctttcaatctttctgggtagtgcttagccagatactcgacggtgtaaaacgccacttcatcgtattccatcgcggtatcttttaccgcgccagtggccgccaaacgaaaaccgctatgagggttttccacttttggccacaaaattcccggagtatcagagagcacaattccgttttgtagattgatgcgctgttgacgacgagtcactgcgggttggtttccggtttgagcaattgcacggcccgctaaggtattgataatggttgatttccctacgttcggaatgcccatgatcatggtgcgaatgtttttgccgatctcttcacgctgtggagcgagcttgcggcacagttcgaggatcttgtgcacttcctgcggattggatgtggtgatcgccatcgctttcacccctttttcttgctcaagatgagcaatccacagctcggttaactcaggatccgcaagatcacgcttattcagtaccttcacacaaggtttttcaccacggatatgcgaaatcagcgggttttcgctactgaaaggaatacgcgcatcaagcacttcgataatcacatcgacttgcggaatcgcttcttcgatttccttgcgtgctttgtgcatgtgccccggaaaccattggattgagttgttaaccatttgaaaaattagccttttaatacagtcttaaatgagttgagagataagaatgatgcttaacatggagtcagcaggagccacctcgttctcaactccgtgacgctatggtcattggaatacgccaatgctaacactttacgaagaatgcgggaatcgccataaacccgaacaatgaattgcaccgctaggcgagagctgtgggaaaggggatttctatatattttctttatacccgacttgcgcttttatacaccttctttaaatcgggctagttagtatgctggaagttgtgatttaggaagcacagcggtgcttaagaaccatgaaacctgcaaaacaaacgacagccagcttggcatttctggcaatgggtatcgtctatggcgatatcggaactagtcctctttacgcttttaaagaagtgttcttcagtcatcatccactcgcgattaaccctgacaatgtgttggggattttatctttggtgttttgggcatttgtcctgatcgtttccattaaatatcttttgttggtgacacgcgccgatcaaaatggtgaaggcggtattctgactttatccgccattgctcaacaaagtgcccccaaaccttggcagaggattgccatgttacttgggattttggcgacgggctttttctttggtgaagcggtgataacgcccgctatgtcagtactttctgcggtggaagggattgcggtggcgcaaccagacttagctccttatgtactgcccattgccatgatgattattgtggcgctgtttgcggtgcaagcgatgggaactgagcgtatcgggcgctttttcgcgccagtgatgttgctgtggtttttagtgctggctttactcggtgcccatgcaatttggcacgcgccccaagtattacgtgcactcaacccagcgtatgcggtgcattttgtcttgctttatggacagcacaccctgtttattttgggcttagtcgtgctttcggtgactggggttgaagcattgtacgccgatatggggcactttgggattaagccgatccgcattgcgtggtttgcactggtgatgcccagtttgctgctcaactattttgggcaaggggcgtatctgcttaccctgtctgcgcccacaggttctactttctttagccttgcgcctaaagcttggttgtggcctttgatcttgctggcgacgtttgccactgttattgcttcgcaagcggtcatctctgggatcttttcgttagcgagacaggccatcaactatggctatttgccgccgatgaaaattgcgcatacttcagagcattcacaagggcagatttatgtgcccgcggcgaacatgttgttgtttgtggccgtgatttttgtgatgttacgttttcgctcatccgccaacttagcggctgcctacggtattgcggtcacggcgatcatgatgatctcttcgctactgttggttttggttgcgcgttatcaatggcagtggagatggccgcgagtcgtcacgattgggatcgtgtttattggcatggatagtttgttgttagcgtcgacctcaaccaaattgatggagggtggttggctgcctctgcttttaggatgcgtggtgtttatcgtcatgtatatctggcagcagcagcgccaacgcttgctggaaattgccggtaacgagctctcggtttcggcgatgattcagtcattggaggaagagtctttccaacgcgccgcaggaaccgccgtttatttgtctcgctcgctgaaccatgtgccgcgctcgctgctgcacaatatcaaatacaacaagaccttacatgaaagaaatgtattgatgacctttcaatatgaagcggtaccaagggttcacccatgtcgcagagctgagatagagcaggtctcggccagtttttggcaagtagtgatccatatcggttatcaagaggagccagatatggcgcaagtgatgcattgctgcggtctaaaaggcttgtatttgcatcccaatgaaacgctctttttgctctcttcagagcgattgaaagtacaaaaactggggatgtggcatgacctgaaagtctggttctttattcagatgagcaaacatgcgctgagaacgtcggaaagattgaatattcctcccgatcgcctaattgagatgggtgtgtatcgagagatgtaaggctcgcacgaaaaagccgttcaagattgaacggtttttttagctctgaggtttagcctttacaaggctcccctagtttttcgctaggggagcgaggctaatcttgttgcgcgacgcccgcatacagcggccatgcgccagatttcaccacctcttttgtaacttgcgcactgtgtgccaaatcgtaatggtgctcgatgcagggcgaataggcgacaaccaaggacggaccagaatgttcacctgcagcttgcagcgctttaatggtctgattgatgttggcacccaaggctattctagccacaaacgcaccgggcagatcttggtaaagtttaaccagatctttggctggacttggattgggtaaactgcacaatttcgcggtttgtccttgcggggtggacttggatttttgtccaccagtgttggagtaacactgcgtatccagaaccagaatattgatgttacgtccgctgcgcatcacatgatcgagtccgccaaagccgatgtcataagcccagccgtcacctcctatcatccacaccattttttcgcttaaataatcggccagcagttgctcttccgagtgagctggaagtcgctgcttcagctcaccaatctgcgatcttagatcgggaagcggagattgcggggtatgtccgcctagcaaacgctgcgcacgcgattgtaaggcttccagtgccatattcatgcccaagccaaattcggcattatcctcaaataggctgttggcccaagcagggcctcgtccatcactatcctgactataaggcgtcgagggtagattgccgccaaaaatagaggagcagcctgtcgcgttggcaatcatcaatcgatcgccgaataactgagtcaaaatacggatataaggcgtttctccgcatcctgcacaggcattcgggtattcaaaatagggctcaacgtgctgcaatgttttgacatcaattcgctgctgctgataggccgactgcttcggcaaggcttggaaatgagtgaatctttgttgctctgactgataactgaggttcttctcaaccatattcaatgccttacgttctggctcttgtcgatcttttgctgggcaaacctgagtgcataactggcagccagtacagtcatccggcgacacttgcagtacatagtgcgcatcgggttgctgtcttgagcgataaggcaggctttttaactcactcaaggtaggatgggtttcactcacaatgcgggcacgaatcgccgaatgcgggcaaatcgcgacgcagtaaccgcattgagtgcaaagatcggtttcccaaaccggcagctgttcagcaagattgcgcttttctaactgcgaagtattggtaggccatactccatcggccggataagccgagacaggtagcgcatcgcctttccccgccagcaactgttcaaccaagctcgcgccccaaatcttcggctggctctggatggccatcgttgtttcacttgggatcgcaaaaggcatctcacacaccgactggtacgcttggtttaggcattgcaggctttgtgtcagttgctgggctgaacggtgtttgagctgttcggttagactcgcttccagtggggtcaataacgcctgttcggtatgctggcttaataatcgagccgccgcggcttgcatcacaatactggttttattgccgagttgatggcgttcaagcaagccatcggcatcgatggtggccacttgaaccgataaagcctgcaggcgactttgcaatgcgggcggtaaagcggcccacagtgcttgccccgtcagtgcggtgttgagcaacagatagccattggcgatcagcttgctggcaatgtcacgctcatggagaagtttcagattgctgagcgaaaccaaccaagcgtgacgaaccggatagggagcagtgatcggttgctgactgaaacggatatgtgtcgtggtgacattggcagattttttggagtcgtattcaaactgaccctgtacatgccagttttggcctagggttttaatcagattttttcccgcactgacactcccatcgccgccatagccatacatcagaacactttgatagggcttatctctcgtcgctgaaatcgttttcggtagagtaagttggcttacgtcatcttcaatacccaccacaaactcgtgcatttgctcctgctcgggagcttgcatcatggtgaaaatcgcttcgacatcttctgggtaaaacgcttttcctgataacccatagcgaccgcgagagagtcggatcgagtttgccctctgggtatataaggcacttaaaacgtcaagataaagcggttcgccgtgactgcccggctctttggtgcgatccaatacgctgatatgagtcaccgtggctggaagcgcatcccgtaaggcttggcttggaaaagggcgatatagtcggatctgaataacgccaatccgctcaccttgttgtacgccggcaaggacgacttgtttgatggtgtcgacggaagatcccattgcgacaatcacagattgtgcttgcggatgaccgatatactcggccaactggtagcggcgtccggtctgtgtttcaaaacagtccatgatgttctgcacctgttcaggcgtactttgatggtacggcgtttgagcctcgcgacactgaaagtaactgtcgggatcggcagtggctccgcgtagagttggccgatcgggcgttaagactcgggtacgaaaatcaactaaggctggcatgggtagcagtgcagataacgcctcttcggagagcggctcaatctgggtaatggcgtgtgaggtgaggaatccatcaaagaaatgcacaaacggtaagcggcattgtaaagcactgaaagtggcaatggcggctagatcttgcgcctcttgcgcattactggcgcagagcattgcaacgcccgtttggcggatggccatcacgtccgaatgatcgcagtaaatggataacgcatgggttgcaacagtgcgagccgccacatgaatgacacaaggcgtcagctcaccagcaagcttgtataagcttgggatcatgagcaataaaccttgcgatgaggtaaaggtagtggcaagtgcaccgctcatggcagcgccatgaacaaccgcaatactgcctgcttccgattgcatttccacaagtttgggtacatcacccagcagattgctcttttgctggcttgcccattgttcacagctttcggccatgctggtgctcggtgtaatagggtagacggctagcacttcactcagttgataagcaacgcgggcaacggccgtatttgcgtcagtaatccaagtcataattcacctctgtcggtatcgcagcgtttgcgatggaggatggaagatgtatgatccggccacctaggtgacgagatcacgaaccaacaggattaagaagcagtggtgacaagacttaatgaagcacacaaagcgctgattctggttgcgctgtacgccatggtcactgtcgtgggagtgatgtaccgcaaagatatgattgagactgatgtggctatgctgtttttgttgctcaatatcttgagcgcatcagtactcaaaccgcgcaacgcttacgtgatgatgggattaagcatcatcgattatcactactttctgctaccggattatcaatcgttccgatttgagaatgcgcagtacgtgattacctatgcggtgttagcttttagtgggattttcgcggtgaatataacacaggctcagcgcaagcaaatagagaaaaataagcgcctgcagcagcaacacaagaagtactatgaacttgcttgccatctttctgcactcagtaccagtgaagacattgctcaagccaccgtcaaatttttaagtaaagagaaggggattgtcagtgcgatcgcgctataccagccgcagtggcaatgggtcgcgcagcacgctgatttccccgttgcagcaattgaactaccgcagcctcctttgactgataacacatcaaccttggtgcaagatgagcagatcaatgccttcaccttggtagatcgtgggacgatccttggggtcatttatttcctacgttatccccatgagcgcttcgcatcgccagaggctttgcggcgtgaatctaaaatcgcaccttgggtacgctctcttctgactctttctctagcaagggctcatgcgcatcgcaccttggcccatgtggaagcggagaaacagctggaaagtacgcgtacaacgttactcgcgtctgtctcgcacgatctaaaaacgccgcttggcgcgatcattggctctgctaccactttaaccgatccgagtcttcacctctcgacggaaacccagcaagagctgctgacgtcaattgctgagcaaggcgagcggttaaatcgcagtttgaccaaactgctcgatatcacccgctatacggcatcggcgctagtacctaagttagattgggttgaaccggaggagttgattggaacggtgctcagtcgcttggctccgcgattaacccatcacaaagtacagattgagagtcaaccgatgttggttgagcttgatagcttactgattgaacaggtgttgattaacttagtggaaaatgccgcgaaatatacacctagaggcagcgaaattgagatcgcttgtgcttatcaagagcagcagtttacgctggcggtgatggataacggcgcgggcatccccgatgaggcattgcctagaattttcgaccggttttatcgtgtggaaggcaaccatgctgatggaacggggcttggcttggcgatttgccaagtgattgttgcagctcaccaaggttcgattcgagtacataatcgagagtctggtggcgcatgttttacggtgacgattccttgccgccaatacaatttaaaggaactgtatgaacagtgaaattaagatcctcattattgaagacgaagcgccaattcaacggtttttgactgtgcttatttctggttatgagtatcaagtgaaagtggccagcacggcagagcaagggctgcatctggtggcgaattggaatccgcatttgatcctgttggacttaggtttgccagatcaagacggcatcagtttgacgagagaactgcgagcatggacgcaaaccccaatcatggtgatttctgcccgagaaaaagaagcggataaagtgcaagctctggatgccggcgcgaacgactatttgactaaaccctttggcagtgaagagttgatggctcgtattcgggtggctctgcgtttagcgccgagcaccgaaagtgtagagcagactcgttttgaattgggggatctggtgttggatcttgtgttaaagcaagtcaccaaggctggagagccagtaaaactgaccaaaaccgaatacaacattttgaaattgctagcaaaaaatatgggtaaggtgctcacgcacaagcagatcttaaaagaagtgtggggcggcaattatgtcgagcatcatcactatgtgcgtattcatgtcgcgcagttacgccataaagtggaagacaatcccgcgcaaccgcgcttcatcctgactgaaaatggggtcggttaccgtttagtggataaataggcacgtaaaataaaactatctttataaaatctatacagatgtatgccttatccatacaaccgatttatacagggttcgctacactgcttcacaggttaaggacaggtaaggcgtgaacttttagtgggattgtttacgtgcactttgcatggtctgaaatctacttggtaaacacacattgtaaaaagcagaggacaacatgggtggaatcagtgtgggtaagctcttaatcttggggtgtattgttgcgctggttttcggcactaagaaattgcgaaccataggtgaagatgcgggttatgcgattcgctcttttcaaaaagcgttacgcggtgacgaagtgacgactcagtcatcaacggccgaggaatccgtcgacagcttcgctattgagcaagagtcgtcccattcttctgattctcagcgccactcataatgttcccattctcaataccatcgcatttatggggctcttatgagccccttttttcatgttcaaatcgatagaacgtctctcgacgtaagcgactaggaaaaagtcacgatgactcacatcctttagttagccggatgttcgcatttgtctatgctggcgctttaactggggaatacttataaagcggctctgcataccgagccgctttgagactttcaatcttctaccgtgactttcactttacgctcgcgttttttgagtatggcgctggcggcaaatgtgagtaaggccagaatcagtgtgaagatcggtgcgatcatcagtagcttggtcgcaaattgttcgagcttagtgggtaacagtgaaataccaaagccagcgccaaccaagaataaaacccagcatagggcactaatggctgacgctgagagaaagcgtagcggctgaacgctattacgtaatcccatcaccatagggagcaaagagcgtactacagggaagaagcgaccaaaaaataaagcaattaatccatagcgacgcatcagtttatcggtcatcattaattgtttatctggaacttttgctaaccaattgttaattattcgccagtgtttgagctgagagccttggtagaaagccaccagactacccaaccagcccgcgaggaatagggtaataagcacccagtgcagttgcaatacaccagttgcagcgagcgagccactcagtacgatgacactatcacaaggcagtggcgcagcaggcaagaaaccactttccaagaaaatcagtagcgctaggcagaaatacagcaagagtaaattaacgttttgtagggcgaaggcatcgtgatgccaaagcgcactaaaaatagagagtacggaatccaaacggtgatcctcttttatgatgaaggtaaaaatgctctgcatgagtggtcgtacaaagagggcgtcgtgacaacagagcttatctctggatagacatggcacactaactcgcgctacacctcagtagcaacaacccattggaatacgagaaaagaggtgtggctaagcgtgcgcgtaacgggagtagagattggaaaataaccatgctttacgagcatgattgagtgtcgtcaactggaagaaacgctgactgggataaagaaaatagtggcgtaaagtgaaaaagaacgtctcgttggcagcactgaaatgcggtgtgaacgtcgaatcttctctttcttcaggttctgctcttaataatgtgcggtaatcttgctggcgattaggaagcagcgcaaatttggctaaccatgtgtgagcggtgtgatgctgtagttgcttttctaaggttgggtcaataattcgatgcgcatcaccaccatgcagcaaaggtgctgcacagagcaaaataaaactcaacagtgatgtcactacatgcaacatgacaggttaacctctcgcaaagacgcagcgagtatgctgtgtattgtttaaggtgtaaaggttagagacacattccgcaacgatattcgctggaagtttacttaccgctgatgcctcctatcttgacgagtatttagttagcatttgctaccttagcggtttgggcaatcccttctggtaaagcgaggtagtaaccttggtacatattaatatccagtttttgcatcgcagcgagttgctccgccgtttcgataccttctacaaccgtatgtgcgcccgttttttgcgctagctgaacacctgccagcaatccacagcaatcaccggccataaaatcgagcagtaactgtctatccagtttgatgatattggggcgcagcatggcgacccgctctggggttgatgctttacagccgaagtcatcaatcgcaatttgaaacccattggcgacgagtttttcggtggccatttgcagcatgccttcatccccggactcaatttcaaccaactccatcactacgcggtgatgcggaatattaagctcggccagtcgagtggcaagcaaggtagagctgatatcacagtaagcaaattgctcaccggcaacgggtaagacattgagaaatagtcgggtatcacgatagggtgaaaggctgaaattgcgaatatgaatggctcggcttaagcgctccacattaagtttgtcatcatccgcgaaggtttcagaatggaaaaacagatcgggccggatttgtgtatgatgctgggtaaaaatcctaaccagtgcttcagcacccacaacctgatgttgcttatcaaaaatgggttgaaaaacactgcgcaaggttaatccgttatatctcgcgtaatactcgccgccttcatcgtaatggatgcagtcgagaaattgttgtttatcagtcagaaccatacaaattgagcatccttgaacaaaaacagcgtgatgtttccctgaagtaagacttttgacgcacgccatgttattggcgaaacgttcattctgtcaatcttgctgtcacacgatagcatgagtcataaaaatgaatttttgagctaaattaagctttattcagtctcaatcaaaagtaggcattacttaagtaacaccttaaattacattatgttatagatggatgacgaggctcacataaatatgcagataaaatacatcaagctgtcatattgcggtgttcaataaatctgattgtagagtgtgcgtaaaaaggttttacaaatatcgacgtagctcactttttgtggcgggcaaaaataggactcagtctagatcattcgtcgagtaaacgattagctccactgtaacacggcgtaaagttgtacatatttacgaaccagttgctgatttttagaacgcttcagtgggtgcccgaatttgatgaaacagggacttatttgatagtaatgttccaacgtttgggttaattgcgaatcactttcctgtaacccgatcccttgagcatggtattcctccatctcatctggcagttgtccggtccaccaatggagcagttcacgactttttcgactgcgtcccatccagtgatcgctcagtagcagcagtaaatcattgggctgaatcacataagcgtattcttgtttccactggctaatgtcacgcattaacttgactcggcaagctttacccgcactcatcagatgatgagtcaaaatccataccgtacccgcgtcactggatactctgaaatgatgaggtaaatcgcgttgataggtcgactcgatgggggcgtattcgcaaggatgaccaaattcactcaacgttctggcaaggcgtcttgcaaaagctaaccctaaatggtgttcactcattccttgattatgaatggttggataatgcttctcacataatctgaggcagtccacctgaaactcattgacactttgcgtgacgatatccagtagcaagatgttgttctcccttacaaaagctaaacaagattatcacagttacactttgtcactagcaggaaacggtgacttcttgatctctagcgcttttctggtgggtaaatgttagtcagctttgtactgttcgatgaattaccaaattcactttttgttacaagtcagtcatgaaccttcttgactgatatgactctttcaaggtgcgtgaaagccataaatggcgaatgttgtctatactctgtcaaagttcgttctaattttttgatgtacttcttcagatggattgactaggcgcaacgtaaaaattggtaaatactctttcgagaataattgttaaccaataagctacaaccctgtaactgaaacacgataagagcaatgacgtaatgaaaaattcagacagccaacactataacttggtcactcgcagtatccattggatttctgctttggtcgttatcgggatgtttgccgttggcacttggatgatggatctctcttactacagtgaatggtaccgcacagcaccacactggcataagtcggtaggtttgttactggcaggtttgacgttatttcgtctgatttggaaagcgctttcttcatctccgaaaattgaaggcgcgcgctgggaaatcgtagcggctaaaagtgctcatcacttgatgtacgttggattgtttgttctttttgtctctgggtatctcatctcaacggaagatggtcgaggtattgaggtgttcaactggtttacggtacctggggcgggggctctatttgaaaaccaagcggatatcgcaggcaatatccatttttatacggcttggggtttaatcatactggcggggctgcatgccgtcgccgcacttaaacaccactttattaaccgtgataacacgttacgtaaaatgctgacaggagcatcaaaatgaaaaaaacactaatggcagttggtcttgctgcagtcatgtccatcccatttgcagctaatgccgctgactatgtgattgatacaaaaggcgcgcatgcttcaatcaacttcaaagtgaatcatttgggttatagctacattaagggacgcttcaataaatttgatggtgagttttcttacgaccctgccaacattgccgcttcgagtgttgtggtgaatgtggatacacgcagcctagattcaaaccatgcggagcgtgacaagcacattcgcagcgcagattttatcgatgcttcgaaatattcgaccgcgaccttcaagagcaccgaagttgttgataaaggcaatggtcagcttgaagtgaaaggtgacttgactctacatggtcaaactaaacccatcgtgatcaatgctgagtttatcggcgctggacaagatccatggggtggtcagcgttctggttttgcgggtacgacccgtcttgagctgaaagatttcggcattcaagtgatgggtgcttctagctatgtcgatatggaactgcatgtggaaggcgttcaaaaataatcgatgttgattccttactcattcatggctcagatgagtagaaaaagcccccagaatttgggggcttgcttttggttaagcgacttatttcctaaccaaaatgagtgttaagcacgagccaacgctttatctttgacaattcttacccgttcaccataaatcgggcgcagcgcttcaagcacatcattacgctccagtactcccactaactgaccattgtgtagaacaggcagcatatgtggtttgtttaccttcatacttttcgcgcgttcttctaatgacagagcgctgaagcgagtggcaatgcccatgcttgtagtcgggaatagctgttctttatcaatgcagaagaactccgccacatccaccagcttgtcgttgacatcaatcgcaatcacatcacgagtcatcagatctaccactttttggtcttggcttggcaagtagtcttggcaccaaaggtcaaccattacatcatggctagagagcacgccaaccaagcgaccttgcatatcgacaactggagcggcggacaaatggtggtcgagcagagtgtcgatcgcggctggagtggtcatatcaacgctgagagtaacaggttgagagttcatcatatcttttactgtaattgtgcttttcataagagtttccttgactgacgtaagtgcttgagtttccgtaatcgtgacaacattggcggcttttaactgagggcggcggtaaatgctccagttggcgaggccaaccagcacggcaccacccacaatgttgccgagcgtgaccggtattaagttcgccgtaataaattgtgtgacattcaaatcgctgtattggctggctgtcacaccaacctgttgccagaaactgtctggtgcgaagttttgaataacaatgcccagtggaaccatgaacatattggccacacagtgctcaaagccgctagaaacaaacatcgcgacaggcatgatggtcatggccgctttagtcatggcattcgctgaactgaaggtcagccaaatcgccaaacaaaccagtaggttacatagaatgcctaaagcaaaagcttgtactgtggtgtgatgaagtttgtgctgcgcaatattgagggcatttaaaccccattggccttcatcaagctggtaaaggccagccgctgtcaccaaaagcagtagaaaaatggcaccgataaagttaccgacgtacaccttgccccagatagagagcatttttccaaaactgatttcgcgatttgcccatgagatgctagatagcacagagcttgtgaacaactcgccaccgcagatgacgatcaaaatcagccccatactgaacgctacaccacccgccagtcggctcaatccccagccggcagaagcgctgcctgtggtgacggtaatgtagaacagaaaagccaaaccgataaaagcgcccgccatgaccgaaagacctaagatcatgccgctggtttttttcgctttactcagtgcgaacttttctgcttctgccatcatttccgtgggtgaaaagcagttttgatttttagagtaggctgcagacatattcgctccccaaactcaatttcatgtttacctccgtttagtacacaacaccttatgcgttgctacgccatcagattagggggacaaaggagtaaaggtaaaattgataatttttaaaaaccacatcaattctattgatatggtagggatgaagcgtaaaatgaaaccgtttgctcatctggagcaaaacagtgaatgaaaagaataggataggcagtgcggtattcattaaagcaattagcagtatttgatgcagttgccgattgtggcagtgtcagtcaggctgcggataaactggcgctcactcaatcagcaacgagcatgtctttagctcagttggaaaaaatgctcggacgccctctgtttgaaagacaaggtaaacagatggcattaacccattggggcatgtggctacgccctaaagcaaagcgtttactgcaagatgcccagcagattgaaatgggcttttatgatcaacacctcttaagtggtgagatccgcttaggcgcgagtcaaaccccggcggaacacttggtgcctgatctcatcagtattattgatagtgactttcctgagattcgcatctcattgggtgtgaaaagtaccaagggagtgatcgaaggcgtcctcgactataaatacgatcttgggattattgaaggacgctgcgatgacaaccgcatctatcaagaggtatggtgtcgcgatcacttaacgattgtcgcttcggcacatcatccatttgcgaaacgtgaatcggtcagtcttgctcagcttgaacaggcgaaatgggttctgcgcgagcaaggcgcagggactcgcaatatttttgatagtgtgatccatccgttaatcccagacttagatgtttggcgcgaatatgaacatgttcctgtgttacgcacgttggtggccaatggcccttatttgacttgcctaccgtatttggatgtcgaacgctttatcgaaagtggattactggttgcactgaatgtgccggagctcaatatggagcgtactctctcttttatttggcgtgcagatatggaagaaaacccactggctgagtgcattaaacgtgaaggattacgcatgatgaaaggaaaaccgagcatcttataaggggtatcatatttcctgaatctgttgatttatcggttgcgtcaccaaatgaatgtaatgaagatttctattatcattttattgtgattttaatcactaatattcccattttcttcggttagcatgtcgccttaattcaccaaggctgaaaacttttcagcatgtatgaggcggatatgagcactctgtttgctattgcgttaaccacaggaattctctctggtgtttggggatggattgcggtgtcactcggcttgctctcatgggctggttttcttggctgtacgagctactttgcgtcccctaaagatggcttgaaagggctaggtcagagcttattaaccaacctaacgggtgttttctgggcaatggtgatcattcatgccagtcaatgggttggcattgagattatcggttacgttgtgacggctttagtggcttttatcatgtgtatccaagcgcaaaaatcctggttggcttatatcccaggtacctttatcggttgctgtgcaacctttgctgctgctggaaactggcaattggtgatcccgtctttaatgctcggtggtgtgtttggttatctgatgaaagccagtggtctttggttatatcacaagctcaagcaacctcgcgctgaacaaacgaccatcgtgagcgaaatgacttctcgctaagcgtgaaggtccgtgtgaaacttttctcagaaacgattggcagaaaagcgataggtgaaagaatctactggttaaaaaactattggtaaaaacgattggtaaagagtacccctgataattcgtatcgaaagaatttagataccgccacacaattttgtgtggcttttttgtaagagccccagctaggtgagggagatttaatccctgtgtagatgaaaacctttaccaatcctaggtattgccgtttgccattgtgatgacccgttttaacgtccagcgcaggagtacaggaatacactctgttccattgctttcacaatgtgaaacgatcgccaaagccaaatccggtttcgcgtgttttttcagaactttagagaccacttttttggcggggattgggtggtcatgaggaattttaaccagctctttgaagaagtattcaaagccgtgcgagtaaaggaagtgctcaatgtctcgatcgggcaattcggttaagcgatgtcgctcttgatcatgtcccagtaatcctcgtacggtcgccgagtattttttccccgctggatctccatcggtcaccacatgccagtcaataccaaacgcacgtgcaaccttgattaaggattttagccctgattgagcaaattcgatgatatgcacaccttctgcagctaagttgtatccgcattgatgggcgagttcgttaaatagccacacttccgtttcaccttcaaccagcagccagcagcgagcaaagagcgctcccgaacggtgaaagcggatatggaaaccaatgcggcgcaactcatctcgacttaaactgcgctgcgaaacggaggtcgcaatggtgcgatcggattttctcaccaaacgacgaatcgaatgcaaaggcaccgcccccagtaaatcactgctgttggtggtgagaattttctgcatggggagcaaatctaaaaagctccaagctcgggcaaggtgcgtagggtgcaaacgaccttccggatcttcaatgatcaaaatcggccgagcgcagcggcgcagctctttgggtcctttgccttgtaaatacgcgttgagtaaaccaagaagcagcagcttagtctgtttatttttggtttcatgaatgatttggctgaggcttttctcactcggagaggccgcatacagtaagctgtcgcgttcgcggcgcggatttttccggctttgacttttgaacgaaaagtagtgctcaaccagagagttcattgcgctcaaactgctgcggatctcgcctttgttaacgtgtccgggcgtcgccattaaacgtcgccacgtattgctgatccgtttctcgacacgagcattcttgccgttgccattggcgagcgatttttcaaaacgtcgagaatcttttaagcggatcactggatgtaaactcatcaactcttgcgccaatttttctgagtgatgcagagtgagtgagttgccctctaaatctagaaaagcgtattgagtgctgatgtcatatttgacccttgaggcgctgatccgataaatgattttttgcgccccttgttcatcggtttgccaaagtggtttgagtttgcgatagcgcccagccttgggctcatggaggtcgttggcggcgaaaacaaggatgatctgcaaattttgcgtctgcgcatcggcaatcgagtaatcaacgtggaaatcttgcagggtgaatgggtatagagtgccatccgccggcaatactaccgacagggcatccagcaaggacgatttaccccaagtgttttctccaatcagtgtggtgatttcatcaaaggtcagtgatagtcggcggatgccacggaaaccagcgatttcaattcgctctaaatgcataggctgctccttagattcctcaccagggcccatagtgtaggctatcttatgaggttttctttaagaataaaggaaaaacccaatataagcagggtgttaagcttggtttttcaaaccagagttcacatttttgtaatgaataacacgaagaaaatgtgacataagttatttagcgtcactaaaatttcagagaggtttcataaaagtcacgattctgtcatgatcggcgggctaggataggagtggaaaagagagaagacgtatgcctatgagaagaaaaaatcagccagcgtcgatcacgctggcacacattaatgacacccattcctactttgaacctacctcgttacaactgactctggaacatgatgcggatattttaaaaccctttgtcagtgctgggggctttgctcgaattgcaacccgtattgctcaattacgcgatgatgcgcagcgcatgcagcgcgaatttctgtttttacatgcgggagactgtttccaaggaacactctacttttcgctgttcaaaggtaaagcgaatgccgacatgctcaatgcactcaagttagacgcgatggccatcggtaatcatgaattggatatggggaattatcccgttgctcaattcgcgcagcgcattcaatttcctttgttggcgggcaactgggatttatcacaagaacgagacagcaaatcgctgcgtttggggagcaaccctaaagtctacagttatgatgcgcttcagggccatgcacgctggattgagaaaaaggcgcagggtgaaagaattgctatctttggcctgtcgattgataagatggccgatattgccaacccagacagtgatactccgtttgtgaacgccatcgaaacggcacgaaagacgattgcggcaatccaccaacacggcatcaataagatcattttgctgagtcacttaggctatgacggtgacattgcattagcggaacaagtgtctgggatcagtctgattgtgggagggcatagccatgtactacaaggtgatttctcagcccttggcctcggcagtcaagatgaatatggtttaaaaatcaatcacacctatatcgttcaagctggattttacgcgcttactcttggccattgtcagattgattttgccgccaatggtgaggtgacccgatttgaagggcggaatgagctactgctcgggcgtcggatgtttgttgatgccagcatgagccaagagcagatcagtgagcgttatagtcaagcgcgtgatgaagtggataaccatccgaatgtggtggtgtgtaaaaaagatcctgtggtgcaaagtctattgcaggagaaatacataccccaagtgcgtcaactgcaacaacaaattatcgctcatgcggatcgcactttacgccatttgcgcataccggatgctgaaggcggcagtgagattgcccctctggtcgcgaaagcatttgtgtatgcattgaataagcgtggcttagacgttcagtttgccatccataatgcgggtggtgtccgtacgtcaattttgccgggtagcatctcggttgccgatgtggcaggaaagcttttgccatttgccgtgccgatcggcgtttaccaagtgaaaggggaagtgatcgcacgcgctctggaaggtgcgatcaataacgcgctcagtaatggcgtgcaaggaacaggctcaggcagctatccatattgccatcacctgcgttatcaatacttagcggataagcccataggtcaacgcattacacaactgcagatccaattagatggtgagtggcaagcggtggattctgaagccttgtactggggaacctcttccgcttataccatgaaaggaaaagaagggtatgatgcgctgcttgatatggaaggtgagggcatggtgacacagatttctatggccgatgcctttattgagctgctgtctgactgcccgtccttgctctcttttgaagcgcatgatgcttgtgaatgccaccatcattaaaacggatatctctttgccttactgcctatttgtgactgcaaatggtttggatgtcacgtcaacaccaagttgatcaagtaggttggcatatagcttgctttgttttgcctagtttttgctcaatattgctgagcaaggggagggagaacatgttaagccgagattggttcgatacattagtggtagtggcttgggtggggatatggtccgcccttatctatctattgccgtttgcgggagtgtaatcattacgcaatggtgtatagaaaaatggtaagccgaacgtgaaggagtcattgaatatggctcctttttttgtactagacacggtcaaaccacaggcatagaatggcgacgttttggggagtagtcgccttaggtttatttgtcgtcatcacgttgagtttcactcaaccggcaaatattaagctctgaatccaagttcaacgcttcgacgagaccaacgcattcaatactgcatttgttgcaggaatcattggtatgcggaaggtcttgatgtctggcgacgaagcaagatcttccgttttcggaggaaaatatgtccccaatcacttatcttggctttggcctacttaccttaactcttgtagccgttgatctctggcaaacccgtggtgggaatgtcacgatcaaaaaagcggccatctggagcatcgcctggtttcttctcgcgtttgtctttgcgattagcctttattacggctggcaatggtacgcccctcacagcagctacagtgccgagaaagccactctttcttttattaccggctatttgctcgaaaagtcgttaagtgtcgataacttgttcgtgtttgcgattatttttcatcaatattcagtgccagagcacttacgcccacgagctttactttggggggtgatcggcgcgctggttttacgtgcgatcatgattgccgtgggggcgcaactgctcagtcaatatcactggatcttatacgtgtttgctctgtttctgatttggacagggatccaattggcgcgcgataaaggtgaagagtcgattaacccactgcctgaacgttggattcgtcgttgcttcaacgtgacgaaagagtatcaaggcaatgcattgatctgtaagcagcaagggcagtggtgggtaaccccgatgtttattgtgattggcgtcattgcgttcatggatgtgatgtttgctttagattcgattcctgcgatttttgccatgacccaagagccatttttagtgctggcagcgaacgtgtttgctttattggggctgcgctctctgtattttgtacttcaaggcatgatggataaatttttctatcttaaaccggctttggctttcattatgatgtttatcggggtgaagatgatgttagttgattcagcatgggcaattccaacgccgatctcactctgcgtgctactggtgaccatgagcacggcggtgatcgcgtctgtactccgtgagcgttctcaatccaaacccatcgcagagaaagtctcttaaatttcaaatgttatctccctgtgcctcgttgttgagtagagtcatggggagataaaaatatttttagtaaataagttgttaaagttttttgtgttgtaaaaaatgacgtcatagttatgcgtgaaagacgcttaaagtttgaactttttagtgacttattgaatatctaaatggcagtatgttaatgcattgtttcattagttttagtaatccaaatcgtcaaaattagtcattttctaaccagatgtgcattgactaatattcacctcaacaaagtaagttaccgattcaagagaggcaatcatggctcaggcaatgcaaatgggaacaatgacagtcccaacctctaaggataaaaaaacctacgcggttaacttcaaaggattgattgctcatctgtttgacattctgtttgtagataatgcaccacgtcattactacgcgactgaaatgtcagcacacatccaaaaagatgtgggtttataccgttaagcgtaaatagagtttaaaaagtcggcatttgccgacttttttgtttcttgaagggcgtatttgctacgaatatgcttcaaataagaaaaagcgcctaaagcgctttttctttattatcttaatcaagctttcactcgctcaatcatcgattactttttacggcaatactcagcaatgatgtacatggtttggccgttcaccttaccttgaatgtgctttggatcttcggttaacgcgataccgcgtactgcagtaccttgtttgatgaccatgcttgagcctttgactggtagatctttgatgacggtgacatcgtcaccttttttcagctcgacaccatttacatcgcgtggtttttccgcatcatcgtccatgccaatttctgcccacttagcggtctcttcatcaagatacatcatatccagcagatcacgagcccagccttccgtttcagaaatacgtttcagttggcgccatgcgagaacctgaacaggttgaacttggctccacatactgtcattcagacaacgccaatggttcatatccaccgtttctgggttttcgatttgtcctttacaggtgtcacacagcatcactgcgtgatcgacagtgacgagggcatgcggagcaaccacaaaaggagaaagaggagtagaggccgcgcatagctcgcattgtgattgacagcgttcaagtaaagttgcttcagtagacatagtacccaccttgtaaataaatgtaagcgcgtattatccattttaaactcagaatttaaagggatattcggcaatttccggcaaaacaccacttttctgcgccaatcacttggctcaaaaagagtaaatttctgcttcttctcaaggcattcggtataatgcagcatcattttttgacgactggagtgagctttggaactgctttgcattgattatttaggtaagccactacgacttgaagggacgatggcgggttggcagcaactgttttgggacaacattttggttgctcagcgcccagcacaagaacagtatgaaggggatattcaacaccatttccaactgactcaaggggagcatgtgttagagtgttgtctcgagatcgcactgacttggcaaccgtttcagttacagtaccaaaccaaactcaacggtgagcttgtggcgcaaggcatgcgcagtgaaaaggatgttgaacgccaaacaccgtatgaggcccctaaggtagaacgtcgattcagtgttatcggccttgtctctttagcgatgaaagcactcaaaagtgccaaaatgatcaaagtggtcatggcatcggccagtttggccgcctactcttggcttttttcgtttcaatttgcgctcgccctgatcggctgtttggttttccatgagtatggccatgtaagagccatgaaatattttggcatgaaaaccaaaggcatctatctagtgccattccttggtggactcgccctcagcgatgaaaagatcaatacccgttggcaagacgtggtgatttcgatcatgggaccgtgttttggtttcctattgtccttgttgctcgttggggtgtactgggtgacggattcgcctttctgggcagcgctggcagtatttaatgcgtttcttaatttgtttaatttattgcctgttttaccgctggatggcgggcacattctcaaaagcgtgagcttttcgatgaacagtaaaatgggggtaatcctctgtgtgctcgcgattcttggtgggattgcgttaagttacagcttgggcttaaccctgtttgggttcttacttttgatgggcgcactagatattgtttttgagtggcgtcagcgccatcacagtcatttgttacccctgaatcgttatgcacaaatggtttccaccatctggtactttgctttagtcagtggattaattgccatcatcataggttttgcttcgacaggagatacgttgctaagtctgccgttgttgattctgggcacataattaaaaggaagccgaatgatttacgttcggcctccttaactgtctattaggcatcaacgccagtcactatcccagtaatctcgtccttcaggagcgtaaggctcatcagaccaaggctgcgctttaccgcgtagctgctccaattgctgttcgagtaagttgaccgttgccagatctccttctgagcaagccacataaatttcttgctcaatggcttcgatgcgatcacgaatgttcatccaatacctcctgtgatggctctctgcatagtgcatgtcaaacattaggacaacacaataatggattctatcccatctaggacaagtttagcctatcccctttatttcatagcacgcggccagagtaaaaatgaatagcactgcttgatacgtatggatgtgtacaaaggattccccttaagaaaattttttcttaaggggaagaacttggttcaacggttttcgaaacggttgtaatcgagcaaaccaaactcaatgggttgatcttggcgataccattgatgcacaagatcgctaaatgcccaaaattcgggtgagctgcggcgtactgcaaaacgatccaatagggcgacataatcttgctctgacttcatcgccgcaaggcgttgatacagctccgggatctggttttctttcagtgttaagtacgccgatggataactgccgaccactccgcgcactaaagtcaaattatcatttttggggtcgcggttgttctgttcatcaaacaagctcgagatattggtgtgggcattgttgtggatgagcgtaaacagttgcggtttaccttgttcactttcaatcatcaacatcatcaattgcggaatgggcagcaaaccttcaccacgcagatgatcgatttggcgcaaagcaaactcatgttcggctttgaatcccgtttgagttatcacgtatcgatcactcaataccgactgtacttgcttgcggagtttagcaaacagctcctgtttcgggttatcagtcacatagttaacgctggttggctgatcaaagggttttacgttacgttgcaagaaatcggaaaactgtacactttgattttggtaccaactagataactcctgatggcgcatatcgcgtggtagcagggcaacaaaattactctcaccctccatgcgcagaaaatccatgaacatacgagtaatcaactgatgtccgaaattgccatatacatcaaaaccagcaacaagcagataatgaatgcgctcaagcagcgcataatccattatccaagcggttttgggaggctcacccaccaatccttgcacgacagatgcgctatcgaaatggcggaaaatcgttaatgcggcattagggtttatgcccgctccatcccaaatgatgtccgtggtaaggtgcgtaccatttttaaaccattgattaataaattcagattttgcttcgagataacggctttgttgtagcgaataacgtacccagttactcagcggcagtgccgtattctcttgttcagccggtagcttcaaattgttgacttgtgagcgatagaattcgttgacttctggaagatcggctttctcaggatcgaggaagaagacccagaatctatcgttaatcacattcagcgccaactggcctcgacacactgggcctttgataaaggccatcaccgtattttgcgcattatcgagcaagaacttaaagcgcgctttcacgggaaggtcgatgaacgcggacatcgggtttgcggcaatatccggacgataacttggaagctcggcaacctcataatccgcatcaataaaccagagtttccagttcgcaatccgttgcttgttgagtgcgaaaggcatgtgggttttatcgacaatcgtctcttgttctggcacaaggcgataatagactcgctcaacgcccggatcatcgtacggacgacgcgtcacgattcgctttacaggctcacccggtggagtactggagcggatgagtttaaagaaacgaggccgctcctgcgctatctctgaaaagtacagatgtgagaggaatagatgttcgtagatatagcgtgctgcgagctgatttttacgcgagctgtgattcaacaaggcttcgtattccgtaaccaaagcttgttcttgcgcactcagcgggagcgcttgattcatcacggctccctcttgtagccaagagagcagggtagtgtactccttgggggataaattcggcataccaaagggcattccccaattaggattcacttgttcgaagtgatccatttcgttgatcgttgggcaggtttgctcacgatcaattgaaaaatcaaatccttgtaactgatcttgctgtggtagtggatgacgctctttctgcatcagcaaacgtgccatcaccccagcatcaagattggcttgcgcggtttgatttcgctcattcagcacgggatgaaaaccagcagctcgccactcttgggttaactgagcatcttcgtagagacgagttggagtagcggccgtcagccgagttccctgataaaccaacgctttgctcgccccgcgatcaatgccttcagccgaggtcattttgagctgacagggtgcatcgtaacaggcgtgacagacgacacagcggttatctaagatgggttttacttcgtttaaaaaatgctgagcttggctagagtgcaaaggtaattgtcgctcacgtacctgctctgtgccaaagagctgatcatagttgatgcctgcgtacatggcgcaaccggagaaaaccgtggccagcagcaacagaatcgaagatttgaaattcataatgacaaaattcaagaagagaataggtgaattaaagcaaaggaagaggggagatgtccaactcacggtgcactttcattccgcttgctttaaagaaacaagcgtatacccaaaccacttgcagttgcatgtgggcggcaagtgagtgacaaatttgtctggaacaaatttgcacagccatcggcttgcctttggtgagagccaaggatggctctcataattcccatgagcataaatagactatgtgattggggtgaacgaacgtagccaacaccgctgcagcttcaagtcggaagggaatagaaatgcaaatagcctgactgggtcaggctatttatataaaagctaacgctgcttaggcggtttgcaactgagccactttctccgctgaaataggcttggtgatcagagcaagaaggatacacacggccatcattgctgcagaaatggtgtatgccaagttgtagccgccaccatgagtcattgagtaacccacgactgccgcaccaatcgcgccaccaatgccccatgaagtgtagagtacgccatagttggtgccgtaatttttcaagccatagaattctgccgtgatcgatgggaacaccgccagtagcgtaccgtaaccaaccgcggcaatcgccgtgccgatgattaaggtgaattctgagtcaaacgtggcgaacaataccatatttccgccttgcagcaaaaatgccagcagcagagtacgcacgccaccaattttatctgacaagatacccgcagcaacgcggccgcctgaattgaaaatcgccaagattgaggcaaggtataccgcgttcggtaggtttgcttgcacgctagcgatgttcgtgatgttaccgatgatcatcaaaccaacagaagcggcaagagcatacatcagccacaatgcatagaactgaggtgttttcagcatggctttccagcttaagttggcgactttggcgactacttttgcttcttgaccggctttcagtttcggctcagcaggcacataacccgctggtgggttgttaatcgtacaggcgagcggtaccgcaatcgccagtacacccgcgcccagaatcataaagctggtttgaatgcctaaatgagtaatcaaggctgatgtcagtggcgcaagataaatcgctgccagaccaaaacccgctgcaatcaggccatttaccatgccttttttacttgggtggaaccacttcatagcggacggggagaggcaagcatagccaaaaccgatacctgcacccgtcatcacgccgaaggtgagattgagcatcaaaacagaagaagcaaaacctgaggcaatcatgcctaaacccgttaaggtggtacctaaaatcaggatattacgtggacccatgcggtcttgcagaatgccagcaactaaaagacagacagaaaaagcgatggttgcaatagcataaggggaagaggcatccgctgcactccagccaaagtcggtaactagggctttattaaaaacgctccaggcataaagaatgccaagacaaaggttgatacagaaacccgccagcagaatgcgcatagctttatcaatcttgctcattatttgtgatactcagtaaaaattaggatagacaaccccgttatctgggatatttgttcaaaataactttgcaaaattcaacaattctggcaaagcgcgcggattataaccaatagccttgtgattggaatcactttttaaagacggataaaaaataaatttcgcttgtttcatcactgttgtatttgtgaagaaatgtggtggtttttagtgagtcaacccaatcattcagcgtgatgaatcatcagtaaacattaagtggggtaatgttagcttcttgtttgtaactatatgtttattaaatgatttgactaataagtaaagcacttggtcaaaatagggttaattcactttcttcccccttcaaaaattgaaaaaagcctctactatcgcccacctttttcaaataagtggagattgatatgaagcataatgcactaaaaatggcgctaatcgcagtattgggtgtcacttccttaactggatgtatgggacaaatggcagcgaccggactggtcaataaattcaatttagaagtggtggataaccgttacgcccgtgaaggcctgtttttgctgctttcacccgtctatggtttaaccagtactgccgacctgtttatttttaactcgattgagttctggacaggtaaaaacccaatttcaggaaagtcgccagcggttgttgatattcctgccaaagcgattatcaaagtcaatggtcaattggatcgctctttgacagaagcaccactgaaagcacaagtgcgcccgatcgaaaaagcaacgctagaacaacttgattcgcatacgcttcagatggaagtgacctatgtcgatggcagtcataaagtattgcgtggcgaaaaaggtcaagatgaggtcactttttatctagatggtgaactctttaccgttgttagccagcaagagctcaatgcttatatcgaggcaagccaaatttgatcgtttgatcggcaaatggtttggttccgactgcgcattcagtctgcgagcagtacctcagccgcaacaggttatgatgaagagccaaggagggttcacacctcggtgaggtgtggaaaagatcactcataatcaaaaggttgctttttacgttgcaataaaatctttcatttagtcgatactgatcgtttgtattcccctgctgtcagcgccatactttctattcacctgctttcatttaatactggccaccgtcatcgcccaataatgtgacttacaaaggatatgagcgaatggatcatcgcttttcgaccaaactgtttctgcttctcatgattgcttggccgcttttattcggatcaatgagtgaggctgtagagcgccaaaccttgactattgccaactcaaaagcatggaaaccctattcttatttggatgaacagggacagccttctggcatattgattgatttttggttggcttttggtgaagcgaatcatgtcgatattgaattccaactgatggattggaatgattccctagaagcggtgaagcttggcaaatccgatgttcaagctggtttgatccgttctgcttcaagattagcgtatctcgattttgcagaacctttactgacaatcgatacacaactctacgtacaccgcacgttattgggcgataaattggatacgctgctatcgggggccattaacgtctcattaggtgtagtaaaagggggatttgaacaagagttcatgcaacgagaatatcctcaacttaagttgattgagtacgccaacaatgaattgatgatgtctgcagcaaagcgacgagaattagatggttttgtggccgatactcaggtcgccaatttctatatagtggtttccaatggcgcgaaagattttacgccagtgaagtttctttattcagaggaattacgtccagcggtcgccaaaggcaatagggatttattagagcaagtagagcaggggtttgcacaattaagtagcaatgagaaaaaccgtattttaagtcgatgggttcatattgaaacgatttatccacgttacttaatgccgattctcgcttcaggtctcttactcagtatcgttatttatactcttcagctacggcgtaccgttcgattgcgaacacagcaacttgaagaagccaatcaaaaactctcctatttagcgaaaacggatagcttgacggacattgctaatcgccgttcgttttttgaacatcttgaagcggaacaaacacgatcaggcagcttaacgttgatggtttttgatattgatgacttcaaaaccattaacgatcgctttgggcatggcgcaggagataatgccatctgtttcgtggttgggtgtgtgcgacaagctttagcatcggatacctactttgcaaggattggtggtgaagagtttgctattgtagcgcgtggtaaaaatgcagaagagtcgcagcagttagctgagcgaatttgccaacgagttgcagaaaaaaagtgggtagtgaatgcccaacactctctgtcactcaccatcagcctaggctgtgcattttacctacacccagctcggccattcagtttgcacgatgccgatagcttaatgtacgaaggaaagcggaatggaaagaaccaggttgtctttcgtacctggtcataactgcactctttttagtcgaaaattggatggtttgctcaactcataatcaaacagcatgcaaatgattaaaaaggggttttcttttcgtaagagtgtggcatagtagcggcgtctcttcgatgcgcgggcatcgtataatggctattacctcagccttccaagctgatgatgcgggttcgattcccgctgcccgctccaatatcctgcacattacctcatatctaccaacgtacaatagcctgaataaatcaaaaagcttaagttaacttcgtgcattttgttacgaggtaaattatggcgcgaattgcgtttacggctccccatcacaaagccagtgaaaccggtttagatatccttcgccaaagtggaacggcttgtgaggctatggtcgcagcagcggcgatgatcgcagtacaatatccccacatgaatagtattggtggggatggtttttggcttattgccgctaaagacaaaccgcctgttgctattgatgcgtgcggatcttcggcgcagagtattgctctgacggattatgaccctgcccaaggattaccacagcaaggtggtgccgcagcactgacgatggcgggaaccatttcgggttggcaaacggcgttgcagctcttttcatcagggatttctctctcaaccctgcttagtcctgcaattcaagcggcagagcagggaattcttaccactccgagtcttgccgcggcaagtcataaaacgtggaaccgattagctaagttagaaccttttgcacaaatctatttgaatccttttcgagatacgctcaaagtcggtgacattgtcacgcaaaaggcgctggcgaagacattgacccatttatcccagtttgggcttgacgctttttaccaaggcgagttagctcaacaaatggctaaagagttggaagaggcaggaagccccctacgtttagcagactttatccagcataaagccagtatcgttactccgctcactcataatatgtcccaaggccagttctataatctgggggctccgactcaagggttagcctcgttattgattctgggaatttatgatcgactggcgcatcaggcgagatcgcaagccgatcatgtccatctgctcattgaagcaaccaaaattgcgtttgatattcgtaatcgagcggttactgatgaaaaatacattccgaccgcgctgcaaaattacctcattgccgaacgagtcgataaacttgcagagaaggtaaatctctctcaagctgcagcttggccgcaaaaaacgcaacttggtgatactgtctggatgggcgcagtagaccgatatggcactatggtaagttttattcagagtatttactgggagtttggtagcggtgttgttctaccttctagtggagtgctctggaacatacgtagccaaagtttttctttggatcccgaacacatcaattgtctggcctcacgtaaaaagccatttcataccttgaatcctgcctatgccgagcttaaagatggccgaagaatggtttacggaaccatgggcggagatggccaaccacaaactcaagcctgtttgatcagtcgttacctatatcaaggcgattcactggagcaatcgatcgcaaaaccccgttggttattggggagaacgtggggagatagcacgacaaaactgcagatggagtcgtctttgatggggcaactcggcactgagttgtctgcccgcggtcatcaaatcaattcggttcccgatggtattgaattgatggggcatgcaggagcgattgttgttggtacggattccagccttgaagtcgcaagcgatcctcgcagtgatggcgctgcattacaactgtggctggaataattcccgtaaacagtaccttatgccggttaagtcgattattatttagaacccgacagtaacatgagaatcaagatttgatgaagttacccttacgcctaagctttggatgtttacttgtgatgtcgttttctgcaacggcaaaaagctatgattttattcaagaacatcttgagcaagctttctcatcaagtgtggttttgtcggatagtgatgtttttactgcagggttcaacaattttgatcctaacgattggtttaaaaccgacaatgacaatttgggtacacctgaatcgattgaaaaccgcaagaaatataaatcgagtacgctccccatcacacttgctttaagtgaggaagaggcatatcaccagcatcagcttttctttcgtctttccgcctccgtcattgatgatgaattgagtattgccaatatgcccggggaaacggagcgctatcgtcaatcggtgctgggcggggcgatattttatcgttatcaatatcgactaaccgatcactggactttgacgccggcgattggaacgcatctactctattaccgcaacacagtgacctataacaacccccaatttaaaatgctcttctcgccgttagatgggctactggttaacacttatgcttgggcaaacttggtcgagacgaatcttaagattcagtacgaagaagaaaaaagctggggtcgctggaaggcctcatcggcatggcactattttggtggctacggttggggtaaagccaataatggtgaagtgggtaatccagaagggtggtatatcgccaacaccttaacgggtgtttatgacttcactcagcttggccgttccgttcaatcaatttatggcagtattaagcgagttgatgtgggtagtacaccacaagagccgttagggacatccaattattatgaggcgagttttggttggttaatgacaccgccttttgagatggaactcgttgacaatattggcttaggactgacgtttaactatggtagtgcattcaagggcgggagcattgtgctgtttttcaaccaagattagctagcgactttgacacaattgcgcccagcttgcttcgctttataaagtgccccatccgctgctttgagtgcctcaataggatggcggtacagctcagaatcacacacgccaatgctgatggtaatagtgacaatgtcactgttactttttcggctgcgtttttttgcaccttcagcatgacttttcgggcgctggttggtgtcacgaatcaccaactcgtaggactcaatatcctgccgtaaggcctcgatgaaaggcaaaacctcctttgccaattttcctttgtaaataatcgagaactcctcaccaccatagcggtaaactcgtgctttaccgttgatttcacgtaatcgagaggcaaccagtcttaatacatcgtcccccgtatcatgcccgtaagtatcgttaaacttcttgaaatggtcgacatcgagcatagcgagggtaaattttcgacctatatgttttaaatcctgatcaagcgcttgccgaccaggaatttgggtgagtgggtcgttaaatgccatctcatagcccgcggaaatgaggtaaaccagaataagcagcccagataaggtaaacatgatggtggaaatataaggcacatgaaacagcacaaacgcattcatgctcaatacaatcgaactataaaccacaacatcaagaatttgattgcgcgttaataccgagatagcagcaatacctgcgagtgcgacaagataggcaacaaccaccaagggtaagcgagaaatttgcggtacaacgaaaaatattccctcggtgaggctggaatggtctgtttcacctatgtgtagctgggtcagccaagcccaaaagatgaacagcaataaaatagccaagtaactgagaaaggatttgctgaataatccagcattcttgtaggcgtaaggtaaaaaacaggccacaggcaaaagcaagctcagcataatgagttcaagcatggtggaattgacggttaaaggcgtttgaagtcgaatttggatcaaccagtaagccagtaacatcgtcatcgctaccatggcgattctgctttgtttaaaaatgtgagcaacggttagcgcaatcaaaaagagaatgtaggggaggttgaccgccatgcctaagttagactttatcaccaataccacattgctcaagcctagccaaatggctaccagcagcaatagaggaaaaccgaaacggaaccaaggtgaagtaacaaagctagaagacatgaattcctgaggttctacattgaattaatgataattctacaattaaaaattgtaaccaaggatactttgatttcgtgaatttccaagctttttactcaagttcagtgatgaaaactatgcttattgcgtaagtatattgtgacaagtataggcttgattaaagataaagtttggtagattcggctacagtgatctcatggcgtcgtgcagaatctacaatctatacacaagctacttgccgttgcagcttgtcattgcagcttgccgaccctgacgcagcttcaagtaacaaggtcactatcgatgagaagtgcaatgaaacgtagtgttttgacggtttagcaggagaaacaagatgcaattgagcgaagatgttcataattatatggaaactctggttggccaagtgcttgggcaacctgaatactcagagacttacgaccaagatcagctcgctgatttggcctgcttggctttgtgccaattacgacctatctatattcgccatgacatcgattttctttctgcattgccagaggccaaactggttattcttaaagatcatgctctgatcgctgttcaagctgctgaatccatgatagttaatgatcggcgtcgtaatcgagacagtgatgtgcccgtgattttcacacatgcgcgttttgatgatgatgccgaattggagtggtttgaaactccgatcgtcaaccaagttcagcaccataagtaaggaatcaaagtgggattattttcgcgcctttttggtaagccaaagcagcaagagccggttcaggtagaacccatcgaatataaaggttttatgatctatcaagagcccatttctgaaaacggacagtttcgggttgcaggtcgaatcacacaagaaatcaatggtgagttgaaaacccatcgttttattcgctctgatttggtttctaataaagcggatgcggaagagttgatgctcaagaaagcgcagctatttatcgaccaaatgtccggccaaatcttttcctaacacacccagatattgataaatatcatgaatatcacttatgccagaggctatgcttaggctcttttcaatactggcataatctaactatctgtttttataaaagataattacaactggtttgacctctgttttgtgtgaaatccgttgtaattatctaacagacttcacacaatcagtctcaacttggcattaaaagtaaccaagcttcgtaattgaattacaaacagcttgcagttcatgtcatcgtccgataaaaacagataatcattgtgccaatagtcaaggaaccgctatgcaaattggtgtaccaagagaacaactcgctggtgaaacacgagtcgctgcttctccctcatcggtagaacagcttattaaattaggatttgaggtttgtatcgaatcaaaagccggagcgcttgccagtttcgatgatgccgcttataccgcagccggcgctacgatcggctcacgtgaagagatttgggcttgcccacttatcctcaaagtcaatgctccttcagatgacgaaattgctcttcttaaggaaggcgcgacactcgtaagttttatttggccagcccaaaatcctgctttgatggaaaaactctcaagtaaaaacatcaacgtactggcgatggatgcggtgcctcgtatctctcgtgcgcaagcattggatgcactctcgtcgatggcgaacattgcgggttaccgtgcagtggtagaagccgctcatgagtttggtcgtttctttactggtcaaattactgcagcaggtaaagtatcgcccgcgaaagtctttgttgctggtgccggcgttgctggcttagcggcaataggggctgcgggtagtttaggcgctatcgtccgtgcgtttgacgttcgtcccgaagtaaaagagcaagtgcagtctatgggggctgagtttttggaagttaacttccaagagactgctggctcaggcgatggttatgctaaagagatgtcggatgaattcaaccgtaaagcggctgaactttacgccgctcaagcgaaagatgtcgatatcattattactaccgcgctgattccaggaaaacctgcaccaaagcttatcaccaaagagatggtagatagcatgaaagcgggcagtgtgattgtcgatctggcggcagcgaatggcggcaactgtgaatacacagtcaaagatcaggttattaccacagacaacggcgttaaagtgatcggttataccgatatggtagggcgtctgccgacccaatcatcgcaactgtatgcaacaaacctagttaacttgctaaaactactctgcaaagaaaaagacggcaatatcgacatcaacttcgaagatgttgtgctgcgtggcgtcaccgtagttaaagccggcgagattacttggccagcgccgcctattcaggtatccgcacagcctcagcaaaaagccaaagtgcaaccgactaaagcgcagaagaaagagccagagccgacttctcctgttaaaaaactggttggtttagccgtgggtgtcggtctgtttgcgtgggtagcttctgtcgcaccagccgcattcttaggacactttactgtgtttgtcctggcctgcgtcgtgggttactacgtggtatggaatgtaactcatgctcttcacacacctttaatgtcagtgactaacgcgatttctggcatcattgtagtaggggcattattacaaattggtcaaggcagcggtattgtgactttcttggctttcatcgccgtcttaattgcaagcatcaacatctttggtggctttaccgttaccaaacgtatgcttgaaatgttccgtaaaaactaaaggagtacgcaatgtctgcaggattggtacaagcagcgtacattgttgctgccgtgttttttatcatgagtttggcgggtttatcaaaacaagagtcagctcgtatgggtaactactatggtattgctggtatggcaatggccttactggcaaccatttttagccccaacgctgaaggtctcgcatgggttttactggctatggtgatcggtggcggtattggtattcattacgcaaagaaagtggaaatgacggaaatgccagagctggttgcaatactgcacagctttgtgggtatggccgcggtactggtaggttttaacagctacattgatgcccctgaggccgctacccacgcggaacatgtgatccacttggttgaagtatttctcggtatttttatcggtgccgtgacctttactggttctattgttgcgtttggtaaactgcgtggcatcatcaagtccacaccacttaatcttcctcacaaacacaaactcaatctggcggcattagtcgtttctggcttattgctgatccactttgtgaatgtcgatggcagtgtgtttgcgctgattgtgatgacgttaatcgcttttgcttttggttatcacttggtagcgtcgattggtggcgcagatatgccagtggtcgtgtctatgcttaactcctattctggttgggcagcggcagcggcgggtttcatgttagccaatgatctattgattgtgactggtgcgttggttggttcatcgggtgcaattctgtcttacatcatgtgtaaggcaatgaaccgctcattcattagtgtgattgctggcggttttggccaagaagtcgtgatcagtagcgatgaagagcagggcgagcatcgtgaaaccagcgctgaagaagtggctgaaatgctgaaaaactcgaagtcagtcatcatcacaccgggatacggtatggcggtcgcgcaagcgcaatatcccgtgtatgaaattactgaaaaacttagagctcaaggtgttacggtacgatttggtattcacccagtcgctgggcgtttgccaggtcatatgaacgtactcctcgctgaagcgaaagtaccttatgacattgtattggagatggatgaaatcaacgatgatttctctgataccgatactgtattggttattggcgctaacgataccgtaaaccctgcggcacttgaggaccccaatagtccaattgcggggatgccagtgttagaggtatgggacgcgaaaaacgttatcgtctttaagcgctcaatgaatacaggctacgcaggcgtgcagaaccccttattctttaaagagaacaccatgatgttgtttggtgatgcaaaggagagtgtcgactcgatagccaaagctctataaaatcgacgccgttaagaagccagcataatgctggcttctttgttttgtagactgtcattattgacatcaatataacactcgaatatctctttaccggataatgcgttatagtttttgcatgttagaaaaaaccaatattcccttgataagagcgcttaatctcaccttggtaagcttatgttttgccatgttaccgaatccagttcacgccgattcgcttcctgagcgcatcgacttgtttgtttcgctctttgattataattctgcgacgacgtcttacgatatccgatcgattcaaaccgatttccccacgcgcttattaacaccagatagcatgttgccgcaaacgtctgaatatccgcttaaagatattcaactgctttataaattggcacaaagttgtacaggcaagttgccgttaagcccattgatcactgaacctttggtgtttactcgttcactctgcaaaggctccagcttgtcaccacgctggtttgcccgcagtggtttgattcatcctggcggtggaacttacgcatttcgctatgcggaaaaatacccagcccagtttgcgaacttgctgccttacatgcacatccaagagcgtcccaatgccgcagagggaaccttactgtaccacttacaaaatatgggtgaagatgcgatcaatgctttggtgtctggtgcatccatgtttggctccggtagtgatttatggttaagaaaaggggatatctactacctttttaatgaagaaacgtggttaaccaatgccaataaagctgggttaagctatagcttgctatcagcagataacacctgctttattcagcgtggcaacatctgttgggatgtggaagatcattcagatcttttacgaactagcatgatcattcttgttattgccaatatcttccttgtgcttggttggtctgggtatcgttggaattcaaaacgacaagaaatgcgcagtcggatgctcattttgcaaattctcacccatgagctgcgaaccccaatcgcgagcttgtcactcaccgttgaaggctttcgacgtgagtttgagcatttgcccgaatctctgtacgatgagtttcgtcgattgtgtgaagattcccgacgattgcgccaactcgccgaagcgagtaaagactatttgcagtctgacagtaaaccactcgcgtcagattgggttccttcggtggaggagtggctacaatataaagtcgaagaagaatttagtggtaatgtgactctgaaacttaatcaagatatcgctgccaaactcaatgtttattggctaggaacttgtgtggataatttattgcgtaacgctgtcaaatacggcgttgcacctgtcactctcgaagtgataacacaaactaacttagtcactttcaaagtgaccgaccaaggctcgttgactcaccgtgattggcgtcatttacgcaaaccatttgtgagcaaaagcggcttaggccttggattgaccattgtcgaatcaatggtgggacgaatgggcggaaaaatgtcactcgaaggcccaccgacaacttttattttggagataccttgtgaaacagacactgcttctcgttgaagatgataaaaacctcgctgacggtctactcgtcagtttagagcaagccggttatgactgtttacatgcagaaacgatcgcagatgtgaaacagcattgggacaaggcggatctcgttatccttgatcgccaactgcctgatggtgattctgtacagcatctaatggattggaaaaaaattaaagatatcccagtgattcttttaactgcattggtcacagtaaaagacaaagtgactggccttgatgcaggcgcaaacgactatctcactaaaccttttgcagaagctgagctgtttgcacgtatccgcgcacagctgcgctcaccagatagtgggcaagatgacagtaaagtggtgacgtctaacttaacaattgataaagcgactcgtgaagttttcttcaatggcgaatcgatcaccctaactcgaaccgagtttgatttactgctctttttagcgagtaatttaggccgagtatttactcgcgatgaattactggatcacgtatggggatataaccatttcccgacgacgcgcaccgtagatactcacgttttgcagctgcgccaaaagttgcctgggcttgaaattgaaacgctacgcggtgttggttacaaaatgaaagcgtgatcatggttaagccaaatcctcttttatggttaacaggcatgctactcagcacgcctgcttttgctgatccaacggggtggtttgaaaagaacaccccgttaactcaagctcatcaacatctcttaaacaatgatttagaaagtatgttcagctcattggtggaagtgtggcagcttgaaaaaaataaaaacctgaaaacacatctgaacaatttattgattcagtctttaagcgtggattgcggtcgagggctagataacaagccatttccagattggatccagggagtgaccattcgacgagttgatgtgcaaagccctggacgagatgcttatcaagttgcgattgataccaaaaccaaagttcctattaccgatattcgtctaaccaaatgggtggataaagtcgtctctaccgacagttcgcttaccaatagaagcgacagtgtcacaacaaacatttatacctatgctcaacgctataatttgacgaacccattgagtgcagggttgtatcgcatcgatattaccgccgcagatcaggaatcatggagtgcatgggtcatttttggcgacactatagccaagcaagtggtgcgttggacatcaaaagatgagtggcagattcagaagaccgaattgcttaattcacactgtccgttaccgaaattatctatttcagtctttgatcatattgatggtaactataaacagatttggagtgagagttatgaatcggattacccaaccacgttagataacgtttcgttaccgtcagatcgttacattgtcacagtttctatgattcaccaacgttggcaaggaccgctagctattgaacaatctcaagttattagcaaaacctatgatgttaatgtagaggaatagctgaagatattggacaatatgccgctatagaataaaaaggacgaataggcttatatcattatgaaaagaatttctctttctgttggtttttcattagttctcacatctccgctcgccttcagtgcaaattatgcagttgaagcacgcggagatgctatgggcggtgtcggggttgtatcaggtaactttctcactggccctttttacaacccagctctggtagccatttatcgccgtaatgatgacgcaggtatgattttaccgagtattggtttgtcttataacgatcccaatgacctcattactgatttggataaggtgtctgacatcatcaaccaaagctctaaaggtgattacagcaatattggcgaattaaataagagcctaaccgcaatgcaaggggacgtactgaatgccgaactcggcggtgtagtagcttttgccattcctaaccaatttatttctgctaacgtttttggtaaagcctacactgaatcctttgtttcaccgattattgatagccgtgtctgtgcggatgatctttgtgagctagagcgcgcaaaagcgagttcggtaaatgccgtttctgtcggaattactgaactcggtattactttagccaaataccaaactttccttgggcagcatatcgcttttggtattacaccgaagttgcaacgagtgtatacctatgtctacgaagcaagcctaaatagctatgatataaaggacctccgtgataatggaaacggagaaaccattttcaacatggatgctggtgcattatggttctacggcccaatccgcattggttttgctgcaaacaacctaatttctcgcgaaatcaaaaccaaaacgatcacttctgccgtctcaggcaatcctatctcatactcatacgatatgaaaccgcagtacacggtgggggctgggattgttgctgattacttcacactaagcgtggactacgaccttaatgaagaagagcgctacaaagacttcaaagacaacacacaaatgatccgcgtcggtggcgaaatcgatatcatgcgtcagttaaaattgagggcagggtacaacaaaaacctcgcgtacgataatactgaaggaacggttacggctggtattggcttgtcgccattgaatctcttccaattggatcttggtgcaagttataccaatgaaaatgctatgggtgcctatatcaactttcttgcgagttattaagcatctctttatagtgtggctcctttaaggagccttatttatgtttgatgatctacccacattaactcacgctgaacagcaagtcgccgtagagaaaattcaaaaactgatggcagaaggcatcagtaccggagaggcaatcaagattgttgcccagcaaatccgagaggataaaaaagcgcaaaaccaaggcactcattgagtgccttttttattatccgctttaacggtggtaataatcgtagccaatttttcatacaccaaacctgctaaaaacacgccaccgctcgttcatttgtaatttttaaccattaaaacaacaggttgcaagagagcattgtgctacctgctttcgattttcttatggagaaatgattcgtgtgtaattaaattacactaaataattaccacattgaaacaccagcataatcaactgataaggttgcaacgtcacgagttgatgattagaatgctacgaacacttaatgcgcattacgtgcgttatgttaaattaaggcataaaaagaggtcgcaaaccccaatctgctccctattcttaatccagcattaaacataactgtatttaccataaaatacctaataatcatatttatcatttgacaatgttaagcatgattattaatgacagtgtttgtgtaatcccttgatttgaaaacctgttaccaacacatttcaaatgtgtttaggtttacttcgctaaaaaagaactccacactaaggtggagttattggcagtttggggttacacgaggagtaaaatacgacttaaccacctgctaatttgactttgtgtcctttcgattcaagcaatgttttgagttgatctctaacatctccttgaatttcaatatcgccatcttttacagctccaccacatccacattttttcttgagttcagcggcaagcagctttagagcggcatcgtcaaggtctaaaccttttacaatagtgacaccttttcctttacggcctttagtttcacggaaaatgcggacaataccatcgccttttggacgctctattttttcatgctcaggcttaatgcgcccgacttcggttgaatacaccaatgtcatacttttactatcttttttgttgcgcttgttgttgcatcgctcgttgtcttgcaacgaggtaagcttcgatatgtttttgaatggcgattttggaacctttaatcaaacggccattaaaaaagcaataccactcattagcttcaccggtatcgtttttgatagtgaagccattgaattgctcttgagctccggccgaaacttcacgtttttggccgatcgactcaaattcttttggatcaataatcgatgcagtatcgcaaaaccagtcaatgctcttctttaccgcagccaaattacccgtcaatacgtggttttttatcctgacttgccatatttcagttgaattggcagccgattggagattgaaacctcgatagattgcaacagccatagatactctgcttttttatccctaggtacctaaataataattctatatctcaggttatcaagtatattgtcgctaattctttagcttacatagagttatctcatgtctgttacgaccttttccaaccaaatcggcggagttgagtgacaacgtcacccgtctcctaatgccctacttcgcatttactaatgtgttggtgacacattgcacgaggaattcactaaatcggtgtccgttatgctctagcattttcggaaacatggaaatcggtgtcattcctggaaatgtattgacctcattgaggtaaatttgtccctcttgagtcaagaaaaagtcgatccgagataaatgacgaagcttcatatggatgaatacacgttcagcatatgtttgaattaattctttgtgtttctcggttagattttcagcttctaagacggttctggcgtggctattcgcactgtacttttcttcatatgaatagaatgtaccttctggtgcaatcacttctcccggttttgagatatagagttttccgttcatctcataagcagaaacctctaactctctaggtttaacggcttgctcgacaagaacttgctctgagaaaccaaaagcagcctcaatggcgggggcaatctgatcttctgtggttactttgtagcatccgactgaagaaccctgacgagcagctttgacaaagatacttccccaatgaccaaaagcttgcttggctttatcaatcgagcttggtgtattttgggttaaaaatagatacggtgtgttaggaatatctaatgcgtcataccatagtttggacgtgattttgttaaagctgtttgcactggcttctggcccacagcctagataaggaatgcctgccagttctaacatggattgaatatccccagtttctcccgggaaaccatggatgcaaggaacaacaaaatctattgggtaggaagccttatcgctatttaatgttgcgctatttgtatcgaggtatacaagggctccttgttcggaaaaccatccctcttttttcatctcgactcgaatcacgtgaaactctggagtcagttcaagctgttgttggatgtagttggctgatacgagagaaatttcgtgctcagatgagccgccaccgcacaaaagtaggattgttgtcttagtcattaatctttccgtgacaccgaagtagtaattgatggctatgatagttcattcaatgtgaagtttcagtcaatgttatcgtttctcacgaaaaccttattcaactgctcacagaacaaacaataaaggggcctacgcccctttaaagaagtattagttgagcttattaagcgtcgggaattccgagttcttgatcgaatcaatgctcttcacgaaaggcttcatttctcgcaattcaactggaaggcttgaaatagcagcggcggcctcttggcgagtcgcataatctccgtaaagtacggtataccattttgtaccattgaccagtttgtagttttcccaaataggttggccatttctagggagtttagatgcgaattggtccactttactttgcgcacccacagcaaccacttgaatggtaaaaccataacgaggattcattgcgacttgtttggcgctaggcggagtaatggagacggcaggcttagcctgtggactcatcttgactacttttttctcgctgtccggcgtcatttttacaacgttttgttcaacgttctgctcagaaatgccgtctgccacaccatattcggaaatgacaggctgctcaacagcggcaactgaatattcttcgcgatgactttctgtcttcacgtctgtggtgtattcaccggatgcgcaagctgcaagaagtgctgatagcccgataactgcgatttttttcatagatatagtcatgccttaggtacaaagtgctttaaatcatgcacattgcaaccaagagaatcaagcttaccgagtcattatatgcatctatcctgtgatttatggcacaaactaaccaaagggaactgtaaactcgatcacagagggctgttctcgcccaacagagctcacaagaattggttaccatataaacagacattccattaggtaggcagggtatggaccacttgaatcaactgcttagacccaaatctgtcgctgtgattggggcatccgttcggtctttccgtgcgggtaatattgtgatgaaaaacttacttcaaggtggttttgatggcgccattatgcctgtcacgccctattatcctgccgtttgtggtgtattggcttacaaaacgatttccgacctcccgattgtgcctgatattgcgattctttgtactcacgcctcgcgcaatgtcagcttatttaaacagttagccgagaaaggcgtcaaacaagtgattgttttatcttccgatatgtactctttggatgcacaaggcgaagaaattcaagcccagtgtatgacgatagctaaatctgtgaatatgcgaattttggggcctaatagcttggggctcatcttgccttggatgcaattcaatggttcgttttctcccgtttcagccttaaaaggcaatattgcttttgtgtcacaatctgcggcggtatgtaccactatccttgattgggctaatgataaaggtattggtttttcagcatttatttctttaggcaatgcaagtgacattgattttgctgacttgctcgataccctcagtaccgataaacataccgatgcgatcttactgtatgtcgatacgattcgtgatgcgcgacgttttatgtccgctgctcgcgctgcgtctcgcaatcgacggatcctcgtcttaaaaggtggtcgtactaaagccggaagaaaagcggcacaaatgcataccggtggcgatgatactttagacatcatttacgattctgcgattcgccgtacaggtatgctccgagtcaataacactcacgagctgtttgcggcggtagagacattgacccattccgttccactgcgtggtgaacgccttgcgattattacgaatggtggtggcccggcgattatggctgttgatgcattattagagcgtggaggcaaacttgcccagcttgaagatgagatttatgaaaagcttaatcagtctcttcctcaaagttggtcacacagtaatcctgtcgatattgtcggtgatgctgatcatctgcgctatgtctccaccttaaacattttgttggaaagcgagaacattgatgcgattttgatcatgcatagcccttctgcaatcgcgcattcagaacaaaccgctcaagcactggttgaagccgtgcaaaagcatccgcgtgccaaaagatttaatattttgaccaactggtctggtgaattatctgccaagcccgcacgtactcttttcaatcaggctgggataccgacttaccgtacgcccgaaagtgcggtgacggctttcatgcacttagtcgagtaccgacgtaaccagaagcatttgatggaaaccccgaccacaacagaagtggtacatgcttcagagatgcaaactgcaaagtcatggatacatgaacacttaggtgaacatgatcaggtcaatctcgatactcatcaaattggcacgttgcttaaatgctttaatttcaatgtattgccaacatggattgcttctgacagtacagaagcggtgcatatagccgagactattggctaccctgtggcggtgaagttacgctcccctgacattgcgcataaatccgatgtgcaaggtgttatgcttaacttgcgtaaccggatagaagtggccaatgccgcgcaagcgattctggatagaactcaactctcctacccctcagcgaatattcacggtttattagttcaagggatggcaaaactggctggcggggaagaacttaggatcaaagtcaaaaccgatgcgacttttgggccagtgattttattagggcaaggcggttctgagtgggatgaatcactcgatgccgctgccgcgctcccccctctcaacatgacgctagcgcgctacttaattgttcgagcgatacgtagcggtaaaatccggctacaaaaacttcccgtccctattgatattgaagggttatctgaatttttagtccgtatttcacaaatggttgttgaatgcccacaagtgcatgagctggatatccatcccctgcttgtcaacggcagccagtttactattcttgatgctaatttggtgctacgccaattcactggcgatgcccaaagccgccttgctattcgaccctatcccaccgagttggaagaaaggtgccaagcacgtgatggagagtggcttactgtacgccccatattgcctgaagatgagccaaaacatgccgcctttatcaagaaagtatccaaggaagatctctataagcgctttttctctgatgtcggtgagtttaaccatgaagctttagcaaacttaactcaaatcgattttgaccgagagatggcgtttgtcgcggtgagtggtgaaggtgaggattcagagattattggcgtttctcgagcgttaattaatcatgagaataccgatgcggaatttgccatcttgattcgatcggatttgaaaggaaaagggctaggtaagatattgatgcgtaagattattgattattgtaaagccaaagggacgcagcaaatgtcgggcatgaccatgcctaccaatcgcggcatgttaaccctagcgcaaaaaatgggctttgccgtcgatattcattttgaggatggcactgctgacatggttctgccattacgctaaatataaaagtgacagaagatctcaaggatcctctgtcactttttttgatctactcccagcgccaattcttcttcaggtattgaatacaccaagatttggcttcacccatctggttacgtcgccaggcaagtacgatatccatctctagatcttcagaaccatgaatagcttttagttcacctttatcaatataaggttgagccacttgcaatggcagagtaccaatccctaagcccgccactaacgctttgcattttgcgtccaaattactgaccgttaagcgaggttgacgctgcagaatgtttacactcattgctggctgttcacgagccgtatcggcaatggcaatagcacgatacttttctctggcctcttcattaaactcccccgaacgacgatgcacatagtgtgtcggcgcggcaacccagatcattttcatcgtgccaatggtttctgctttcacatcctgtggtaaggcttcgatgcgcgggcagatcaacaaatccgcacgccccgtcgctaaggcttcccagcaacccgccaaaatttcatcttgaatgcgcactcgcgttttactgatgttacccagtgcttcaaccataggaaaaagattcgctgcgggcacaatgccatccagtgcaatcgtgatatcgagctcccagccattagccagtaacgtagcatcattgaccaatttttcggtcgcagccaagatggccctgccccgctctaagataagtttgcccgcttcagtaaaattggctcgatgaccggagcgatcaaagatcatcaaatccaaatcctgttcaagcttttggatttgatagctcaatgaactcggtgctcgattaagctcattagctgcggctgcaaagctgcctctacgctcaattgcatccaaaatatgcagcgcttcaagagtgattggacttaacaatgctctctcctattgatagttcacaccgccaactgtgatgagagtcacaattagcaacatcataaatgccattatgaataatataaccctttgattataaaattcatttagaaaactcaagtcctgttcttttcacattaagcaaacaattaaacacaaatgatagcaattatcattaatatttattagaattcctgcgttttactcaacatggaaattgcaggtagttcaaatgtataaaaagtctctgctctctagcgcgatcatgctagcactcgtgccttcagcatacgcggatgattatgcctcattcgatgaagtagtagtatctacaactcgcttgaatactcaaataactgacaccgcagcatcagtcgctgttatcaatgcctcagacattgaacagcagatggctgaagatatcgaaggcctattcaaatatacccctggtgtaacattaacaacgaattcgcgtcagggcgttcaagggatcaatatccgaggtatcgaaggaaaccgcatcaaggttatcgttgacggtgtagctcaacccaaccagtttgactccggaaattcatttttaaactcatctcgagttgatatcgatacagatatggtgaaatcggttgaaattgttaagggtgcggcatcatcactacaagggtcagatgcaattggcggtattgttgcttttgaaaccaaagatcctgccgatatactcaaaggccgtaatatgggtggctatgcgaaactgaattattcgtcatcagacaaaacatttagtgagtctatcgctttagccaataaatctggtgatttagaatcgttagtcgcatatacgcgccgtgatgggcaagaaatccaaaactttggttcgccagaccaacaagataacaatgctaataatttactagtcaagttacagtatcagctaaatcctaagcatagacttgaattttcagggaactatattcgcaataaaaatgatttagaaaacttagaattttctggctacaagaacgcttctggtactgatgaaacgactcaatatcagttaggcattaaacatatatgggatgccgagttttctcttgctgatcgtataacatggcagtttgatgtcgtaggtaaagaagagactggtattactgatcgcacaagcaaatcaaatggaaatattcagaaaaaagattatttatactccgataagggtttttcatttgatagccagttagacaaatcatttatggtttccaatacagaacattatatcgtatatggtttttctttaagtgataaagatatagaaaatacaaaccaagagtttaactcaattgggaaaaacaacgttattttctacatacctaatgcatctgaaaaacgttatggcttttttatccaagatgaaattgcattcgataacttaatcgttactccagggatccgtttcgattccttcgaaacaaaacccggagatacaagtgctaacccgagcctaaatgatgcaagtgaatacaagaaatattcagactcagcattaacagcgagactaggtactgtttataaattgaaccaagaaaatcgtctgtttgcacaaattagccaaggtttcagagcaccagacttccaggagctgtattactcttttggtaatccagctcatggatatgtttttaaaccaaaccctaatctagaagcagaagacagtgtttcttatgagcttggatggcgttataacgcagatagtgtaagtaatgaactatctattttctacagtgattatgataactttattgatagtcaaattgtatctggtagcttcaaaacaagggatgctgtacaccaatcaattaatattgataaagcaacaattaaagggattgaactttctaaccaattcttttgggatagatttatgcctattgtaggctttagctctcgtattgctgctgcatatacggaaggcaaagatggcaatggaaaaccactcaatagcgtaagtccttggaatgctgtcactggtatcaattatgattcagaaaataattggggtactgcagttaatctgacttataccgcgaagaaaaaagctagtgagatcaatggtgactaccaaccaatctcttcagcaacggttattgatgttacagcctactacaaacctattaaagatttaacactacgtgcaggtgtgttcaatcttacagatgaagaatattataactggaatgatgttcgcggtttacctagtgaagataaagataagactcaggctaagcgtaactttggtattacagctaagtatgaattctaaatccttctaaaaagcaccattttaccgtggtttaggaacgataacaaaaagccagcttacgctggcttttttcttaaagaacacttcattcaaaaggaatttaaaaggtgatgaaatgaattatttgttctctgccatctcttttttcaccattactgcagcagcaacgataaaagcaatgatcaatgccagttccacttatcctcctaagcgattctactgagttcgcacatagtctagcactgggcttaccgacaagcagtgtttattttgcgaaactggctaattagcgatcgagatcaaatcccacgagtgagtaaaagctagtgttctgacaagtctggctttacccagacttggctaaaatcgaaccaacctagcgcattgcatttcgcattttgtaacgcaccgcactgatctttactgatgcctaaccagcagtggaacatcgggatcagttggtgtttttccaccagtgatttccccagttctttcgcagggaagagcgcagaagagtcagcacgccaagcatcaatcaaactcacccactgattgaaatcctctcctttgctcaaaaactcaatatcggagtaattgagtaaccaccccgctaacgcatcatcacggtgattagcaatacccattggcttaatccaaatatccacattttcagtttcaacgaccgtgtgttcatatttgatgacattgactgtgatcccatcttggctgagcaattgtttaatcgcattagcaacagtcggaaacataggatgctgagcgtgataggcaatcgtaagttctttggattctggcggtaacgttctttgcgctgccgctgagtggtgataccacccgggttttaacccataggctggcaacaccccaagttcaatgattttctcttccggcagaagacgaaacaggttgagcgcattaagtttgtcagtgagatagcgcgcccaatgttcatctttggcaacgccattgcgacgattaagcagtaaataggtgcagccgggatccagctctacctcttccgttgatgatcctcgagcagttttcatcggattggataagcttggaaaaaccatggaagagtgcacttcatcaatcacccaaacttcaactcggtccagcagtggacgaaaaccaaaatagccatcaaacgcttgcaaaaccaaacgtttttcatcgtttagaaccactttgtagggccccgttcctactggcattaaatcaaaatcgggattgcgatcggactccgctgggaggattttggcacaggcttcggcaagcaatagcggtaagcgggtatcgggcttttgcagatgcacatcgaccgcccaagggtaaggtgagtcaactcggtcaatatgggcaaaaagattaagcaaccgtagctgccaaagattttgcacaatcagttcggtggtgaggagattgccattatgaaagcgcactccggggcgtaagtaaaaccgccagtgagtatctgatagcgcctgccaagcgtgtgctaaatcaggctgtaattgctcttcttcatcaagacgcgtaaggccgctaaacacctgtcgcgcaatatgctgttcagagcggcgcatcggcttttgtgggttcaacatcgatagctgacgatagtaaggcaacctgacaacttgcagaccttcttgatgctgaacgccaaggtagctttctatcacttgagttaattttgcggcgtcctgatcaagcacggcaaacgcttggcctatctttccttcattgagataacggcgcgcaaggttctcactgacatccgcgcgactgcgtttaaagatcagttgcgagagtttgccgcgccccgccgcaggatgccactcaatccacccctcttcttccattttattgagaacaatacgcgcattacgtcgagtgcaaaaaagaatatcggtgacatcttccagttgggtttcaacgtcttgaccttgaaaatgctcaaagagtgtttcgaactgtacacgtaaacgcgggctgctcataaagaggaaatctcatctaacttctaattctagacagtttccttattttgtaagctttagcaagcccaccgcaaaaacttttaaagcaagtcacaacctaacgtttgagcaatggcgctcagttgctcttcatcatcgagcttcactgaccatttgctttcactgccattggcgatcatcacatttgccccctttcccattagcgtgatggcctccgcttgggcttgcaaggtaacgcgattgtcgtgtccgagccgcacgacaacttcatggggggttacaatgattttgccaccgctaaattgaatcaccatttaaacctcggctactggcttggcttgatttgggcgtgaacgtttcaccgcgaccgtcaaacggctaatgcaaaccagtcgtccttgttcatctttgatctcaatttgccacacttgagtcgataccccgatatgcaacggtactgcagtacccgtcactaaaccttcacgcatcgcacggacatggttagcattgatatccaagcccacacagtaagcgtcttcacccacactgaaattggccgctactgaacctaaggtttccgcgagcaccaccgaagcgccaccatgcaacatgccaagtggttgatgtgtgaaatggcacaccggcatagtggcggaaatgctattttctgtcacttcagtgtaaatgatatttaaatgttcaattaacgtatttttcgatgtggcattgagtatttctaaactgatgggcttattccaaatcgacatcgcttgagtcctgaacgagtaaaagtggctcattgtaacgactccatccagcgaacacaaagtcgtgcaccaactctgcgacagtaaagatgaggggataacattatgaatgtatggtgctaatataaacgccattcatcgatcgccacagaaataaggactataagatgaaaaagacgcaactggcgctcactttattaatgactcttggcttagcggcatgcagcgcttcaccgacaggccgaaatcaattgctactgttttctgacaacgacatgagtcagcttggcgcgaagtctttcacgcagatgaaacaggaaattccaatcagtaaagatgcaaaaaccaatgcgtatgtacagtgtgtaaccaaagcgattatcgctcaagtacccaagcaaagcagttttgagcaatgggaagtggtcgtgtttgagagtgaccaagttaacgcgtttgccttgccgggtgggaaaattggggtatacacgggtctactgaaggttgcggtgaatcaggaccagttagcgaccgtgattggccatgaaatcgctcatgtgctgtcaaaccacagtaatgagcgtttatcgcaatcacaattagcgaatgccggcttacaactgacggatatcgcaattggggcatctgaatatgcgcaatatcgtaatctgaccatgtccgcgctcggcgttggtgtgcaatacggggtaattttgccctatggccgcagccaagagtcagaagccgatatattaggattggccttgatggcaagagcaggctttgatccttatcagagcattgagctttggaaaaatatggccaaagcgtctggaggaaaacagccgcctgagctgctttcgacccacccatcacacagcacccgtatcagcgatttgagtgcaacgatcagtacactgccaccacatcaaggttctaaagctcagtgtgctctctagtttctggtttttaataacgccggttttcaggtgctctcgtctgctcaatactgtttttataaaaacgacgagatttcaaaaacatagcgccttcataaaacaaacatcacgtcaaaagaatcggatagcactgcgccctgatggggatttgctgtcgctttgtggtgattttttatcgttcttggcttttttttgtccagatacggttttgttgttttttgatggcttggatttggccgaagtgttggctgaagacttcttctgcgtttttgtcggcttgtgcgacgatgctagctcaggttgagtatcgaatgactctggctctgtcactggtgcatcacaaatcaccaaataaaactcttggttaaattcaatcagatcgccatcaaacactttgcagcgtttgcgagtttctacatcgccattaacaaacacatagccttcactgatcacgtgttttgcttcaccacctccacttacggcattggcaatttttaacactttgtacagctcaatcggctggcaagagacctcaacaccaatcgcttctatttcgatttcttcatcttgcgggttgaattgctcgtcggtcatgacactactctcaaaaaatttttacgcagtttagccttttcaaagttttttaccaacgtcaatccaaatagccactaaactaaagttaattaccactccttcaaacaaggcgactatgcgcattgggttactttttgcttcactttgcttgatgtcgacctgcctccatgccaagccgcaaagggtcaccatttttgcggatgatgcttatccgccatacagttatgctgaaaatggccgtgccgtgggtatctatcctgaaatacttcgtgccgccgatgttttgatgacagaatttgagattgagttacaacccatcccttggcgacgtgggctcaagctactcgaagcaggaagaatttttgctttgcttcccccctattattatccgcagcgccgaccttacattcatccttactcagaccctatcctagatgaagaggtggtggttttttgtcaaaacgcatggctcagcaaacgcaagtccaccgaatggcctcgggacttttacggtttaaccataggaatgaacgatggattcagcctaggcggtcaagcgttttggaaggccgtcgaagaaaagaaaatcgaggtgaaatacgctaacggcaatcgcgtcaatctactaaagttacgcggtgacagaatagattgctatgtcaacgaccgcatctcgatcttatgggaactcacacgattaaagcgtgagggcattgtcgataccgttaacttttccatggccgccaaaatcagtttagagcaaggctatatcggatttaccaaccgaaacctcgagcaatacccttaccagagccagtttgtagccgcattcaacagcgctcttgcagagctaaaaagcagcggccaactcgacaagattgttggccgctatattgagtaatgtggctcccttacgacgtcaagctacagcggtgtgagtgtgcagtaacgtgagccgtttgaggaaccatcaaatgccgtgatctttagcgtgttaccatattgcggatctgtttagctcgctcatcatcactgacgttactcggaggtggtacggttaaccctttcactacggcaggacgcgcagcgatctcgttcatccaacgctgtaaatgagtcagaccgtcaatcgagatcccactccattcatggattcgaacccatggaaaggtcgcgatatcagcaatcgtgtattcatctccggccaaatacgggttttgggctagctggccatccatcacttcaaacagacggcgtccctctttttgataacgatcgatagctggttggattttctctgggaaatagcgataaaacacgttggcctgccccatcatcggccccacgccactcatttgaaacattaaccattggatcactttggagcgcgctttgctttcttggggtaagaactttccagttttctctgcgagatagagcaaaatcgcacccgactcaaacaccgcaaaatcttcattatcacggtcaacaatcgccggaatacgcccatttgggttaatcgcggtaaatgcgggctgtttttggtcgttgttcgaaaggttgagcgcgtgggtggtgtattccaagcccatctcttccaatgcgatggcaattttgtgaccattcggtgttgctgcagtataaaaatcaatcatagaaaaatcctttattgaaaggctggtcgttgcgagagttgctcaaaccaacgagtgatgtgcggatagtgttcaaacacagaaagttcgagcgctttttgggcgaaaccaataaaaatgtaggcggtaatatcaacaatggtgaaacgatctgtggcaataaatcgcgactgtgccaatcgctgctcaagttgtggcaaaaaggctgccacgcgtgctttgctctcttcaccccacgcgtaaacgcagtgttcacgatctttatagataccgcttagatttcgaaacgcctgaaatcctgcatacaagccttgaaactcaaccactcgatgccacatttcaacttgagcttgttctaatgctgaatccccgaacaacttgtgcgtattgggataggtaaggtcgaaataacgacaaatcgccacactttcacacagtgttgtaccctcatccagttcaagcagaggcactttgccgttcagacttttgcttttaaaggtatccgataagttttcaccaccacgaacgtccacctgaacacgctcaacatcaatgcctaattctttaagaaaaatcgagactctgcgacagcttggcgtcatcgcggtttcatataatttcatgttgctatccttaattcctttttctgaacgatcgttctggatatactctacgcagtttctgaacgttcagtcaagaatagatttaagcaaccgagtttacaatggcaagaaaatgcaactttgatcgcgaagagaaattacaccaagcaatgacgctgttttggcaaaaagggtatgccaataccgcgatatccgatttggtcgatcacttacaaatcaatcgctttagcctttacaacgcgtttggtgataagcaaaagctctattatgaagcgctggatcgttatctgaatttggtcagttcccctgcccttaaagatctcgagctcgaaagtgcggcgtggccagaattgaaagcgtttttgcaacattttgccgcgctccaacgcgagggaaaccgtggttgttttatgcaaaatgctttggttgagcatgcagacacggacgatgaagtcttaaacaaaggtcacgcgttatttgatcatctgctgcacctgatcgcccgtgcgctcaacaatgcgatacaacaaggtcaaattgcggctcatctttgtgcggactctttggcgccattagttttgacccagatgcaaggtatgcgcgtgcttggcaaagcgcagcgccatgccaatcttgagcagggattagaagccttgatccgtttgatagagggcgattttacaggggctaaagcatgatccatttgattgccctgcgcttaactcgaggaatggatttaaagcagcagattgtacagctcgttcaacaacatcgaatccatgcaggctctattgcgtcatgcgtgggatgcttatcgacgttgcatattcgccttgccgatagtgtttctaccctacaagtgagtgccccgtttgagattctgtcactctccggcactttgacgtaccaacattgccatttgcatatcgcggttgctgatgcacaggggcgtgtttggggtgggcatttgctcgaggggaaccttatcaataccacggcagaattgatgatccatcactatccgcagcaccactttacacgagagtttgaccccaatactggctatagcgaacttgtggtctcatagtgaatccttcttacttgaagcggcagcagtgttggctgcaactccaagtaagaagaagtataggaagacaattactcgcccgattacaacagagaaagacgcactagctgctgcgtatacgggtgacttggattctcaaataggctttgagtttcgccatgttcgacaatctcccccgctttcatcactatggtgtggtgacataaagcgcggatcaccgcgagatcatggctaataaacagataggttaattggtatttctgctgcaaatctttcagcaaatccagtacttgcgcttgtacagttcggtctagcgatgaggttggctcatcaagcaatatgaactcaggcttgagcaccaacgcacgcgcaatcgcgatacgctgccgttgaccaccagaaaattcattgggatagcgatgccgagtgtctacatctaggccgacttcctgcatcaccgcgcaaatcgcgtgatcaatctcgtcatcattaagctggctatgcacgcgtaaaccctcgcctatcacttgcgccaccgacattcgaggattaagcgcagaatatgggtcttgaaacaccacctgcattttactgcgatacggcagcatttcacggcgtttgagagcttgcagatcttgccctgcaaaacggatagccccttgtgaggcgagaagcttgagaatcgccatgcccgtggtcgatttccctgaaccactttcccccaccaaacccaacgattgccctttggccaaggtgaaactcatatctgtaaccgcttttatataggcttgagtgcggcgaaaataaccgcctttgattggaaaccacacccgtaacttttccgcttgcagcagcgtcggagcatccatcgctgtagggacgggcacaccacgcggatcggcattgatcaactgctgggtatagggatgtgcaggcgcagcaaacaaagtgtggcacgcgttagtttcgaccaattggccactttgcatcactgccactcggtcagcaattcggcgcactatgctcaaatcatgggtaatgaacaacatcgccatgcccaattcttgttgcagagatttaagtaaatccaaaatctgtgcttgtaccgaaacatctaatgctgtggtaggttcatcggcaatcagtagctcgggttcattgattagcgccatggcaatcatcacacgttgccgctcaccgcctgagagttcatgcggataggcattgatcttaatttcaggatgacgaatccccaccttgccaagccattcaatcgctttttgctctgctgccgttgcacgtaatcctcgatggatcgctaaggtttccaccaactgttttccaattttgtgcagaggattaagcgagaccatcggctcttgaaaaatcatccctatgcgtcccccgcggatgccgcgcagcgcgcgctctgagcagcgcagggtatctacatcgccaaaatgaatgctgccacttaaatagtgcgccgatcctttgggcaacaaacgcaaaatcgcgttggctgtcacggattttcccgagccactttctcccaccaaagccaacgtttcaccacgcgcaatggttaagcttaccccttccgtcacagggcgtgcctgccctgcgataccaaagcccaccgacaggttatctatcttcaatacccaatcgttcatgcgcggctccgttgtaaatgagggtcaaaggcatcacgtaccgcttcaccgataaagaccagtaaagtcagcatgaccgacagcaccacaaacgctgaaataccaagccaaggcgcttgtaagttggctttgccctgtgcgagcagttcgcccaatgacggtgaaccggccggcaagccaaagccaagaaaatccaatgaggtgagagtagtgactgagccagaaagaataaacggcatcatggttaacgaggcgaccatagcgtttggcaacatatggcgcagaataatgcgcatatcactgactcccatcgcttgtgcagcacgtacataatcaaaattccggcaacgtaaaaactcggcacgcacgacgcccaccaagctcatccaactaaacagcaccatgatgccgagcaaccaccagaaattcggctcaacaaagctcgataagatgatcaaaaggaacaaggttggcatgccagaccacacttcaataaagcgctgcccaaacagatcgagccagccgccgtaatagccttgcgtagcaccgattaaaacgccaatcagtgacgaaatcaccgtgagaataaaaccaaacaacaccgagattcgaaaaccgtaaatgatccgagctaatacgtcgcgccctttatcatctgtacctaaccagttcactgaatccggcgcagaaggcacactgccggtgatatcaaaattgatggtgtcataatgaaaacggatcagcggccagatgatttgccctttctcttcaatcaagctaaccacatagggatcggtgtaatccgcttcagtatcaaattctccaccaaattgggtttcgctataacgctgtacaatcggcatgtaccacgctccgtcatactgaatgaggagtggcttgtcgttagcgataagctcagcaaacaagctcactacaaacagcaataagaaaatccacaatgaccaaaaaccacgccgattggctttaaatcgcgcccaacgcgcctcagtcaacggattcggcacacgcttgcttgcttttgtcatccccatcaacgagcctcaaaatcaatgcgtgggtcaacccacatgtaagtcaaatctgaaatgatgctgagcaacaacccgagcaatgtcatgatatacaacgaactaaataccaaaggataatcacgttggatagtggcttcaaagccaagtagaccaataccttccagcgagaacatcacttcaatcaacatcgaacccgtgaagaagatgctgataaatgcgctcggaaatccggcaatgatgatcaacatggcattacgaaacacatgtttgtagagaatgcgccgttcatccaaccccttcgcgcgcgcggtgaccacatattgcttgttaatctcatctaaaaacgagtttttggtgagcatgcttaacgtagcaaaaccgccaatgaccatggctaatgtgggtaacgtgaggtgccaaaagtaatcgagcacttgttgataccaaggcaagctggcgaagttatcggaaactaaaccgcgcagcggaaaccaactgaaatagttgccgctggcaaagaggataatcaagatgatcgcaaacagaaatccggggatagcgtagccaatgatcaccaccgcactcgaccaaacatcaaaacgcgagccgtgatgaatcgctttgctgatccccaaaggaatcgaaatcagatatatgagcagcgtgctccacaatccgagggaaatggaaaccggtaatcgctccacaatcaagtcaatcacatcgccgccacgaaataagctttcaccaaaattaaacgtggcgtaatccttaagcatctggaaatagcgttcatggatgggcttatcaaaaccaaaacgacgggtgatctcttcgaccacttgcggatcaagtccacgtgaacctttataaccagaaaccggcgcatccgtcggcgccgcgacttcttgcccgcctcccgtaaaacgttccatgacgcctgaggtgttaccttccaactgagcaatggcctgctctactgggcccccaggagcaatctgaataataaaaaagttaatggtgatgatggcccacaatgtgggcaccaccagtaacaaacggcgcagaatataactgagcattgcgcctcctaacgccgtttttcaggtagccgcgcggctttctcttgatctatccaccaggtgtctaaaccaagagaatatttcggtagcacacttgggcggctgaatttatcccacatcgccacacggtacatactcaaatgccattgcggaatgatgtagaaattccattgcaacacgcgatcgagtgctgaacccaatgcgcgaagtttttcggtatcttgctggcttttggctatttgttcggtcagagcatcaatcaccggatgattggcccccgctgagttgtagctggagtccatataattggaattccagacaatcagtagattcgggctcgggtaaggattcgcgctaaagccgtgcgatatcatgtcaaaatcacgatcacgcagacgtttggtgtattgcgtggtgtcgaccgtgcggatcttcatctcaatccccatgagttgcagatttttttgcagaggaatcgcaattcgctccgttgttggactgtaaatcagcagttcaaaactgagtggctcaccagtcttgacgttggtcatcaccttatttttcagctcccatcccgcttctttcagcaaggcaaatgcttcgcgcatttgggtgcgaattcgtccgctgccatcggtcacggaaggctgataagtttccgtaaatacccgagcgggtagttgttctttgtaaggggtgagcacagcaagttctgcggcattcggcagaccttgagcctcgtattcggtgttttggaaatagctgcgggttcgctggtattgatcgtagaacaggtttttgttcatccattcaaagtccaaggcgtagttgagtgcctcacggactcgaacatcttggaatacaggacgctgtgtattgaaaataaatccctgagtagaggctggcgcttggtgagcaatttcctctttcttaatcaaaccttggtcaaaattacgaccagtgtaagaggtcgcccagaacttggcttggttctcttcacgtaaatcaaactcacccgctttaaacgcctccagcatcacggtgtcatcgcgatagtagtcgtactggatctgggcgaagttgttgcgcccaacgttgacaggcaaatcttttgcccaatagtccggattcagtttataggtcacactttgaccgggtttgaaatcgacaatttgataagccccactcccaacgggaggctcattgagcggctcggccaaattcttgtattgccagtaatgtttgggtaagactcgggtcgattgcgccaagctaaataactgttcacggtttggctgcttcatttcaatgcgtactgtccgctcagcaatggctttcacggattttacatcctgataatacactcgatattgcgggacaccttcggccataaacttctcaaaagagaactccacatcctgcgcggtgatcggtttgccatcatggaaacgcgcattcggattgagatcaatttccagccaagtgaaatcatcggaatagcgaattttactggcaatcaagggatagtaagagtcaatttcatccgcaggagaaaacatgagaggatcatacagctctgcggtattggccgccgccacgccacgtgaagcaaaacggttaaagttgtcgtatgtgcccaactcaccgaaggtcactttgccgtatttgggggcttgtgggttgacataatcaaagtgcgtaaagttttctgggtatttagcttccccaaacccaaccagccgagtggtttctatcacggccgcccaactgaattggctcgataacgcgagcgtcactcctaaagcaatcggcttccaactgcgcatggctttctccctcaacacgacgtaaacagataatcaataccttcccatttgaagctgcagccaagttagcggcattcaacgtcaaatcgtttgggtataagacatttgaaattattaataattcagttacttggatagtatagtcacaaactacttgaagtggcaggtcggcggcaagtgagttcaggggaaattcttcccctgaaaatgtgatcaatgaagggttttagcaattaaccgtaaaaggtaggtttcacgctcaatgctcatgcctttgcgtgaatcattgagcagggtttgctcgttatgagcaatcgcttcgtggatgttcacccacataggtttcatgccattacgttgctcgtagttttcaagctgggtctgacccagtttttcatccacctcacagcaataacaataagacaccatgtggatcacatccgcttcttgctgtttatgccaagggcgaaattcttggtataagccaaagggttggatgttgcggacattttgcgccccggtctcttcttgcagctcgcggatcatgcccatcagcacatcttcattgctttctaatccaccaccgggcaaagaataatcgtggtaacgctcagtgtagaggagcaaaatgcgttcaccgcgcatagcaatcgcgcgagcggctttacgttgcataattcgctgctggttcaacggtttaatatcagggtgtatagcgacatatagaggtttcatcggctctccttttccaacggttttgagcgatgctaacacatcaaaaagtcgaagaccctgataaatcagggtctatttgcgctgaatcaaatttaaccatccgcattgatctgggtgatcaaggctttttcgacgcgatccgcatcttcaatcgcgatctggcaggtacctgcggcagcgtgtccacccccaccatatttgagcatcaattcaccgatattggttctcgagctgcgatcgaaaatcgattttccggtggcgaacacgatgttctgtttctggaatccccacattttatgaatagaaatattgcactgcggataaagggcataaatgataaaacggttccctgcatagatggtttcttcttctgtaagatcaagcaacaccagattttggtaaaccttaccacagcgctggatctgctctttaaacaaggtttcatgtttacggtacagttctacccgttctttcacatctggtagttgcaggatttcgtcaatcgatgcgtgagtgcagtgatcaatcaatgccatcattaagttgtaattagagatccggaaattgtggaaacgtccaagacccgtccgagcatccatcaaaaagttgagcaaattccagcccgtagaatctaagacctcatcgcgggtaaattgcgccgaatcccctttatctaccgcctccatcatttcaacccattcaaacggaaaggttttggttccgccgtagtgctcccacaccacacgcgcggccgaaggcgcattcgggttaataatgtgattcggtctctcgcctttatttctgagggtttctgagtggtgatgatcaaataccaaatgcgcgttggcgacataaggtaagttagtgatgatgtctcgctccgtgatcgggactttaccatcttgcatatctttcggatggacaaactggatgtcatcaatcagctcgatacttttgagcaaaactgcacacaccaaaccatcaaaatcactgcgtgtcactaatcgatacttgagtgatgacatgttcttccctcttcaaagctttgagatccctgcccattagaaacaccctgttgcaccatatacattgacgtcttaacggccaatcatgggataccaaacctaaaatgaaacaaaaatgttgtttatttgagcttttattaattgtagacagcatcaatcttttgacaaatctgacatatagcaaaaaattaattttgtagaatactgatatgcaacccgtaacaaaaaatggagaaagcatgaataaaaccgccctattactcactgttgttggtgccgttctgctcactggctgtgcgcgccaagagaatgagtacaccgttaaggaatacacttctatggcaaacccagcttccgtttactgtgtggagcaagggggtcagttggagatggtgacagagaatgagcaacgcgtcacttactgcgtgaccaaagatggtgagaaaatcgaacagtgggaatattttcgccaaaaccatgaccaacaatagtcaccgccggttgggatagatgaggcagctaagctgcctttttggttttcattggcgcgctttcggttagcgcactttcggttagcgcttccaccaacgtcctgaacgttcgagctcgggatcgcacaaacggttcaataacgtcagttcagtatccaagatagccaacgcttcacaaaacgactgctgatctatctgactgtccatggtggaatgatttaccgctaggctatggttaacttgctcatggttaacgtgctcatgactaacttgaccatgctgaatctggtaaaccgtggactccacgacggtttcaatcacatcgagcaatgacagtaatctgggctcttcactcatggtgtggcgaagttcggcgatcgctttttgcgcaatccaataaggctgctgctgaacttgcgtgagcgacctttggaaagcgtttgccacgacgccttcaagaaaaacacgataagtcgtcagttcatcgacccacaaaaaacgtaagccttgcgggttttggtgaggatacggcacgcaaagatgagccttaagatcgcgcgctatctctaaccggacgccagactgcgcacagcgctcaatcaacttacgtaacaagccttgttcatccatcagttgctggatttcaaaaattcgtttgaggtgatagtcattggataccaaggtcaaggcaagtgtttcaccgcgctgcacaacaccactttccaataatacctgcgccacatgctcaatattttccactgtgctggtggattcttgctcaagcagtacatcgatttgtgggaatgacagccctaattgttggcgacgttgctcaaaatactcatgcattcgctttgcttcagacaccgtctgaccgagagtaatgcccccgcaaaagaccactcgtgccgccgtattttcgtgacactgtaacgcagagatcaatccatcgacgcggcttttgccttctaatgtcagttggttagcattaagacgtttaccaagcaccacataaatcggacacactgctgacattcaatcttgcctctctgacgttcagtattagaaaccggtataggaaaataaattcattctcccctcatcaccgaccaacaccacccaatcgttgcgatagagaaaatgagtgcatcacggattttttctgccataatcgcgcccttattttattagatgctgatgtaaacacttagtttagagatatacaccagcttaatgcaaagaaacagaccgatatgtggaatagactcaataaatcaatgatgttctgccaaatgatgtttggcctctcgttctacggcgttatggtgatcttaactcgcttcttcttggaagatctcaactacagcgaagccgataccatgatggtcgtgggtgcattctcgtcgattgggcccctgtttgccatcgccggaggctttattgccgataaatttctcggtgcgtatcgttcattggccatttcctacgtaacgtttgcgatcggttacgctttattggttttgggtgcgtcatccacccatgttcctttaagtctggttggcatcgctttggccagctacgctcgcggcttaatgtcaccttcttatccaagcttgtacaaacgtacttttgccagtgaagaagatttcaataatggctatcccgtaaactattcggtcaacaacgtcggcgcacttttgggacaatacctgtttccaatgctagtgttgctgctgggttttcacggcagcttcgcgctttctgcattaatggcaaccttagccaccatcaccctagtggtgatgcgtcgtccactgattgaagtggccagcgagaaagatcagcaatccgtcagcatgggcaattggatagcgttcaccctactttcattagcgatggttgggttggttttcttcatgttttccaacatggtgattggccaaaacatcgtgtatgcgattgggcttgcggcgattgtctatttcatcaatttgatgttgaaagctcgccgcgcggaagctctcaaaatgggcaccatcttgattgtgacggtgctgaccacctgcttctttgtgtattacgggcaaatgatgacctcaatgaccatggtcacgattaataccatgcgcggcgagctgtttggcatcatcccgattgcgccggaagcctcgatggccatgaatccactctggtgtatcgtggcaggtcccgtcatttcctatctgtttcctacactagaaaagcgtggcattaccttctcaaccgcaaccaaaatcgcgtttgcctttgtgctaaccgctatttcatttggcattctgacgtttgccgtttccaccgttggtgaagaggcaattatccgcccagaagtgttcttggtgatccatttcttccaagcgtttgccgaagtcgtggtgggaagcttagtggtggcgtttattctgtccgttgcccccaagcagattgagaacttctcagtgagcttgttttatattgcgatggcgctcagtggcattattggcgcggtgttctcgacttccatcgcgttagaaaaaggccaagtggtgacgcagcagatcgtacagatcatttacggcgactacttcaaactgctaacggtactcgcagtcgtcatggtgggtgtggctctgcttgcatctgtcctgatccgtaaaatgcttgccgccgcagatgtgaattcaccaagtatccaagataagcaagcttaacaagtggtgaatcagaccatcgcacaaaccagagatggcaatgcgactgctgatgattgatgaaatggcctgcgggccatttcttttatccagttattcttatctggcgaaggcaacaaccaaccctgccacaatcgcgctaacgccgagtaaacgagttacgtaccaacgctctccaagaaatgcgatccccataaacagtccaaacacgatgctggtttgacgcagtgcgacaataaaactgacgttttcggtcaacgtcatggcatagagaaccaagctataagttccccccatcatcaatcccgcgagggtcgcggtataacgaatgcgccatgcttcaacaaatggagcgcgttgaccagtgagcaaataccagatcgccagtggtatgcacattgcccaaaattgaatccccaaataaagcacggcagagtaactggcaggcatttgtgagcctacggtctgttctatgatcgccagcgcttctttatcgataatcgaatatcccgccgtgcctagcgctgcgaccagagcccacacaatgccgaggttggcataatcggcgaaacggaactgacgaaatttttgcagcgggatcatcaagcagccgagtgtgatcaacgcaaatcccagccactggttaagctgtaagtcatagcccagcatcacagtgcctgccccaaccaacaatacgggcaatccgcgtgctaaaggataagcaatgccgatatccactttgctgtaagcaaaggccagccccagcatgtacaccatttggctcagcccacttaccaccaagagtaaccaaaattgagtcggcagcgttgaccaaccaatcttagtgaaataccacacaatataaggcgtgaggagcagtgaggtcgctgaagtggcaccaaggaagaaagaaggacccgagctttggtagcgcttgccgatgatattccaacccgcatgcaacagtgcagaaaacagtactaagatgataggcataaaagacatacgacaaccttgtcaaaaagcccagtcatcgacagggcaagcaatctgcgctttcgcgaaatggattaacgctttaattctgcgatggattcaatggtaatggcatcgtgacgccagtattcaatatcacaatcaatcaactcgcctttctggttatagttgacccgctccaccaccattgccggtgtacctgacgttgcgcgcagggcttgagccatttcacccagtaacgagctggtggatatacggtagtgaatcgtctggtattgtgtcgcatagtgttcacgatagagatcggtgagtgactgcgacagatcaaaatcgagcaggtttggaaacagctctgggcgaatgtagttggtgacatacaccacaggtcggttatccaaataacgcacacggtctacgcgatacacatccgaaaacggtttgagttttaaaagacgagtcgcctgcttgttggcgatcaccgctttggcagacaccaactccgttttcggctggcgattttgcgccaacgccatattagtaaagttgagcgtttgagtggggtcatagcgtaaaggcgcgggcgaaataaaccaaccgcggcgatcttcacggtaaatctttccttcagcttcgagcagggaaagcgcctcacgcaaggtgactcgcgtggtatcaaatgattcggctaacttgcgctcagcggggagcttttggcgcggcatcagcatgccggcatcaatctgctctacgatggcatctttaatttttacgtattgcacttgcgatcctattgcctctttccactaacgcttgcgccaagcttgcaggcggccaaacaatccaaactctaatcccacatgcagcaatttggctaacgcggccgagagcataatcatcaccgccatggcagcggcggcgcccgtctgcccggcatcatccatattcaataccgcaaccgatgcgggtacggtgtcggttgagtagaggaatactaccgcagaagtggtggttaatgcattaataaacaaatagctagcaatgtccaataccgcaggcaaggagacaggtaacgtcactttccaaagtaagcggtattgcggcagcttgatggaggccgccgtcgcctccaattcaggtggcaactgtttaagcgcggtaaccgccgtcatatgccccaccgtgtagtaatgcaccacggtattgatcaccaaaagcagcatgccaccgtacaagccattgagcggattagacgcgtgattgaaaaagaagatgtaacctaaacccagcactaagccgggaaccgccatcggtaccatactcagcatctgcatcgcctgacgcagcagcgcgaacactcgccctttttcaatactgtaagcgccgagaaaaatgatcaccgtcccacacagtgcggttaagctggctagggtgagtgagttaaaatacgggctccaaccataggcactggtttcggcaaattggtaatgtttgagtgtcagcgctgtattccacggccaaaacgtcaccagtgagccgtacaccgccgtggctaataccgccacaatcgccacacaaatcagcacacaatagagcagacataaaccatcacgcagccgatgtggcgctggttggtaagccacagaacgggtatcaaataggctttgctgttttttctgcacccagcgatcggcaataaacgcaaacacggcgggtagcaacagcacaatactggtcaccgcgcccatcgcgaaattttgctgccccactacttgcttgaaaatgtccgttgcaagcacgttatagctgccaccaatcactttcggtacgccgaaatcacacaccaccaaggtaaacacaacgatcaaggcgctgatcaacccatacttggctgccggtagcgtgacaataaaaaacgttttgatgggggatgttttcagcgccctcgccgcttcatacagacgagcatctgaggtgctcagcgaggtggtcagaatcatcaaagcatgcggaaatgtccagaaaatcaacccgagcgtaatacctaagccaccataaatggattcaccgccgagccaactcttgagcatgccttgattaccaaatagaaaaatcagactgatcgcgggcagtaatgaaggcgcgagaatcggcgcactgcctaacactcgaaacagatgttttcccggcatgcaggagcgcgttaacgcataggcgtaaccaaacgcgaggataccgacaatcgccgtcacactgataccaagcactaaggtgttgcgcaaagattgccagagcgctgccgaggaaaaatattgggcgaagtaagcgagcccgacaaattcaccctgcccattttgcacgcttttcaacaacatagcggccaacggcgcgacaataaacaacagcatcagtgatagcaggatcaataaggtggtcgataaaattaggctatcgcggctccaatgcggcaatatccgcactgaaaaagtacgagcaacattcaacatactcttctccttaagccgcataagcacagctggctgtagctgctggcgttgtcgacatgaccttacgacggtacgcacgcaactgccctgctctcaatgccaaatatcgaacatctcccgcttttaaattcatggtttgtacctgtgtgatcggtaaatcgacatacacgggcggagccaaacgctcaccttgaaacacacattcgactcgataaaacgcgccaagaaactccaaatggcgaatgacgactggaatggcctcgttgtagcgcgtaaccagctctagattttcagggcgcacagccaaatcaaattgttcaccttggcaaggcgtataattttcgattttgggcaaagcaataagggattcagcaatacgcagttgctgggaactcgccatggaaacgggaataaaattcatcgtgccaacaaactcagccacaaaacggctggcgggcttttggtagatctcttgcggcgtaccaacttgctcaatcaccccgtggttcatcaccacaatgcgatccgccatggttaacgcttcttcttgatcatgcgtgaccatgatggtggtaatgcccaatttacgttgcagttggcaaatttcttcgcgcaaatgcgttcttaccttggcatcgagagcggaaagcggttcatcaagcagtaataaccccggcgataatgccaaagcacgcgctaacgcgacccgctgctgctgaccgccagagagctggcttgggtatttttgtgccgatgtggcgagcccgatcatctccaaccactgctccactttctctaacgcatcacggactgacatgccttgattacgcaaaccgatggcgatgttttcttccaccgttaaattgggaaatagagcataagattggaacacgatgccgaaatcacgctgctcgggtggtaaaaaagtaatcgcttgctggttttggtggatggtgccagaggtgggaagatctaaccctgcgatggcgcgcaacaaggtggttttgccacagccagaagggccaagaaagcagacaaactcgcctttttcaatcgataaactgatctctttcaacgcggtaaatgagccaaactgttttaccacatgacgaatatcgaggtagcttctgctgatcgcttgtggtcgatcgtgctgctgtaaattaggatgatgcatggtcataaaagtcacctttaatttggtatagtccaaaattaacaaggctttattgcaatgcagtgacagttttatcgctgatgcgtgaccatctgatgacagttaggtaaaaaggaggctttcgcctcctttgatgaacaagttaagatttgggttccgatttagcatcaaggaggctttcgcctcctttgatgaacaagttaagatttgggttccgatttagcatcaaacttttcagaccaggtttgcagcacgcgggcacgatcgacgcccatttgcgtgaagtccatcttcgccatcactttttcaacattcggataattcggcacttgcttgctgacgtcctgatggccaacgataggatagctctcaatatacagctcatttgccgctttcgagacagaccaatcgaccacacgctttgccgcatcactttctttgacgagccctaccgcttcggattcccagccaataccgtttggtacaatcacatccaacggtgcgccttgggttttgagttttgcgccacgcgttgccattgatatgccgatcgcaacctctcccatccccgcttgaacacaaggttttgagccagaatgtgtgtaatgggcaatattttgatcaaggcgttgcatgtaatcccacgctttatcttcgcccatgttttgcagccatgcggaaacttgcatgtaccccgtgccggaagatgcagggttaggcatcgcaatgtggcctttgtagacagggttagtcaaatcttcccaactctgtggcttaggtaaattcagctgttttgccaccgcttcgttaaagcataccgcgttaaaaaaagcatcgttgccataccaagcttgctgagcctgcggatcgttcaaattagctcgtaactcgttcgctcctttgggtgtgtaaggttttagcactccttgatctttgaggagagccattgaagatccagccaatccccacaccacttctgcacgtgggttgtctttttcagccagcagtttggccgtcatgatcccagttgaatcgcgcacccacttaatctcaatatctgggttctctttttcaaaagcgcttttgtatttcgccagcagatcggtttcaaatgcggtatacaccgtgacttcttgtcccgcaaacgcatgagcagacataagtgctgcgatcgctgttaaggttcctttcaatatacgcttgttcatcatcctctccaattgattgaatttggtatgtaccagaattgttatttaccctacccagtctatgtgacgattcgatgaagaaaaattggcagtttcacgacgtttttaggttctttttatgccatttttccggcatgtgcggttatgaaacttttatgaaattcgccttcgaagggtttaccgcgtgcgtttctcgttgttagatagcgttaaatttattggtatagtccaaaaaggaataacatgaagaatgcttatctactgctgacaccgggaccgctttccacctcagaatccgtgcgtgaagccatgcttaaagactggtgtacttgggatgatgattacaacttagaaattgttgaagtgatccgccgcaaactcgtcacactggccaccacacaatccggttacacctcggtgttgatgcaaggcagtggcaccgcttcggtagaagccaccattggaagcgtgatgttacccaccgataagctgctcgtgattgataacggtgcttatggcgcacgcatcgcgcaaatcgcgcagtacctgaatatcgcatgtcgtgttattgctcccggagaaacggcgcagcctaatcttgatgagattgccgatgtgctgacccatgatccggcaattacgcatgtggcgattgtgcactgcgaaaccaccaccggcatgctgaacccgattgctgaggtggctaagatcgctaaacagcatggcaagcgtgtgattctcgatgcgatgtcgagctttggcggtattccgatggatattggtgctctgggtatcgattttatgatcagctcagccaacaaatgcattcaaggggtgccgggatttggttttgtgattgccaaacgcagcgagcttgaacagtgccaaggccgcgcacgctcactcactttagatttgttcgaccaatggcaatgtatggagaaaaatcacggcaagtggcgttttacctctcccactcatacggttcgtgcgttctaccaagcgttacttgagttggagagcgaaggtggcatcgcggcgcgctatcagcgttatcagaccaatcagacccaattggtgaaaggcatgcgtgaactgggttttgccccgttactcccagaaaagctacattcccccatcatcacctctttctattcacctgaacattcggattaccagtttgccgagttttatcagcgcttaaaacagcaaggctttgtgatttatcccggcaaagtcagtcacgccgactgttttcggattggcaatattggtgaggtgtatccgcaagatattgagcgcctactgagcgccatgcagcacgcaatatattggcaacaagcgtaaacggttaggaaaatccgatgaaaacattcgatcccctctcgtcatatagcccaactcactggcgtagtgaaggtgatatcaataccaccgccgcacgtcgcgactggctaacgcatgtgaatgatgaaactactcagaatttattacaacgtgacgcgaatgtgtttctgcatcaagccatgtccacaccttgcctcgctccattggccagtgcagcgggctgctatttgtatgatgtatcagggaaaagttatctcgattttcatggcaataatgtgcatcaactcggtcatggtcatccgcaggtgatcgaaaaaatcaccgaacagatgcaaaccttacctttcgccccgcgccgttttacccatgaaaccgcgattcgctgcgcagaaaagctcacggagattgctggcggtgagctaaaccgagtgctgtttgctcccggcggtacttcagtgattggtatggcgctcaaattagcgcgtcatatcacgcagaattttaaagtggtcagtttgtgggatgcttttcatggcgcgtcgctggatgcgatctccgttggcggcgaagcttgtttccgccaaggcatggggccactgatggcaggcgtggagcgcattcctccggctatcacctatcgcggtgcatttccccgagaagacggcagcgatgtgcactacgccgattacttggaatacgtgattgaaaaagaaggcggcattggcgcattcatcgccgaagcggtacgcaataccgatgtacaagtaccaagccgcgcctattggcaacgcgtaagggagatctgcgataaacacaatgtgcttttgatcattgatgacattcccaacggtatggggcgcagcggtgagtggtttactcaccaagcgttcggcatcgagcccgatattttgtgtatcggcaaaggtttgggggctgggcttatcccgattgccgccctacttaccaaagaaaaatacaacacggctgcacaagtttctttgggtcactacacccatgaaaaaagcccactcggctgcgctgcagcattagccacgattgaagtgattgagcagcacaacttactcgccaaagtgcatgctgatagcatttatatgcgtcaacgtcttagtcaaatgcagcagcaattttcactgattggggatgtgcgcggtatcggattgctttggggcatcgaactggtgatcgatcgccacaccaaacagcgtgctcacgatgaagccgaggccatactctatcactgcttacgtcatgggctgagctttaaagtctcacaaggcaatgtgattcaacttagcccgccattgatcatttcacgccaagagctggatcaagctctcgatattctctattccgctttgctcgcaattagccagcaaatgaattactcatattaaggaaaaatgatgaactctccgattcaagccgttattttcgattgggctggcactattgtggattttggatcctttgcgccgacctcgatttttgttgaagctttcaagcaaggctttgattttgagattagccttgccgaggctcgcgagccgatgggactgggcaaatggcagcacattgaagccgtcggaaaactcccaaccgttgcgcagcgctggcagaagcaatttggacgcccgatgcaagccagcgatattgatgcgatttacgccgcctttatgccgctgcaaatcgccaaagtcgccgatcacgctgcaccgattcctcactcacttgaagtggttgagcagatccgatcgcgcgggatcaaaatcggctcttgctctggttatccacgccaagtgatggatgtgctgatcgctgcggctgccgattacggttatcgtcctgattatgtggttgctaccgatgatttagcgcaaggtggccgccccgccccttttatggcactcaaaaatgtcattgagcttggcgtgaccgatgtacgcgcttgtgtgaaagtcgatgatgccctgcccggcatcgaggaaggtcataatgcggggatgtggacggttggtttactgctgtcaggcaacgaagccgggttaacccttgaagagtaccaacatgctgatgaccaaacgctacaagcggcgcgcgaacgtgcacaagccaaactgcaacaggcaaaaccgcattatttgatcgatacggttgcagacttgcctgccgtgctcgcgcaaattgagcaaagattattagccggtgaacgcccttaagtggtcagttcgtttactctatttctcgtcccccttctaaaaatctggttatctattggggacttgaaatcttctgctatgcgagctatggttagtccgacaacttaacaaaactgattgataccgccctgttttcagggcggtatttatttgggaggaataaaatgtctcaacttaatactatcgtggtgtccactcgcgatatggacagaatcagccagttgatggataacctagccactttgtcgccagagctagagaaactggaagaagaattggatcgcgccactgtgctcgaacctgcagagatgccagaggatgtcgtcactatgaattctacggtgcgctttaaatttttgggcagcgatgaagtgatggaaaaaaccttggtgtatccaaacgatgtgaaaagcagcgcggatgtttcgattttcgcccctgtgggaagcgcattgcttggtttagcagtcggtcaacaactggcttggccaatgccgggcggtactctcaaaaccctcgaaatcatcgatatcgtctatcaacctgaacgcgctggcgaattccaccgttaatcaggtatctggtgcaaggtggttcactttgcaccaggagcgcctcgcttattcatggcattacgccaacaaaatctctctcagttcatgcagtgaagtcacttcataatgtggcgtaatgccatctggtttcgggtgctgatgaacattgagccagcaagtttcgatgccaaaattcaagccacctagaatgtcagaatgtggattatccccgaccatcagcactcggcttttggttgggttgcccatacgctctagtgcgtgggcaaaaatgccagcatcgggtttagcaatcccgacttcttcagaaatcacaatctgatcaaaaaagtcagtcatgccggttttagccagccgaacatcttgtagctcggtaaaaccgttggtgataatgcccaaacgcgctttaccttgtagcgcctgcatcaactccatcgcgcccggtagcaaggtacaaatatccgccatggcttgtaaaaatgcactattaagctcgtcagtggtggtattaagcttttcagcccaacccgcaaagcgcgtatgtttgagctgcgcggcagtaatatcgccgttttggtaatccacccacagcggtttattcacttcttggtattggtgaaaatcttgttcggtaaattccacgcctttgcgcgcgaacatcagctgcatgcctttaaaagcatcgaaatgaaacaaggtctcgtcagcgtcaaataagatccaatcgtacttcatgatgatctccttaaaatcaggccgacagtgtagtgtttttcgcggcgaatgaacatggttatcattttgttaaaccaccagcaaatatgtaatttatttccgccaaccgatagattcggtgacttagcgcaaaaagtagcccgacatttctttttataaagagccgtgaagcgatacattgaacggcagaaggagtggttatgaagcgttttttcccgtcagtagtgatgttgatcccgtttgtggtcaaacgttaccccgatcaggaagagtattcagcggcagaagatggcgcggagcatgacactccttcctcgatggctcaagaccatctcaccgacacgtctaaggcgcataagcaatctatggaggattaatgtcatgaagaaagtcgcggttattctcagtggctgtggagtattcgatggagcagagatccacgaatcggtgcttgcgctgcatgccatcgagaaacaaggagccagttggcactgctttgcgccgaatgtgcagcagatgcatgtcattaaccacctcacgggtgaagagatgccagaaacacgcaatgtgttggtggaatctgcccgcattgcgcgcggaaaaatccaagatgtagccacactcaatgtgaatgaatttgatgcacttttgctcccaggcgggtttggagccgcgaaaaatctcaccgactttgcggtgaaaggcgcacagtgcagtatcaacccggatgtagctgccgcttgtcttgcttttgcggatgcgcaaaaacctgcgggttatatctgtattgccccaaccatcatcccgatgatttatggcgaagccgctcaaggcacgattggcaatgatcacggcaccgcagccgcatttaatcagttgggtggtcagcatgtggattgcccagtagaaggcatcgtatttgatgaaagacataaagtgctttccacccctgcctacatgctggcagagaatatttcccaagccgcttccggtatcgaaaaattggttgagcgcctactgcaactggcatagtgtttcacaaactcaatcgataacaatgcccactttaagtgggcattggtttttgtcctcaggccaacacagagtcgtcatttgttgcacaaatgaaacggccgcatcaataatgctaggtatataaaatttctggatgacgagattgcgcataaccaaacagcgctatacccttggtaacgtaatcggtagcggaaaaccgttggcttctcctgataccgcagtcaccttcaattcaacaatttatttattcagtttggagaaaacccaatgagcttacttaaagagttcaaggcatttgcatctcgtggcaatgtgatcgacatggcagtcggtatcatcattggtgcggcgtttggcaaaatagtgtcatcgttcgtggccgatatcattatgccgccaatcggtattattttaggtggtgtgaattttagcgatctgagtttcgtgttacttgccgcgcaaggtgatgcccctgctgtagtgattgcctacggcaaatttatccaaaccgtggtcgattttacgattatcgcgttcgccattttcatgggtttaaaagcgatcaatagcttgaagcgtaaggaagaagaagcgcctaaagccccacctgcgccaaccaaagatcaagaactgctttctgaaattcgtgatttgttaaaagcacagcaagataaataactctggatgatttccccttctaaggcgctcacttgagcgcctttttccattttagcgcgccgaataagagtaaaaatctcgtgcttcaattgatcaaaatcagcaatccgctaaaatcccaatcgctcgcagaattcactccataagaatctttacaagccacaatttatcgctatgatttgcgcgcaaacgttttcctcaccatttttaccgctctagatgagggttttatgctgccagatattgaaatttgccgcgctacaccattagcgcctatcgacaccattgctcaaaaagcgggattgcacgcgaatgagtacgaaagccacggccagcataaagccaaagtgtcactgcattgtctagagcgattggccaacaagcccaaaggtaaattcattctggtcactgcgattaccccaacaccactgggtgaaggtaaaaccgttaccacgattggtttagcacaagggttggccaaacttaatcactcggtcatggcgtgcattcgccagccttcgatggggccgatttttggggtaaaaggtggcgctgcgggtggtggttattcacaagttgcaccgatggaagagctcaatctgcatttaaccggtgatattcatgccgtcacggcggcgcacaaccttgcggcagctgcgattgatgcgcgaatttatcacgagcagcgcctcggctatgcagattttgagcgccgcaccggcatgccagcgctgcgcattgaccccaaacaggtcatatggaaacgcgtgatggatcataacgatcgcgcgctgcgcatggtgacagtcggccgcaatgaaccgggaaaaaatattaatggttatgagcgcgaagatggtttcgatatctctgccgcctccgaattgatggcgattctggctctcgcctcggatctacgtgatttgcgtcgccgtatcggtaatgtggtgctggcttatgatttggacggtaatccggtcaccaccgaagatctgaaagtggctggtgcaatggcagtcagtatgaaagaagccattgagccgaccttgatgcaaactttagaaggcgtcccaacactgatccacgccggcccatttgccaatatcgcgcacggtaactcctcgatcattgccgatgaaatcgccacccgtttggcagactacaccgtgaccgaaggcggttttggctccgatatggggtttgagaaagcgtgcaacatcaaagccaaagcatccggtaaaaccccagattgtgcggtgattgtcgccaccttacgcggcttaaaagccaactcaggcctgtatgatttacgccccggccaagcggtaccggatgccctattcgcgccagacagcgccgctttgcaagccggttttgcaaacttgaaatggcatattgataacgttaaccagtatggtgtgcctgccgtggtagcgattaaccgcttcccacaagattgtgccgaagaactggaacaactggttaagctgattgaagccctgcccaaccgtgtatcggtagccatttcagaaggctttgccaaaggcggtgaaggtaccaagctgcttgccgaaaaagtggttgagcagtgtcaacatccaacgaaattcactccgctctacgattcaggcataccattggatgaaaaactcaaagcggtcgcggtaaaaggttatggcgctgccgagattgctctgagtgataaagccgcacagcaattagccaaactgcaaacccaaggctttgaccatcttgcggtttgcttggcgaaaacaccgctgtcgatttctaccgatcccgcaatcaaaggcgcgccacgtgattttatcgtaccgatccgcgagctgcgtttatgtgcaggcgccgaatttgtttacgccctgtgtggcagtgtgatgaccatgcccggtttaccggaaaaaccttcctttatggcgctcgatatcgatcagcacggcaacatcgtcggcttaagttaattcttttccaacttactcccgtgcttctcttagtagcagcacggtgattctttcctaaaaagtttcccctaacaaaaagttatctctggcaaaaagttatctccaaggctgaaatttctgatccggtttgccgttctttttctataactttgtaaagaaccaaaaggaaatgctcatgaaacgactctttgcttggggagctccactattcgctttggttgcgcttaccctatctctgtttagtcaagctgacaccaaaccaagtaccatcgactcaacttcagctaactaccagcaagcgacattggctggtggctgcttctggtgtacggaatcggatatggagaaacttcccggtgtcgtggatgtgatttcaggttatgccggtggagatgtcgataacccgacttataagcaagtctcatcgggtaaaacgggacacatcgaagtcattcaagtgacgtttgacccgaagatcgtcacttatgaacaagtgctagataacttcttccgacacatcgacccaaccgatgaccaaggctcgtttgtggatagaggtgaacaatatcgcccggcgattttctaccacaacgccgagcaacttgaagtggctaaacgttttatgatggagattgaccaactcggcatattcaaaaagccactcaaaaccgagttgattgagtttaaaaagttctggccagcagaagattaccatcaggactactacaagaagaataaagtccgttacaactactatcgttatgcttccggacgcgatcagtatttggatgaaattttcggcgctgaccgtaacacgcatccgaaaacccttcgccaatggattgatgagaaaaatgggcaagcgaacgtcaaagcttatgtccgcccatcggatgagcagatccgcgccaaactgactagcttgcaatacaaggtgactcaacgcgacggtacagagcgcccgtttgataacgagtattgggataacaaagaagaagggatttatgtcgatatcgtctcgggtgagccgctcttctcttctaccgacaagtacgattccaaaaccggttggccgagtttcactcaaccgctcaactcgagttacattgtcactaaagatgacaatagcctgttctatactcgcaccgaagtgcgtagccgctttgccgattcacacctcggccatgtgtttaacgatggccctgctccaaccggtttgcgctattgcatgaactccgccgcgatgcgtttcatccccaaacaagagatggcagcgcaaggctatggcgaatatttagctctattcaaataattagctataccaaccctgaaaagcaatcagccctcaaattgagggctgattcatattcacgtttaagaaaatgaattaactaagacaatgaattagcgcaaaccgtgtaggaattccgcacgcgtcgcagggttagatttaaaaatcccccccaaagcggtcgttgtggtgacgctggttgcatccatcacgccgcgggatttcacgcaatagtgagtcgcatcgatggtgactgccacatcatccgactcaagcaacgtttgcagcgcaactaagatctgctgcgtcatacgctcttgcacctgcggacgctgggcaaaaaagcgcacaatacggttaattttcgataagccgatgattttgccgcgcgggatgtacgccaccgctgccgtgccatcgatggtgactaagtggtgttcacacgtgctggtcagtgtgatgtctttcactttaaccatctcactcactttcatcttattttcgataacagtgatcttggggaagttggcataatccaaccctgagaagatctcatccacatacatcttagcgatgcgttgtggggtttcttccaaactgtcatccgttaagtccagtccgagcaggttgaggatctcacgcatatgctgttcgattttttcctttttctctgctggtgtcgccaagttgggctgcattggtgtttccaaccctcggcgctctagcgcatctttcaccaacttcgcggattcgctaagacctgacattcctctacctcttaaatacccctttcggatggctgacaagaatactcggatttagcgacaattacaccccaaaattcacgtggattctgcatcgcagaaggattctgtgctacagtttgccgcaaaagaacaacaacataggacattcccgatgggctgttgcgatgctcctggcttaatgccgattgaagatgcacttaagaaaatgctgtcacgcattcaacccgtgcaaaccactttacgtttgcctctgcctgaggcgctcggctatgtgctcgccgaggcgatcttatcgcccattcatgtgccaccgtttgataactcagcgatggatggttatgccgtccgtcgcgctgaacttgcgcagcaaaagccgttgcccgttgcaggaaaatcgtttgctggtcaaccctttacagcagattggccgccaatgacctgcgtgcgcattatgacgggtgcacaaatccctgccggttgtgatgcggtgatcatgcaagaacaagcgaccatcaccgaagagggtgtggtgttctgccagcatgaggtcaaactcaatgacaatatccgcccaaccggtgatgacattcgccaaaacgatgtggtgctggaacgcggtgcgcgcttaaccgcacgtgatatcccgatgattgcgactctcggcattagccatgtcaccgtctatcgcaaaccgaaagtcgcgtttttctccaccggcgatgagctcaaaccactcggtgaaccgctgcaagccggacaaatttacgatagcaaccgctacggcattaaacccttaattgaaaacttcggctgcgaagcgattgatctcggcatcgtgccagattgccctgccactctgaaagccacgtttgaacaagcgcaaagcttggcagatgtggtggtcacttccggtggcgtcagcgtgggtgaagccgattacaccaaagatattttggaagagctgggcgaaatcggtttttggaaactggcaatcaagccgggtaaaccttttgcatttggtgcattgcaggatgcatggttttgcggtctgccgggcaacccggtttccgcggtgctgaccatgtacgtgctggtgcaacctatgcttgccaaattggcgggacacagcgcttggcaagccccggaatcgatcccggcgatcacgcgtagcccctttaaaaaagcaccgggacggacagatttccaacgcggcatttaccgcattgaaaatggtcaattcgtggtggaaagcaccggtaaccaaagctctggcgcgttccgctcaatgagcttggctaactgctttgtggtacttgagcgtgaacgtggccgcgtggaagtcggcgaaacggttcaaatccaactgtttaacccaaccctgtactaggagtgatggtggatattctcagcgatgcagaaatgctgcgttacaaccgacagatcattctcaaagcgtttgattttgaaggacaagagaagctaaagcagagcacggtgctgatcctcggtgcgggtggtttgggctgcgcgagtggccaatacctcgcgactgcggggatcggccacatcacattggttgatgatgatgtggttgagctctctaacctccagcgccaagtgctacaccatgatgcggatattggccgcgcgaaagtcgattcggcggccgattcgctgcgtctgctcaatccgcatcttcaggttgagacgatacaagcacgtttgagtgatgacgaattggatgcgctgatcgcacgccacgatctggtgctggatgcttgcgataatgtgggcacacgtaatcagctcaatcgcctgtgctttaaacacaaaacaccgctggtttccggagcggcgattcgcatggaaggccaagtgagcgtgtttacgtatcaagatcccgcgcagccttgctatcaatgcttaagcgccctgttcggctcatcggcactcagttgtgttgaagcgggtataatggctccggtggtaggcattattggtgcagttcaagcaatggaaaccattaaggtactgactgaattaggcacacctaagcaaggtaagatcttgattcttgacgcgatgagcatgtcatggcgtgaaatgaacctgatgcagttgcctcagtgtccagtttgccacccgcaaagctaacgccttctgtattaacgtcacaattttgcgacgctgccacggtctggctacccattctgtgccagatggcgaagttaaatcctctaaagccgactaaagttatacccacactacttggagttgcagctcacacggctgcagcttcagcaggatgggaataagatcaaatagaggagctgagccatgtccaatctcaacgttttggaaattaaatctttcgttcccgctcaggacttcaccacgtccaaacagttttacttatccctcggttttgaactgattacagaatttggcgatgtggcttatttacgtttaggccaatgcgcctttttgctgcaaaacacccatcagcgcccccatcaaggcaacaccatgatgcatctgttagtagaagatgcacaaagctggttcgatcacgtcaaaacgttgcaattggaagaacgttttgaaagcaaagtgactgatctcatcactcaaccttggggcatgttggagttttgtttagttgacccgagtgatgttctgtggcgtattggtcaacgtattgggtaatcacaaaaataaggaataacaatgacctccccactcgtcacggcgcaatggctgcaacaacatctgcacgaccccaatttggtgatcctcgatagcagcatcgagtttcaaattccaaccgagtctgaaaaagattgggtcaacaagatccctaatgcgcagcgctttgattacgacaaagtcttttgcgaccctgattcgcccttgccgcacatgatgccttctgaggagcgctttaacactctcgctcgcgaactgggtatcaaccaagattcctttattgtggtgtacgacaacagcggcacgtttgcctctccccgagcatggtggatgttcaaagccatgggacatcacaaggtgtatatcctcaatggcggattaaccgaatggaaggctcagggttacaacgtcactcaaaactatcgtgaacccacaccaaaagggaactttgacggcaaactcaacccacaagcctttgttgatgcgagttatgttctcaaacagatcgataatccacatagccaaaccattgatgctcgcggattagcgcgctttttcggtgaagtgccagaacctcgccccggcgtgcgcagtggacatatccccggttcatcctgcttgccttttgcagagctcatcactggtcacaagctaaaagagcaagccgagttacgcccgctgctgactcatatgctgcccgagacagcacaagaatatctgtttagctgcggctctggcgtgaccgcatgtattgtgctgctcgcggcgtatgtgtgtggctacaaaaacctctctgtttacgatggttcgtggacggaatggggacaacggcaagatctgccgattgagtaatgtctaagtcgttagagtgcagcggagctcgctgcacttcttttctacagaaattggcctacaaaatatccattaaatagcgatttaagacgcagataatgccgtttgcatctgctcatctaagttgagcacggtcaaagcgttactcacactggtcgcgatcacatcaatcgcgccggtgcgcagtgcacccaaaagagcaagcggtttactgttttctgcggcaattgcgatcacttcagcaattgggcggaactcgtcaatccccaagccaatcacgcgatcattcatcacggtattcgcgatacgtccatgcacatcaaaaaagtcatgcccggcgaaatcaccgaccacaccttgattcaggcgtgattgcaccacctcttccggcgtaaaccagccaagatcaaccatgtagctgttttcactcatatcgccaattccgaccagtgcgatatccgctttacgagcaagatcgagggtttgcttcaccgtgctattttgcatgaacacccgtttctgctccgggttttctgcgtaagctggcgcgtacaaggtttccgaactgccgccgtattttttggctagctgacgacaaatgtggtcagcattaaacataccgccacgtgggtgaatgccgccgatgctgcacacaaatttgcaatctcgcggcgtgatcaccccaacatgatgcgccacggctgacacattacgcccctgcccaacggtcactaccatgccgttttttagcgtgctggtgagatagttggataccaaacctgcaacttgttggcgctgtgcttcatcattgggttgatcgagggcaatcaaggcgcggcgcacgccaaaacgttcgatcaagcgctgctcgattttggcgctgaacaccggatggtatttcacagtaatttcaacaatcccctcatcacgggcttgcttgagcaaccgccccactttggcgcgtgaaatggtgtattttttggaaatctcttcctgtgttgcgccatcttgataataagagacggcgatttcagtcagcagatcggtactttcaaccgaaatctctggaatttggctcatgggctatccttctatggccgcggccttgcatgccgcagcactcaacattgcgctcaacattcagctcaacatcagtatgcgcgctatgttactcgcctttttggagtgagcaaatgatctcagtcataacattttctcagtgtggttttatcacctttgatggatagcccatggtgaggccaaatttgagcaaacgatttaatggcaacaagggctgcgaaggcgaaaaaaaactccgctcaacgcgtcataaaccgggttgttgaattgactttcccgacagataggataaatatggctccatcatttactcagcgaacgagcaaatgttcagagcaaaagttcgggcgctgaaaattttgcatttactgactcgcactctctaaatctgcccaaactacttggagttgcaggtaggcggcaagtgagttcatccccatgagcatagatgcactatgtgattggggtgaacgaacgtagccaacaccgctgcagcttcaagtaggaaggggataaagtgattgagtcattcaactgcttgccctatctgaccctcatcggcagataagcccaacgaaataggacgatcgaaatgagcaataaattagcgcaacttcgtaaactgaccacagtcgtggccgacactggtgaaattgatgcaatcaaaaaataccagccagaagacgcaaccactaacccttctctgattcttaaagctgcgcagattgctgaatacgcacctctgattgatcaagctatcgcctacgcaaaaactcaaagcaacgacaaagcacaacaagtacaagacacttgtgacatgctggcggtcaacatcggtaaagaaatcctaaaaaccattcctggccgtatttcgactgaagttgacgcgcgtctttcttacgacaccgagcgcagcgtagcgaaagcacgtcagctagtaaaaatgtacaacgatgcgggcatcagcaacgatcgtatcctgatcaaactggcttctacttgggaaggtatccgcgcggcggaaattcttgaaaaagaaggcatcaactgtaacctgactctgctgttctctttcgcacaagcgcgtgcgtgtgctgaagcaggcgtgttcctgatctctccattcgttggccgtatcatggactggtacaaagctaaagaaggtcgtgatttcgcggcaagcgaagacccaggcgtactgtcagtcaccaagatctacaactactacaaagagcatggctacaaaacggttgtgatgggtgcaagcttccgtaacatcggcgagatcctagaactggctggctgtgaccgcctgactatcgcaccttcgctactggctgagcttgaagcggctgaaggcgaattggttgcgaaactggttgactcaaaaggctctaaagctcgccctgctccaatgacgcacagcgaattcctgtgggaacacaacctagacgctatggccgttgagaagctggctgaaggcatccgtaacttcgcggttgaccaaggcaaactggaagcaatgatcgcggctaagctgtaatcctgattttgaagcgagctccggctcgcttctttctgctgtttatttttgttgaacgcactccgttcaacctcctttattgaaatgagtaacactatgaatcgcaaacaacttgccaatgctattcgtgccctgagcatggacggcgttcaaaaagctaactctggccacccgggagccccaatgggcatggcggatatcgccgaagtgctgtggcgttcacacttaaaccacaacccacaaaacccaaactgggctgaccgcgaccgtttcgtactgtctaatggccacggctctatgctgatttactcgctgctgcacctgagcggttatgagctgtcgattgacgatttgaaaaacttccgtcaactgcactccaaaacaccgggtcacccagagtacggttacgcaccgggcatcgaaaccaccactggcccactcggccaaggcatcaccaatgccgtaggtatggcgattgctgaaaaagctctggcggcgcagttcaacaaaccgggtcacgacatcgttgaccacttcacttatgtattcatgggtgacggctgtttgatggaaggtatctcgcacgaagcctgttcactagcaggcacacttggccttggcaaactgattgcattctgggatgacaacggtatttctatcgacggtcacgtagaaggctggttctcagacgacacaccaaaacgctttgaagcgtacggctggcacgtaattccagcagttgatggccacgatgcagatgcgattaacgctgcgattgaagcggcgaaagcagaaacgtctcgcccaacgctgatttgtaccaaaaccatcatcggtttcggctcaccaaacaaagcgggctcccacgactgtcacggtgcgcctctgggcaacgatgaaatcaaagccgcgcgtgaattcttgggttgggaatacgctccatttgaaatcccgactgacatctacgccgcgtgggatgcaaaacaagcaggcgcaagcaaagaagccgcttgggatgagaaattcgcggcttacgcgaaagcttacccagccgaagctgctgaatataaacgccgcgtagcaggcgagctgccagcgaattgggaagccgcgaccagcgagattatcgctaacctgcaagctaaccctgccaacatcgcatcgcgtaaagcatcacaaaatgcgctggaagcgttggcaaactgctaccagaatttatgggcggttctgctgacttggcgccttctaacctcaccatgtggtctggctctaagtcactgacagcagaagatgcgtcaggcaactacatccactacggtgtgcgtgagtttggtatgacggccatcatcaacggtatcgcgctgcacggcggttttgtcccttacggtgcaaccttcctgatgttcatggaatacgcgcgtaacgcgatgcgtatggcagcactgatgaaagtgcaaaacatccaagtgtacacgcatgactctattggtctgggtgaagatggcccaactcaccaaccggttgagcaaatcgcttctctgcgtatgacaccaaacatgagcacatggcgtccatgtgaccaagtagaatcggcagtggcttggaaactggccatcgagcgtaaagatgctccatctgcgctgattttctcgcgtcaaaacctcgcgcagcaaccacgcagcgcagagcaagtcgcgaacatcgctaaaggcggctacatcctgaaagattgtgcaggccaacctgaactgatcctgattgcgacaggctctgaagtggaactcgcggttgccgcttacgagcaactgagcgccgaaggcaaagcggttcgcgtagtttctatgccatcgaccgatgcatttgataagcaagatgcggcttaccgtgaagccgttctgccagccgccgtgaccaagcgtatcgcgattgaagcgggcattgccgacttctggtacaagtacgttggctttggcggtcgcatcatcggtatgaccagctttggcgaatcagcaccagccggtgaactgttcaaactgtttggtttcacaactgaaaacgtagtgaaacaagccaaagaactactggcgtaattaaaagcgattcttttcaaagttacgcaaagaaagttacgcaaagaaaaatcgatgataaaaaatcccgctgcggcgggatttttgttttatagcacgagacttaaacgattcgattagtaagagatttcaaatccgagcgtaatggttcgccccggatccggcatgctgaccacagaccccggacgcacttgataacgatcggtcacgttgttgatcgcaaagaacagctgggtgttggcattcaactcgtactgtgaatagagatcaatcgtgtaatcggacgggatttcaaggatcggattggccgccgtgcccgctaaccaatcactagggtttgatttgcccgagtgataagaaactttcaccccagaatcgagcgtatcgttaaagaatttcgtacccacattcaggtacaaattctgttttggcggaatacgtgttggagttaatccccatgcaaatccgagcgaattacaggtatcactctccgcgtattgcgcttgttgaacggaacaaatctttgtctcgctgtacaaggtcgccgcaaagtgggtgtacaaccaagcatattggtaatgagcacctaactcccaaccagagagttgcaacttatcataattggtgaaggtaaagttggcctgccattcagacatacccggggttttcgccaatcgtccacctgaaatgaagtctttaatactgttgcggaaataggacaccgacagattcaaacgatcatcctgcagcacactgttcgacgccataaattgcacgccaacctcattgttccaggcttgttccggtttgatcgggttgtatgggttatagctgaacacctcatttgatagcgtcgtttcatacaagctcggcatacggtaagtgcgtgaggatttcaaaaacagctgagtgctgggtgttaaggcgtaggtgaactcactgagcagatcgagcttctccttgtagtctaactgctgcttggtttgataatcggttgacttggcattgtgcagattgaggccaagctgaactctcaacggcgagtaatcgatatccgcatttgcaaacaggttctgcgccgtacgttttccgtggcgggaagtcaccgtcttggtaaagcgggtttgcccatcttcttcaggagataaacgctcattctgctgagccaaaccataattcagcctgactggccactgagtcagtaaggtttcattggtcaggctcagaccagagcgatcattgtgatatgcatgaaaatattgctccgcgttggttcctagcgcccaaagcccattgtattgcgccagatcagcctcggtgtaccaaaagttagcattcaaattgagccaaggatgatccggttggtaatagtaattggcgctgtaggtattcactttggcggttcctagcccccactgcggcattctgtctttgccatcggggtatgggttcccttcccaatcttctgaagatttgtaccaatacgccatcagcacttcacccgctttttgcgcatggtgacggtaattaaaatcggcattgtgtgccgtgccagtgtcgctcgcgagtttgaacagccaagagtcactctcaaaactggtattgacgacttcttgcccttgcccaacaacaggctcttgatactcctcataacctttcttgccagcgaagtgattgccttttgaacgcttactgtacgccagtaccgtattgaatgattcggcctgatagcccaatccaagcataagtgaaccgtgtttaaatgcagaatgctcacctcgctcatcaagcgcgtattggccttgttccgaataatcacccgaaacatcaggcgtccgattgtggttattggcgcgtgctttcagtactacaccgaaggcttgatcatctttgatgatgtctttgatacccaatgttgtggcattcaccacaccgcccaccgcgccactggcataaggtgaactctcaatggtcgcccctttattgacggtcaatgaactgagcaaatcggtatcaatataagtgcgatcactcaccccttgatagccacgagaggtgtgagtggattgcaaactcccatcaataaagatcggcacacgcccctcgccctgcacaccacggatgccaatatccaatgcccccgcttcgttgtgcatgttattactctgcacactcgtgatgccggaaaaaatatccgcgttggcaataccgcgcactttatctaaatcagaacgagtacgttgatcggtgagaatcgattgaccatgaaccgtaacggtttcatcgacggcttgctcggtattctcttgtgcttgaacgacactactcaaaacgacaggaagaagagtgaacaaaggtttcaactgcataatttgatccttgtcaaaaataaagcacgaatactgatgcaattgataattattatcaataatttgtaacaatgattttagtgaccttgctcccacaaacattcatacgatcaatcatttgcgcacgatttactctgattgagccatttatcgccaccgaacaaaagcaaaattagcaatcgattgcttaatgaattctcctgagtcaatgctcagatggagcgatcaactggcttttctctcgtgttagagcgacaatcgcgccattcgtgagccaagctcaaaccaaagcaacacagaagtagaaccaccgcaatgaccacctcttccaccgtaattattggattgcacaacccgaaaagcccaaccaacgtcggcgcagtaatgcgtgctgctggctgctacaacgccactcaagtgcgttacaacggtacgcgttatgctcgcgccgtgaaatttcagaccgacactcaaaacagccatgaacgtattggattggtcgagatggacgatctcaccgcgggattggatagtgaagtcaaaatcgtctgtgtcgagctggcggtaggtgcaaccgcgttgcctcactttacccatccagaacaagcgatttatctgtttggccccgaagatggttcgctgccgcaagaggtggtcgatcaagcgcattatgtggtttacgtgcccacccacggctgtatgaaccttgccgctaccgtcaatgttgtgctgtatgaccgtttagccaaaagcctcggtgagattgacgatcaagcacaagtgatcgccaatcgagataataaaaatcggttgaaggtgaaaagctaaaccgcgttcactttttacgtgagcgctttatgcccctcccccttttagggggaggatggaggggtatttcacgccagttttgctcaactgagtacaacttttaggtcagcgatannnnnnnnnnnnnnaccctcccctaaaaggggagggaactggatttgtggtcatttggattttgtggctgattgtgaatggataactcgtttatggacaaaaatgtgttacgaaaaattgaatattagcaattcattaataattttttgtaaatcaaatttgtcagttaggcgttgctctgttggcgattcaaagcgagttggattcctatctactaaaaattgcaagacaagacactccactaaacatgagatccctcactaaatagtgaagttcaagaaactatactctcgtactcataggctaggaaaaaggtgtgataatgataaagcatagagcagagcaagatgtctttagtcaactagaagaaatttgtaaatcaaacggctatatatacgcagttgcatccctttgttttagggacaactttcttgtgacttctcctgggagaagtattgctgagaattttagccattggttttctaaaaataagttgtgcaagaatgaaatcaatacattgttaggtttaatggttaaaaaaccattaacgaagttagccataacgcaagaagaaatagataaattagcaaatgattcagatagtcttcttgaagaacttcataacagcatgctatttaaccctagtgctattgaagcattattttcagatatggattcatctaaaggttttggtgaaagatttatgagttcaccagcttctatccgtgaatccacattttattctgctgacagtgcttatgattttcaatataacgatctgtctattgaaaaatatatacaggatgaagagtggattcttaaaaataagggattcacagttagaaatgcagttaatatagttaacataataaaagaaaacattaatgaaaaagcaagtaggttttacaagaaagtaaccaactatgaagacttacttgaaatatttagaatagacattgatgctataagtgcaaaaattgattttgaaaaatcagaactatcttcatttatagagtgctttgcatgctcaacaaataacactaacttcaataacgttactgatttgaatgaagttaaattacgacccataattaattttaatgataactactatatatttaacagctatagtttattagaaaatctatatgaatccccaatgttctggattcgtgatactgataaggaatatttgaaacaggcagaaaaacatcgtggtgaatatgtagaaaaaatgaccataaaataccttaagaaggtattcggtgaaaaaaatgtatttagcaacattgaaatatatagagatccaaaaactagaataagcgaaatagatgtcttagttttatttggaaacaaagcattaatatttcaagcaaagtcaaaggctttaactcttccagctagacaaggtgatggggatgcggctaagcgggattttgtagcagcagtacaaaatgcatatgatcaagctgtgaagtgtgctaaagctttgcactccaaaaacgtcatattaaaggacgaaaataatcaaaaaattgaactcaacttagatattgattgtttctatcctattgccattacatcagaacattacccatcattaacatttcagtcgctaaacatgttaactcttgatcgtgaccttgaacttatcaagaaaccttttgtaatggatatatttttcttggatgtgatgagtgaattcttaaacactccactttactttattagctatatagatagacgagctggttattttaatgattttgttgcaagctctgaattgacaattttatctcatcatctaaaggataatttgtggctttcatctgattatacattcgcatgcttagatgaaagtatatgtggagatttagatcacgcaataatgtctagaagaataccttactggggaggaaaaaagacaccagagggaattctcacttatcatgtgaacactcctttctcaaggttaatatctgtgattgataaaggcgatgataggggagttattaattttggtttggaattgctcaaattttccagtaaggccatcaatgatttcaataaagcagtagacggttgttcatacaaatgtattcaagattccaaactacacgatttttcgttgcttatggacgaatacggtgtaacggtacatgtggatttatgtaagaataaaatggacttagagcacgaagctaatcgaatgttggctcacatgaacatgaagaaatactcatgtaaatttgataagtggtttggtgttctttttgatgctattactaaatatccagtattcatgggaggagtagatttcccatgggcatatgatgaggatatggaaaaagcaatacctaaagagataaaaaataacacaaaaaaaatctctccgtcagatattcaaaagaaaatgaaatttaaaattggcagaaatgataagtgtccctgtggtagtgggaataagtataagagatgctgcggtagataaaaggtatctaaatatacttgctttaaactaaccgcccgaaaggtgcggttttcttttatctgagccccgttaacggcatgaggttacgtggaatatccccccatgatacaacacggggatttacaaactaacaccactagaagaatggataaactttggtaggggaaaagcccatgaacaggatgtgaatgagtaagaggtctaccaaataaaggggcacttctgagctaaccccatccactagctagctcttactcaagaattcccccatcacctccccctcaactcctccaactgctttttcagcatggcgggcagtgagtagagcaacaacaggcgcagagcgtggttaatcatcacaaacgccggttccatgccgagtaacaaggcgacggcggtcatggcttctacactgccgggaacccaagaaagcagcagcacgacccatgatttatcgatcaaaatagaaaagacgccggagacacccaccgcgaccaaaaggccaatcatggtgaccattacccctgcgcgggaatacgccatggcttcgcgcagtgtggtatcggcaatgcgtgagccgatcaaaatgccgagtaaagcggtggcgaatatcaccatccatttcggcagttgcatatcaatgccggtggcaaagccattaaagctggcggtgatgagtaacgccgctaacatataaggcgcaggaatgccgagtaaggtggaagctttacccagtagcaaactcatcagcgccagagccaagaaaataagccaagcgtaaacggtcaggctgccgtctacggatgcgctatctggcgcgctgttggagatcaacagtgccaacaaagtgaggatcatcaggcgcacagaatgggaatagaccactttggcggaaggcttttcgcttgattcgctgatcaccaaaatcgcggccatggcacccggtacggcaccgagtagagattcaaacggcgtccagccctcttttttggtgagccacaaatagctactgataatttgcagcgttaaacagcacaccaaacccacgatcaccggcaaggttaaggtggtgcctagctcactcaaactgatggtcgcgccgacactgatcccaagcacgacttgcacaaacagcagcagccacggcggcgtatgaatagttagccaacgcttcttgtgcagcacaataaccaaacccgaggcaataaacatttcagaaagcggtatggagagtagcgtccctgtccccgcagccacggcggcgataatcaagatttgaataaagagtgtgaaagaaactctttcggacatgctgtgtttcctttaggccttatcgctcagtgacgcttttgcggccgagtgagcaaacttgaccacattctcaaacgcggcctgaaagtagatctcgtagctgtttttctccacataaccgagatgcggcgcgcacagcacattgggcaaactcagcagcggctcattgttgggtaacgcgggctcgttttcgtacacatcgaccgcggcttggcgcgttgggttagtctgcatcactgagtagagtgcgcccgactccaccagttcagctcggctggtattcacaaacagcgaatcgggtttcatggcgagcagatcttgtttggtaacgatgccacgcgtggcgtcattcaaacgtaagtgcagtgaaagtacatcggctttagcaaaaaactcggctttatcggcggcggcttgatagcccaactcaagcgctttttgtcgtgaggcttcactgccccacaccaagattggcataccaaatacgtgaccaaattgagcaatgcgctgaccgattttgcctaaaccccaaatgcccaaggtgtgaccagagagggttcgacctaagcctaatccgccattttgttgccaatgacctgcgtgtaactgctcgatataacttggcaaatggcgcgaagcggcaaggattaaaccccagcacagctccgctggggcaacgggagagccgatgccttctaacactgtcacgccataacgctcacacagtgccacatcaatatggttgctgacttttccggtctggctgatgagtttcaaattcggcagatgagccagaagattttcagtaattggggtgcgctcgcggatcagcaccaaagcctcaaaaggtttcaggcgctcaatcaataccgtttcatcactcaggctgtcattgaatacggtgacgtcatgcccttgtaagcattgaaaggcgtttaagccacgcaccacattttggtaatcatccagaatcgcaattttcatctcacgtccttgtggttaaagatcaatccagtagcgtgccagtaaagaggggaaatactctccggtgatcgtactttcaaacacaccgccgttaacttcaatcacgcggcgtgatgcgtgattatcgctatcggcaaccagcaacacgcgttttaagcctaagcatttggcttctatcaatccaaggcgcagcatttcgcggccaatgcccttgcggcgcgcactgggtgcaacatcgtaaccaatatgccccgcttcgttagtaagaaatggcgtatcaatgtggtggcgcaaacgcagcgcacccagaattttgccttgttggtcctgataccaaaaatagctgcaaggcacgtagccacaaggcaggttttggccgtgggcgtggtcatccaacagttgcacatagtcggcaaaattctcatcgccttggcggtaaaaatcacaattgatcgggtcgtggcgctgaaaatcttggaagaactcggcaaacgccgcttcatcctgcaaagttaatcgagttaacggcatagtctctccttgacgaatgattgagcgcgaatttacagcgccagatagcgtggatacaggcgttggaactcttgaatcgcgattttatcggcaatggtttccaccgcacttggcgcaatcggcgtccaaaaaacttcatccgcttcgtggcaggcgatctcaccttgccattgatccaccacgtaatagtgcagcagttgcagctcaaattctgtcggatgataaagcgagcagagataaacgctgcgcgtagcgtccacgcctaactcttcttgcacttcacgctgcaacgcttgcgcttggttttctcccgcttcgatatgcccaccggggatcgcgatgatattaggatcgctcgctttggttgctgagcgacgttcgagcagacaactgccctctttgaccagcaaaaaagagacacattctgccacgggcaatcttgttggcgttttctctacaggctcggttttttctacagacacagctttctccttaaatccgtttcatgatggcgagtgagcttaggccatgctcgggtgtaaacgagtccaacccaccagtaaaagtgcagcaaataccagccaaaccaaggtggcacagaccagagtgccagtaaggctcaagcggtaactaaagtaatacaccgcaagaagatacgccgcatacgggataagcgaatacagcccaaacagcgcggtagtgcgcagatcttccatagtgcgttcggtgccaacaatataatgggcgattaaagcaaaggtgggaaatagcggcacaaggccggagataaaaaagcttttggttttcgataacagggcaatgatcaacaccgcaagcgctccaagcaagcacttgaaaaacaaagccgccatgacatttccttttgtcagaacaggttacaggcaaccactataaatcactctcccgttaagaagaactgctcattaaccagtttgttaatttctctgcaacatttttccgaacctgagtaaaatggccgccactgttttgattcggcagccgatagcggcggcttcttttagttaccgcatgtaggtacagcatgaaattaggaaaacggctgactcagttagtccaacaggtaaagcgcgactacgaccatatttgggattgctgctgcgaccacggcttactcggcgcagcgttgctcaaacagcacccaagcagcacagtgcattttgtcgatatcgttccgtctttgattgataaggtgacgctcgatttaatccgctattttcctgccacgaccgattcaccacgctggcgcacttactgtcttgatgtacgcgatttgccactcgaagccaacgccggatcgcatctcgtcatcatcgccggagtaggcggagatttgatgacggaatttattgctgagcttgccaagcgtcacccaagcatgacgtttgatctgctgctgtgccctgttcaccacacttataccttgcgcgagcagttaatcgcgctgaatgcggagctgaaaagcgagcgtttagtagaagagaatcagcgcatttatgagctgctgcatgtgcaaatctctcccagctcgggggcttgctctcaccctctctctttggtcggtgagttgctgtggcaagtcagcggcacagatcaatcaaagatcgcgcagcgttatttacagcagttgcagcagcactatcagcgcaaagcacaaggtggtgatgcgggcgcagagcagcgttggcaagcgtatcaggccgtggagatccttcactcgatggatgccactctagaactcgttcaataggctagaaagatgaaagcactcaatgatttgaatttgtttgtcgaaacggcgcgccaaggcagtttttctaaagcggccaacagcctatcactcacgaccgccgccgtgagcgctgcgatccgccgcttggaagagcaagtgcaatttccgctgtttgtgcgctcaacgcgacatattcgtttaactcatgagggcgaaatctttcttgccaaaacccaaaccgcgctggccaccttgcaagagggtttggatcagatcgcttgtgcgcgtggccagttggctggccaactgcacatcagcgcgccttcagatttggggcgtaatttgctgctcgactggattgatgaatttatcgcgctgcacccgaatgtcacggtgaaactggatctctctgatcgtctgacggatatgtacgccaatccggtcgatatcgcgattcgttatggtcagcccgccgattccaatttagtcgccatgttgctgtgcgattctaacgagcgcgtattgtgtgcttcgccagagtatttggccgctcacccgcccattctgcatcctgacgatttacagcatcacaactgtctgtgctttatgctggccgatacgctacacaacaaatggattttgagccgcaatggcgaaacgcacagtgtggtggtgcaaggcaaccctgcctgtaatgatggcgaagtagtacacagattggcggtaaaaggcaaaggcattgccaataaatcgctgatggacatcagtcaggacattattgatgggcgtttagtgcggattttgccggaatgggaaagcggccctgtacccatttatatggtgtgtgccgatcgacgtttgatcactccaaccattcgcgcttttcaggaattcattcgtgaaaaaggctgccaacaacgacgtgcggtgctgacagccattcaagagcgagagcaaaatcctcgttagccaacaaacgtcagtgggcgtaactgcaggtattccaacatctcgcgctcaccgatcttttgctgaaaatgctggaaatggtcgctctgttggtgcttttgcaagctctcttccgagcaccagatttcttgcattaaaaacagcccctcaatcgagttgtcacgatacagctcatattggcagcacccctcttcattgcgactaggctcaaggagcgcttcaagcagcgcttgcacttgctgcgctgaatcggggaaggctttgatttctgcgagtaaatggatcataacttacagctcggtaaagaccgcttccgccggccaacgtgatttaggcagtttggcgttgaagtcgtcttcactgtggaaacctagtggcacaatcaccacactgttgaagcctttttcggttaagccaaactcttcgtttagcacttgagcatcaaagccttcaatcggcaccgcatcaatgcccatggctgcagcaccaagcagcagtgtacccacgttgaggtaaacttgtttttgcatccagtgctcagcatcgttcaggttttcacggtgcaagtttacaaagtagctacgcgcgccatgcatgccggttttggcttcttcattcgcaaaacggccatctttatcttcgttgtccagcagagagagcagatacgcgtcatcaatgctggttttggcgcagaacaccatcacgtgcgaggcatctaaaattttgcgctcattaaacgaaaaaccgccctgcgtagctttggcaatgcgtgttttgccttcatcactgccggccaaaataaaatgccaaggttgtgagttcacgctagaggcactcatgcgtaccaactctttgagatcggcgacttgctgttcagatagcttgcggctggcgtcaaacgctttggtggaatagcgagactgcgacgcttatacaatgttcatgtttcactcctaaggatgatgtctttcgagatgacgctaagatatctgactgacacacaacaagaaaccacctgctgcttgaatcattttcaaaaattttttgataatccaaccttgaataggccagccacatgtttgggacagcgaatagcacctaaaaaagaggcagacctgtgcgatcagcctctatccataaattgtctcgtcactttgagttaatgtgccgcgaagcgtttacgcatcaccacgtaatagagcaccggaatcaccaacaaggtcagtaccgtggagacgaaaatcccgaagatcaagctgatcgccagaccattgaagataggatcatcgaggataaacactgcgccaatcatggccgccaaggcggtcagcatgatcggtttggctcgcactgccgccgactgaatcacggcttctgagaaggccatgccctgctcgacctgttggttaataaagtccaccaacaagatggagttacgcacaatgatccccgccagcgcaatcatcccaatcatggacgtggcggtaaattgcgcgcccaacaacgcatggccgggcatcacgccaatgatggtcagtgggatcggagccatgataatcagcggcaccagataagatttaaactgcgcaaccaccaacagataaatcagcaccatacccacggcgtaagcaatacccatatcgcggaaggtttcgtaagtcaccgtccattcgccatcccatgccaccgcaacaccgcttaggccatcgggttgatggatgtagtactgcgccaatcccatttgctcatccagcgcaaaaccaatctcaaacatgccgtacagtgggctatccagctcgcctgacatatcgccgaccaccatcaccataggcaccaagtttttgtggacgatgtaatcatccatgcgggtttggcgcacctcaaccagatcggaaagcggataagcgtgaccgtttgggctaccgactttcatattcagcacctgctctaaacgcacctttgcggtttcagtggcttgaatctggatcggaatcgggtacttgctgtgttcactgtgcaagtaagtgatgggtttgccgcccaccgctgtcgccagcgcatcgacaattgaggcataaggcacctgcagatgtgcggccttgctgcgatcaatcaccacctgccatttctcatgcctttccggcaagtacatatccacatcaacaatatctttcgtttcacggaaaatttcacgcactttgcgtgcggcttcgttacgaatttcttgagttgggccatacacttccgccagaatcggcgaccaaaccggcggccccggcggcacttccaccactttcactttgccgccaaagcgctgcgctatttcgttcagttgtgggcggagttggctggcgatggtgtggctatctctgtcgcgctctttacgcccgagtaagttgacttgaatatcgccttgatgcgcttggttacgcataaaataatggcgcactaaaccgttgaagttaattggcgcggccgttccggcatagatttggtaatcccgcacttcaggaacgtcattcagtgtcgcgcccatctcaaacagaacccgctgcgttttttctagcgaactgccttcgggcatatccagcacaatctgaaattccgacttgttatcaaacggcagcattttcaacaccacggcttggaacactggcagcaatactgaccctgcaatcagagccaaaatggtcagcagcaaaaacagccggttacgcccttgctttggcgcagtaacaaacggcgacatgattttgtggaaaatgccattcgccgctttgccttcttcttgatgatgcccagccttaaggaatttacccgccagccaaggggaaagcacaaaagccacggccagagaaatcagcatgcccattgaagcgttgattggaattgggctcatgtacggccccatcaaacccgacacaaacgccatcggcaacaaggccgcaataacggtaagagtggcgagaatggttggtccgccgacttcatccaccgcagggggaatgagttccgataatttgcgtttgcccatcgccatatgccggtgaatattttctaccaccacaatcgcatcatcgaccaagataccgatggagaaaatcaacgcgaacagcgacacacgattgagcgtaaaaccccatgcccaagaggcgaatagagtaatcatcagggtgacaatgatggccataccaaccacaatggattcacgccagcccatggtcagcagcaccaaaatcaccaccgccgtggtggcaaaagcgagtttccccatcaaggtattgcttttatcggcagcagtttgtccgtaatcacgagtgatatccacatcaatcccttgcgggatcagctgattttcaaggctgactaaacgtgcttccaccgctttagcaacatcgactgcgttttcacccccttttttggccactgcaatagtgaccgcaggatgaataccgtcacgatcccccgtccagacgttttgagtggccgtgttaacaccaaaggaaacggtcgcgatatcttccaaataaacgggcgtgccattgtgcagcccaaccaccaactgtttcacctcttccacacgagttaagaactgaccgacttgcaccggaaactcttggttatcgtgggttaaacgcagcatcggtgagctttgattcgccgccggcagactttgattgagttgatctaaggtgatgccaaagccgttcattttggcggggtcaagacgcacatcgacaatggtgttctgcccgccgatggtataaatatcgcgtgtaccgggaatgcgcttaagctcggtttctaaaccgtgcgccacttgcgtcagttgctgctgatcgaagcgatcactcttatctgccaaggtgatggtgacaatcgggacatcttcaattcctttcggtttgataatgggctcacccacgccaacaccttgcggcatccaatctttattggaatagagtttgttgtagatacgcaccaccgcatcattacgtggcacacccactttgaaaatggcaacgatcatcgcgccatccggttgagagaatgagtagattttatcaatcccttcaatctctgagatcacttgctctgcgggcgttgtcaccaaactttccacttcacgaggggaagcgccgggaaacggaatatagacatccgcaaacgtcacatcaatctgcggctcttcttctttcggcgtcaccatgaccgcaaataaccccatcagcaaaccgactaaggcaagcagtggtgtcatggctgaattttgaaaggccgcagcgatgcgacccgaaataccgagtcgactttccatatcattcaccttttgctgtgacggcctgtgtagcgaccacatcacctaattcaagcccagaaagcacttcaacgtagtcaccatagacttgccccaaacgtacaggattcagtgcacgttggccgttattgactcggtacaccgcgctcaattcggcacgacgtaacacggcgctgctcggcaccactaagacttcacgctgaccatagttaaattcggtttttacccacatgcccggcaccagagcagcgctgttttgcggcagctcaaggcgagttttaaaggtgtgcgattgcggatcggcgtagctaaacaagctaaattcgacgggtttcaactgctcaccttgcgcagtgcgcacggtaaattgagagacatctgccacataaggctgataacgctgcggaatttctgtttccactcgcagttcatcgagcgaaaaaccgcggagcagcggtgtgcccggtgcaacggtttcacccagttccaccatgcgctgggtaacaatgccatcataaggtgcggtaatgttggtataacctagcgattctttggcttgttctaccgccgcttgtgccgatttcactgcggcatcggcactgcgtgcccgcgcttcggcgctgtccatttgatctttggaaatcgcgcctttggggaacagttgacgataacgattgagctgggcttgtgcttcacggttttgtgccgtggcactcgccaattgagcttgcgcggcatccaatgcggcagattgctgaaccgccgagatctccaaaagcacctgatctttttttacgaaatcattcacatcgacgtataagccaaccactcgccctgaagtttgcgcggctaacgagccttgattgaccggctgcaccacaccgtccaattcgactatctgcgagatcaactctgttttcacggtaaaccgttcgttactgtcctgattttgagcataggccgaactggcaagcaccagtgcgatactccaacttaacgctttcatcctcttccctcgcagattctactttcccgcttgttgccacacggtatcgcgaacgcgtcaagcgggtcagagagtgattgcctagatactgcctaatagcctagttgcattaggcggtttgtgtttggctttctttacgatttctaatacagatcaataaattagttgtacctaagccaaccatcatcgcagggaaaaatacccatgatccgagattgcctaaggcaagacttgagacaacgggccccggacagatgccgaccaaaccccaccctaaaccaaagattactgagcctgagatcaagcgacgatcaatcttggtgttgttggccaaacaaaacacttctgcgttaacaggcttggctttgggtttgatgaggaagaaataagcaggcatgaatatcgctaacgcgccgcccatcacaaacatcaaactggggtcccaagtgcctgccacatccaaaaagccgatcactttagcgggatccgccataccagataccaccattcctaagccaaataacaggccagcgacgagcgaagttgctcgaaacaacagcttattcataaccactcacttacatcagatgaagacgaacgaaaaccgtgacagccgcaacggccataaagacacaagtcgccacgatggatcgcttagagaagcgaccaatgccgcagatcccgtgtccactggtgcagccattggccagtcgtgtccccacgcccaccaataaacctgccgtcgcaagcacaataccgctcacaccaaaatcggtcgccacatcatggcctaagagctttacgccgatcacaccaccggaaatcatgccgaccacaaacagcagtcgccatgcaaaatcccgcgatttaggcgttaacaagcccgtcaaaataccactgatgccggcgatttttccgttcataagcaacatcaatgtcgctgaaatccctaaaagcatccctccaattaacgaatcccaaggaatagaaaacgtcatactttcctctacttatttatcgacaaaacacattctgtaaactttgaatcaacgccgtgatccgactgtccgccaagcgataaaacacctgttgcgattctttgcgcgcttggataatgccgtgctttcgcagcacagtaaggtgttgtgaaaaggccgattgactcaacgtcgaaccttgttgaagctgcccgacgcccatctcactctgcgtcagttggcacagcaccattaatcgttctggatgagccatcacacgcagtaattcagccacttcttcggcatttttcttcatttcatccatttcaatcttgatggtggtgggttctggcatggcgaatcctctaactaaaatttaacgagataatacaaaaataattatattagtcaattcttatttagtcattttgaatttagttaaatttacattagacaaagctaattctcaggcgtatagttctgaacaaacaacaacggaggttagcaacatgacgattgaaaacggtgtaagagtattagctggcagcatggttctgctctcagtcattctcacttggtttgtccaccccaactttctgtggttaacagtatttgtgggtgtaaacctgatccaaagcgcattcacaggcttttgtcctgccgcattctttctcaagaaactaggattacgttaatgacagccctacccctttccatcctgaaacggtgtagggttttagcaactgacttggagtaactcatgacgaaaatagtgattattggtggtgttgcaggtggagcctcggcggcggctcgtgcgcgtcgactcagcgaagacgctgaaatcatcatgttcgagcgtggcccctacgtttcctttgccaactgcggcttgccatatcacatcggtggtgacatcaaagaacgcagcaatttgctgctgcaaacaccggaaagctttttagcacgttttaacgtggatgtgcgcaccatgaatgaagtgctgcgcattaatcgcgccgcaaagaccattactgtgcgtaatctgctcgatcaatctgagtatgatgaaaactatgattttctgctgctctctcccggtgcaggtccagtcatcccgccaattccggggattcaaaacccactgacgcattcactacgcaatattccagacatggataagatcatccagacgctgcaaatgaataagcctgagcatgctaccgtggttggcgggggttttatcggtttagaaatgatggaagccttccatcaccttgggatcaaaaccacgctgattgaaatggccgatcaagtgatgacaccggtcgatcgcgaaatggcgggctttgctcacgctgaaatccgagccaaaggcatcgatttacgattaggtgcggctttgaaatcggtcgaatacagacccgccgccaccttaccgagtgcggaatcgggggaatcccttgagcataaacacgtggaaggcgaattggatttgctgctcagcaatggtgacacgctaactaccgacattctgatcatggcgattggtgtacgcccagaaaccaaactggctgcggaagccggtttgcagctcggagaactcggtggtatttgggttaacgagcagatgcaaaccagcgatccagcgatttacgcggttggtgatgcggttgaagagaaagactttgtgacaggcaagcaaacgctggtaccactggcaggtcctgccaaccgtcaaggccgtatggccgcagataacatgcttggccgcaacgaaagctaccaaggcacacaaggtactgcgatttgtaagatttttgatttagcggtcgcttcgaccggtaaaaatgaaaagcaacttaagcgtgaaggcattgcttacgaaaaagtgtatgtgcacaccgcaagccatgcgagctactatccgggggcggaagtggtgtcgttcaagatgttgtttgatccccagacaggcaaaatcttcggcgcacaagccgtaggtaaagatggcatcgataaacgcatcgacgtgatggcggttgcgcagcgtgcaggtatgacggttgagcagttacagcaccttgaactgacctacgctccaccgtttggtagcgcgaaagatgtgattaaccaagccgcctttgtcgccaccaacctgataaaaggtgatgcgaaagcgatccattttgatgagattgataacctcaccgatgagcaagtgctgctcgatgtgcgtaacccgatggagttacaaaacatgggttatttgcccggcgcaatcaatattcctgttgaccagttgcgccagcacatgaacgagctgccaaaagacaaagagattgtgatttattgccaagttgggttacgcggtaacgtagcgtaccgtcaactggtcaataacggctttaaagcacgcaacctgattgggggttaccgtacttacaagtttgctaaggcttaaagttagggttcccagacagaatcggaacacagaaagtcaaaagagatggcacatgccatctcttttctattgaactatgccgttggctgcatttactgcatcgaatgcaaaccaaacagattaccttcggtatcgaccgctaaagtaatgaagccatactcgccgatcgacattttcggcgtatggatttgaccaccagctgcaacaattcgctcttgttcaaccgcacagtcgtcgctcgagaaataaatcagtgtgccgccaccaccagcgcaaatgccttccattttgaccaacgcgccggatgccccgtacttttccatattggaaggaaacgtgagcattttaatcggcatcgacgttggattaggcatttcttccaaagaaaccttcaaaaccgtctcataaaacgtttttgcacgttccatatcattcacataaatttcaaaccaacctacgggattattgagcatgatgtcacctttattttgattgtccctatcccgcagaaaaacagagaatccacgagaccgaatctattctcaatcaccatagtcaaactctgtggattttgctgtcttatctttgctacgtcactgagcaaaggtaatgctgcgcagcctctttacccatgtatttagccaacgttttcagtggtacttgcttcaaattcaccacaatcaagccatctaacgcatcgttaaaagcaggatcaacgttcaaacagaccaacttgccattcataccgagatactggcgcagcaacacaggcagcccgttgccctgctccatccgcgcaactacttttgagagcaaagagacactggcgagtgccgatagcaagctcttttgccaaaacacttctgttccggcacgcaaaggggttgatggactgaccaaagccgctttatgttgatcatagtgatggatggataaggtcgcagccatcagttgtcgagctgctgggctgtaatcattgctgatgctgaccgggccaaacaaatgggtgtaatgtgggttcaattctacgaaacgcgcaatgcctttccagagtaaaagcaatgagttgagattacgttgatactgttcagccaccactgagcgaccaagctcaatcgcattctctaaggtcgccaagaaagcgtgatcgtaatgaaacaagctacgggaatagaggccttgcagccctctttctgcgacaattttatcgaccaagcccatgcgatacgcaccaaccagctcgctctgctctcgattccaaacaaagagctgccaataatggtgatcatacgcatcgacatcgcaagcctgcccgctgccttcccccaccgcgcggaaactgatttcacgcacacgaccaatttcttgcatcatgagtggaatgtgggttgaaggtacgcagtacacggtgaattcgccctgctccaataacttggcttgcttatctaattgagcaagctctgcgatgagagctgctttaggtacaggatcaattaccggaatcgtaaaagagacttttgccgattcaacttggccatgcgggctcatcaaataggtattgagccgcaagtaattgaccacatcttcatctttggtgaactcttttaattccgcataaggaatcggctgaccaatgcaaagggaaatggtactcgcgcttttattcaaaagctctcgacctaacatggcggtgcgcaagagcggatgaatttttccagcgcgataaaaccacgcgctgttacgaccatgaatataaatcggcacgcacctcgcttggctacgctgaatgaatttcgcaacggattgactccagtcaatatcactcaactgtccggtttctttttgcggtgtcgaaacttcaccggcgggaaatacgatcagtacgccaccttccgctaaatgtcggtgtgcttctcgaatacctcgtgcattggttttactcgcctgcgcgccattaaacacatccacaccaatgaacagaggttcaatttcaggtaagcgtttaagcagttgattagcgagcactttgacatctttgcgtacttgcccaaccaaatcggccaaaatcaccccttcaatggcaccaagcggatgattggccacaatcaccacaggcccttgcgcggggatctgttcaacgcggcctctatccacttggtaatgcacattgagcgcttcaagggtgtaacgcataaactcaaaaccatcacgcgtggttggcctttgttggtaatagcgctctagctgactaagccctgtcgctaactctacccccttttctatcaccccaaatggggtgaagcgcggcaatcgaaatggctgggtttgcatcattcgcttgtcccaatcagcgcaggccaattttggtcgccttgagcgatatgatgcgcccgatctttttcccacaatcctttaatcttattgttgtagttcagataaagcttaccgtcttcaatggcccagtattgcggatcaccaggcgcgaaatccttcttctcagacaccgcccatgcacagtagccaccatattgcggcgcgtatttttcagggtcagctaaaaacgcgtcgaggttttgttgagaggcaaacaaccactcggcaccttggtactcagttttaaactgcgcggcccctttaacgggtttgccttcggtgaaataagcgaccgtgtcatacccatccagcgctttattgctgaacgtgccagtgtaaatcggatcttgcgccatggtgaatgtgctgaaaaagaacaggattaaaccaaaccaatatttcattacgaactccttaagaaaccaaagatattatttgaggaaatcgatattgcggctgatgcaatatctgctctgtcagctgcgttgggcgaccagagaaataactcattcccagttgtccatcactgaccttgatgtgagtaaaactcacggtatgggcatcgtctcgctgcatcgccaccgaaagatgcggccactgtgggtgttgatggcagtgaaacgccaacaacttttccggtgttactccatcggcagtgaggtgttgatagacctgcgtgcgatagcgctgcacttcgtcaagcgcaacaccagatgaaaaaaggggtgatgaggtcacgcctgagcaaaattgttcgccatcccatgcataagccaatacctcaccttgctgttgagtaagcaaaggatcaaaagccagcagagtgaagggagcaaaacgagacaacgccagtttttcaaacgcaagcgtgatttgttcaatcgaagaggatcccgcaagggatttgagcagcaatccgcggctgatcagcgtcccatctggcactcggccttgatagttattaagcagacacagcgataacccgaactgattaaggctaatccaactgccctgaccttgcggatcgagcggcatcatgactgcaactccttgtcgatcatagatggcgggaggcagcgctaaggctcgactcctttgctcatcgcgattgaaaaacacctgataaccggtgtcactcaaagaccaagtgacggagcacattaggcattgcctcgtaaaaaagtggcggtcgcgggcgctaaaccaaaatcactcggcgtttgcacgttcagtaaactggtcaccacttttgccatcgcaaaatggtgattcgcatgcagcgcagcgaaggccaattcacgctctaaggttgaatgaaaggtgcagctttcggtttgcgataaagacacttccatcaccacatcaatggccatttgaggtgactgtagtaaatcagactctaaccatgcgatgagcgattcaatctccttaagtgccacttggcgagacaactcaaccggatgcccacgtcgacgctggttgtaatcgacggtgtttggcgcagcgcacagcgcatggaaaatgtctaaccaatggcgaaaatgctggccaatactgctgctcacatgcggcttcgccacgtaggtgtagtgatcgtctccaatcgtgtttaaaaaatcgcgcccttgttctagtgtctccaaacagccatgaatggcggctgagtatcggtatggttgcgctaaggttgtcacagcaagcataaaatccccttcaatgtcttattcaatatccggtctttgtaatatctggttatggttattccagagcattcggcgctcatgcgttccgctaatctgtctctggatagtgctggatcaattgtttttcctgccgccaagcacgtaataaagcgcgcaaacttggcggtttgtggcctcgctttttctgctcagcgccaatcgcgtacaaaatccgatattgcttaagtagcgtagtgaagatttcaccgagccgcgtttcgcgatcccatatatgcgtcgcttcgctgctcgcgccattgacctcaagaatggtgaacgcgtcaccacgcatgagcgcatcaatatggctgaatttcacatcgagtcgcccgtagtgaaaaccggggaaatcgtcaaatatcgcatccagtttttcgactaaagcaggcgtgatatagcgattgccattacgaaaaatcgaaccccggctgtgactgcccgcaaacgctaattggaactcttgtttgtccggaacaacccagtcgagcttgtcagggtggcgtggtaaatagaggtgcgccagttgtccagatcgcgggcaagcgtggatcaattcacgcagcgtacgcacgccatcccccatcacactcggagcgtatttcaaggtcattgagatgatttgcccctgcgcgtcaccgggaaaacgcacgtagaaaatccccgcttcagcgctatacggcgctttttgctgcaaaagaaaacgcgcttggacaggaaaacggcgtaggtactcgctcagttgttcatgggattggatgagttttacccccacaccacgacaaccgagatcgggcttagccactaaaggaaagcgcaaatctgcgtcatgtaaacgttgctcaatggcttttacctgttcggtgagcggcagatcgtttaccgtgcaagtgataaacggcgagatccaacgtcgcgcttggtcgccagctaggctcaaaatatcgtgcttggactcaccgaccataccgcttaaataaatggtgggattcgccaccaaaggcagacgtaaatcacggtaataaagccccagcagcacactttgcaccaccacaggcgcgtaacaaaaccagctaggcagaaattcaaaaggcgagatcgcccgttcgttggcggcctcaactaaaagaggcatacccgcattcactttatgctcggcaatacatgccacgggagaaagaactgtcatgcggtttccttaatcattttggcactgaagacgcgattaaaaacgagtaacaacacaaccaataagcacagccaccaccagcggtattcactggcctgaaaccaagcctgactgcctaattgatagatggcgaaaaacacgaccaccgtccacaaagcggttgccatcaataccgcagccgtaaatagccgcagcggcaaagcgacataaccacttaacgtatagccgaccgtgcgaagccccggaataaaacgaatcgtaaacaggttaatgaaaggtctggctaataagcggcgacggacctgtcgaaaatatggattggtcaataatcggtagcgcattgcgcgaaaataacggctgtaacgcccaaggtaataaagcgcaatatctcctgttgcgatgccgataaatatcgccagcaaagcgaaaggcatgggcgtgagctgttgactggcgagccccgctgccgtaacgatcgctacatcttctaataaataagaaagcacaacgatgccaagaaacacccaaaagggtgagctgctatgcaaggtgagccattcgctaaaagcggcttccataaatcaatccaaaccaattattcactgtacttattactctagaccgaatcggtggatttaaaatttcaggcactcaacgccacaaagaaaagattctgaaaagaaaatggagatccttatgctctcccgtcatgctaagtgacagaataaaagaaggcattggtgacaaaagcaacgttaaacgtgctctaaacggcaatttatcgctgttgtattgacattttgggataagtttttagcatggcgttttttactctaatgagaattttccatgtctgagacaaaccaaaccgaaacaccaaaagtggatctcgaatccatctctcctgaactgcgtcaggttctagagtttgatcaggtgcctgaagcgatgttccatatggtgacttcaatccatgaagtctctgaagaagtggttcgcgaagcatgggattcactgccagcgagcgcgcaaaatattctggataactttgaacagttccacgctctcatctcggtaagccaagcatttgctggtctaaacgtgatggaagagttcccaacgctgaaccttcctaaagagatgagcgaagaagataaagacgcgtaccgcgctcaactgcttgatcaagtgctacacaactgtgtgaaagacatggttaagcagatcaaaaaagcccgccgcgacccgattctgaagcgtgacttcaaagatgtgtttgctaagtaagtaaacctagccctcatgcacattcgtgtttgaaaggcaaaagataactaaggagcgccaaagcgctcctttcgtttttctatctttcagagattcaccttggtattgaactatcaaaaaagcccactcaaagagtgggctgcgtagccaagatagggggagcagttacgcggtgacctgagccgcttgtttggttttttcacgcatcgcaagcaggacagtcaacgcaaaggcggccacaaatgagatcgccatacccatgatgtagtaaccaatttgctgtggattaatcgaaatgatccctggcaaaccagccgcgcctagcgcttgggcttttacattgaataaagtgatgaaagcactggctaaagccgcaccacagatggcagcaataaacggataacgcaatttcaaattcacgccaaacatggcaggttcagtgatccccagcagcgcggtcacacccgaaggaatcgcgacccctttgagtttggtctctttcgtcatcacacccacagctaaagccgcggcgccctgcgcaatgttagacatcgcagcgatagggaaaataaaggtgccacccgtggtcacgatatcggcaagtagctgagtttctatcgcgataaagctatggtgcattccggtgatcacaaaaggagcatagataaagccaaacagtgcgccaccgacaaaccctgccgagtcatacagccagttcagtgcatctcccaacatgaagccgacatcacgcgttagcggtccaaccacagtaaaggtcagaaaacccgtgataaaaatcgccagcattggggtaagcaagttatccactacagacggtacgattttgcgtaagccattttcaattttggccagaatgtaagcggaaaccagcacgggcaataccgagccttgataacccactttttcgatttcaaaaccaagaatattccaagttggaacggtgccagatacggatgcactgccaaaaccccagccgttcaagagatcgggatgcaccatcagcatacccagcgcagcgcccaaaaaggggttaccgccaaacttgcgcgaggcagaaaatgccaacaatacaggcaaataaacaaaaggggcattcgcgaaggtgttgatcatgctcgcgagatcagccaatcccggattggcatcaatcaacgattgaccttcaataaacagtcccggggcagtcaatacgttgaacagtcccatcaataaaccacccgccacgatcgcggggatgatagggacaaaaatatcggacaatccctttactgcgcgctgtgcccagttctgcttttcggcacccgcggaagcgacatcattggttgacatctcaaccaaaccggtcaatttcgccatctcagcatagacttggttgacaatgcctgagccgaaaatgatttgatactgcccggcgaccttaaattgtcctttgacaccttgcagtgattcaatggcgctctcattaatttgcgtttcatcgttaagcactaagcgtaaacgagtcgcgcagtgcgcgagtgcttggatattacttttgccacccaagctctcaagaagttgttttgctatgactggatagtccataactcaccccggtagttatcccctttcaacttgaagttgtattacctgctactccaagtcgtttggatgttgttgtgtaattgaatgattcgttggtttcgatattaatttcgggaacgtttgcaaaatgattcttgtctgtttcggagtaatggtcaaaatcaacacagtgaaaatgtgaataggatcgccaaatttcgtgaggataaaccttagaacggggttaaaatccgatcattcgtttgattgctgtactgatttctgcaatccatcccagtttttgagcctacaggatacgttatggccagtttgcatgatgtcgcccgtttagcgggtgtctctaagtccaccgtctcacgcgtcatcaatgatgaatatggcgttaaagagtctacaaaaatcaaagtgttaaaggcagttgagcagtgtggctatatggtcaatcaagttgctaaagacctcaaatcacaaaaaaccaacttaattggcgtgattgtgccgcgcgtctcctctcacgcaacagcacaaggcgtggatggacttaccgctatttttgagcaagcaggtaaacatgttttactggccaacactcatcaagtccatgcaaaggaaattgaatatattcagatatttaatcaaaagcgggtggaaggtattgtgttttatgccactcaccttgatcagccgctggttcatgcgattcaacactcggcggtacctgttgttttggttggccaagatggctctttgtataacattcccagtattgtgcatgacgatcaccgtgtcggcttcgaagcaggacaacgcttagtcaaagcaggctgcaaacagatcggtttcattggggtacaaagtgatgacattgcggttgatgtgctgcgttcacaaggcttgcagcaagctctggggttccatcaacaaacgttgctgtttcatgcgcgcggtaatttctcaatagaatcgggctaccaaatggcaaaacaagcctaccttgactatccacagctcgatggccttttctgtgccaccgacaggctagcggttggcgccattaaagccttgcaagagcttggggttcacgttggacagcaagtcaaactgctcggtgtcggtaatgatgagttggcttatgtcagcaatcccccactctccacttttaactatgcttttgataaggcaggagaaaacgctgcgaaaatgctattagaacgcatcgccggacgtggacaagagatgagcaaagtggtactgaccttccaaaacattcaacgtgagacttgcccagtctaaccatgaaacacttgctttaccgattttgcagcgctaaattgagaacgttcccgaatttagtggttaggtaagtccatgttattagatacgctgctcgaactcgcgggtggaataaacaatgtcacgcgcattttagctccacaggggcaagtggttttggcactaaaacatcccccgcttgtccctcaccttcctgacgatgtgagtttgcaatcggtacttggagagtggcaactctctgtccaacgcactgctgaagtgtccgatcagcaactcgccgcgataggtaaagcgattgccgagcgccaaaagcttgaaaccctcccttatcaaacagccttagactgcccttatcggcccctgtggcatatctcaccaccacagggcttactcaacgaccccaacggctttatttatcatcaaggggaataccacctcttttatcaatggcatcctttcgcttgcgaacacaaagataaatactgggtgcatcttaagagcctcgatttagtcgattggcagtggcagtcggtcgccctgacaccttcggattggtttgatagccacggggtattctcaggtcatgcggtcagccatcaacaagatttatggcttttctataccggcaacacgcgcttaggcgtagatcgccaacgccaaaccatgcagtgcgccgcgcgcatgaacgccaatggtgagtttgaaaaattaggacctgtgattcggtgtttacctgaaggcgtgaccgaacatatccgcgatcctaaagtgatttacacccaaggaaagtggcagatgttacttggcgcgcaaacgctcgctcatcaaggacgactggcggtctaccactcagatgacttactccattggcatttcgataagctctatggcgatgaacttggcgattacgggtatatgtgggagtgtcctgactggtttgaactgcaaggtgaagccttttttgtgttcgggccacaaggtatcgcatcggcgaatcctcatcacaccattgaacatcaaaatcggatctttcgagcgacccagaatgcacaaggtgaaatagcgttactgcagggttggccattggatgaaggctttgatttttatgcaccgcaaaccgcgcaaactgccgatggacggcgagtattgtgtggctggatggggctacccgatgaaacgcagcaccctagctgtgaccaaggctggattcatcaactgaccgcactccgtgaactagagtggcgtgaaggcaggatttatcagcacccattgcgtgaactcgacacactgcaaagtgaaccgcacaccttgcttttgagtgacaacgtcactgagctaaaaaccaagagctttgctctgcaagtgactctgccttggggatgtgagctacgcttgatgcaaaatacgcagtatcgcgtcacgttaacgttagatgcagaaaatcaactattacgcctcgatcgctctgcgactcaaattcgccaaggggacaccattcgggagctgaagctcgatagcccaacggttgagctgcgcatcttggctgatcaatcctcattagagattttcatcaatcaaggcgaacatgtgatgaccagccgcatctttaccccacgtgatgccagcggtatttcattgcatggcgcgagcgtagacgcaaagctgtactacatggctcccgcatctgcgccatttaacctagaagtgaatgtgcagccttgaataaacaacttggcgtggcagatatgccgcttcaagttgcaaggggatatatctcagagagatatatcccactatgcgaagagtcaatatggccagagtcaatcttcactctagccatatttcattctaaaaaggcatacagcgccgcttgattcggaagtgcggtcatggctcctttctgtgtggtcgctaaagcgccacagccattagcccatttgacggcatctaaaatcgtggcttggttatgccaatcttgcgccacggataatcgatagagcaagccgccaacaaacgcatctcccgcgcccgtcgtatcaatcggtttgactgccttgcccgacacaatttgccgcgagtttggtgttaccaccagcgcccctttcgcgcctaatgtcacgacaacaagagggatctggaagtcagctatcgcctgtaatccttcttcaattgactgagtcccggttagaaactgtaattcctcctccgaaaacttcaccacatccgccaaaccgacggcacgcatgacagtggcctgtaactcttgcggctctgaccatacttcttcacgcagattaggatcaaagctgacatatccccccacctctttcatttgcgcaattgcggcaaaggtcgagctgcggctcggttgattggccaaagcaatcgaacaaacatgcaaccactcaccattttgaaaagagggaatatcactgagttgcaggaattgatccgcgctcggtttcaccataaaggtaaaactgcgctctccatgctcatcaaggtcaacaaccacagtggaagtgcgatgtacggggtcgaaatacaagtgctggcaatccacttgctcgtcagtgagtgtctgttgcataaatcgaccaaagggatcgttcccgactcgaccaaaaaaagcactgcgaccgcataaacgggcgattgcgacggcaacattagcgggtgcaccacctggacactttaaataatgctgttgcccatctgggatcagatcgaccaccgcatcgcctgtcagccatactcttgacatagaatcactcctcaaaatgtggtttgagctgagtctaaccaaagcgttcaatagggaaaactgccttattcgagttcaggtcaggaattgctcatttctgtgagcttaaatagagattgcgatctctatagtaagtttctctttactttttcgggaacgttacctattcgaaaaatcatcacgcctcatcccatccccaaacggattggtgcagcagccacacacatgcgcctccagtaaaaatgtaatattcgagcgctcattacacccatttccctcgttcatttatgatcaagatcaaaattcatagtagaaatattgcgcattcctatgttttaatgctttcatacgaacattaaagaacaaaaacgaaaacaattaagcgcggagatagaaaatgaacgctcgctcaacacgttttacccaagatgaagtgctcgatttgattattgttggcggtggcattaatggcgctggcattgccgcagatgcaacagggcggggattaaaagttggcttatacgatgccaaagattttgccagtgcaacctcttccgccagctcaaaactggtacacggtggtttgcgctatttagaacattatgaatttcgcttagtcagtgaagcactggcggaacgcgaagtgcttttgaaaaaagcaccgcacatcgtaacgccgatgcgttttcgtttgccacatcgtcctttcttacgcccagcatggatgatccgcgctggtctgtttctttatgataatttgggcaaacgcacttccctacctgcaagtcacaaagtcaacttaaaagcgggcagcgtgactaaacctgaaatgcaaattggttttgagtattccgattgctgggttgatgatgctcgtttagttatcctcaacgccatgcaagctcaagaacaaggggcagaagtgttgaactactgcaccgtcgaaaaagctgagcgtatgggcgatttgtggcatgtgacgctactggatgagcagactcaacaacgctttgagcgccgtagtcatgcacttgtgaatgccgcaggcccttgggtaaagcagtttttaaacgagaatgctcacgtcagttccccttacggcattcgtttaatccaaggctcacacattatcgtgccgcgcattcacgatgagccgcaggcctatattctgcaaaatgaagataaacgtattgtcttcgtcatcccttatcttgatgactactcgatgattggcacaacggatgtcgaatacaaaggcgacccaagaaaagtggcgattaccgatgctgagcgtgattatttgatttcgattgtgaacaaacattttatgcgcgaaatcgcgcgttcagacatcattgctgaattcagtggtgtacgcccactgtgtgatgacgaatcgaactcgccacaggccattactcgtgactatacactgtctctggatcaacaagctgatgaagcgccgctgctgtccatttttggtggcaaactcacgacgtatcgcaaactaggcgaagcggcgatgaaacatctcgctcctttcttcccgaaaatgaaagccccttggacagcggatgctcctctgccaggtggtgaaaactttgactatgcagccttaaaaaaccagctggtggcggcctttccttttattactgagtcagtgattgagcgttggctccgcagctatggcagccgcaccacgcaacttttggcaggtgtgacaggcattgaagatctcggcatcgcgttcagcggtgagctctaccaaagagagatcgattatctgtgcgagaaagagtttgcccgccatgcacaagatattttctggcgcagaagcaaactcggcttaaatcacgatacaagtgtggttgaggaagtggagtcctatttacagcagaaattccacgctgagcagccgctaaaagcgaccgtttaaaatccaagcactcgcagaaactgaaatggccacataacgtggccatttgtctttttctctttttcttttggactcagaatcggctatgcccttcctcgcgcctatttttgtgcaaactgcttcgaaagcgctccaaattctgccactttaccgctcatcgccatcgctaactgttctacggtatgggtggccgccgaattttgcgttgccacactggcgatagagtggatatgttggttaacctcgcaggtgagctcacgttgatgttgcgcagcactcgccacctcaccgataactcgtagcatgtcactcattacgcattctacatcctgcaactgctgcagcgtggtattcgcatcttgagcgcactgctcggtttgatcacgacttgcagtgatatcccctcgccacgcttcaatagtggacaacatagtatcaatgctggtttggatctgctgtgtggcacgctgggtacgagccgataatgcgcgcacttcatccgccacaacggcgaaccctcgaccttgttcacccgctctagcggcttcaatcgcagcattcaacgccagtaaattggtttgctcagcaatcccgccaatttcagtcattaattgcccgacctgctgcgcttgatcgctcagttttagtgtcgtcaaggcagcactctcagcttgcgtggcaagtcgctgtaaattctgatgggtgacattgatgctgtgtttggtctcggcacaatgatcttgcacttgatcaatcaattgatgagccgagtgagtatggctcgaaacccgctcagcggcgctctcgacagcgtcggtggcctgcgttacggcttggatgttgctgttttgtgccgccaacgcttgatgcacttcttgcgtcgtcaaatgcagctgattggccagttcacccaatggacgcgccgagtccatcattctaccgagaatggtacgaatccgagcggaagccatttttagatggtagtcggcaacagaaaaagcatcagcgcccgaatagatcaaacggctgatactgtcatactcgttttgccactgtttaagctgttgcggggtacgcactagctcttgccgaaacaacaaacctaatactcccgctggtaaaagactggctaaccattgccactgttcaggagcttgaaacccatgtgccaatgctggtgacatcaatgcaccgagcaacaaggcgtaacgcagcgaagtatgcagcttaaattggatttttttaccggccttttcagccgctaataacgcttggtaggctttggtggcaatctctacccactttcgctcagcttttacccgaaccgattgataacctgtaagttggccttgttgataaatcggcgttacataggcgtcaacccagtaaaacccgccggatttagtgcgattcttcacgattccgcgccaagcatgcccttgcttaaggtggtgccacatatcggcaaacgccgctttcggcatcgaagcatggcgaacgatattgtgattttttcctagcagctcatcggcttggaacccagcaatacgacaaaatgtatcattacagtaggtgatgacaccttttaaatccgtcgttgataccaattggtcatggtcgccgacaaggacttcttgttgagcagagggagtataggctgacatttcggcttgttgttctaaggttatttttatgagcgcaaatgtatacacacttgttattaaaaactcaaactctggagactcgtgggcaacacaaacgtgaattacatcaaaaacactagggttaatacttagaaaagaataaagagcggaacctcatgctatgaaattccactctttcgatatttcgatttgttatgcgaacagtctcaaaagagagacgataaatattaaccttaattagacgcgaggatgaaacggatctccactcggcggttacatgctcggccattcttagtactgttggtgcacgcgggaacattctcaccaaatccacgagtgtaaatggcattttgtgccactcgactctgtactaaagccgctttgaccgcattggcccgtcgctcggctaacttgtcgttcagtttctctgaaccggtattatccgtatgcccttcgagtacaatatcaatccctgactcggtagcgagaaatcgagcgaccgtgtctaaccattgtttggaagccatagagactttcgctgaacctgtttcaaaccgaacggtattgttcaacttaatcatcgggtagtcacccggcaccacttcatgctgaatgccgttactcaataaatactgacgtaaatcttcgtaactggccgaacgcggctgggtcattgcattgggcatcacactggtgttcttttgcggtgcgtaaccccattctggataacgcacatcgaaatcgcctttcggggcgacatcgagcagattgtcgttaaacatgcggtcagtcaccagcgaaccacatcctgttagcaaaaacgtcacgcacaacacccagaatttcatctcaaacactcagttattgaacttcttatagtttatcggcatgtttctaaaaactttatctgtcatcaacaacaatttacaaatgggttgcttgccatcacataatccgtggttagaatgttcgccattcattattccctcataagtaaagctgacgactcgcgtctctgctaactgttaaacggggaaagtcatcgctgttaaaggacgtcaaacattttatgtcgaaaattattatccctttagttgttttcttgctcgcaggtttcatgatttaccgtacttggactaatcataagtcggcagatgccaatttttctgctgggcagcagtttttggctgagaatggacaacgcgaaaacgtcatcactaccgatagtggtttgcaatacgaagtgctgcaggcgggaacggggactgaacatccggggccaaaaagccgcgtgaaagtgcattaccatggtgagttgcttgatggtacggtgtttgatagctcggttgaacgtggtgaacccatcagttttggcttgaatcaagttatcaaaggttggcaagagggcgtgcaactgatggtagtcggtgaaaagactcgcttctatatcccaagcaacttgggttatggcaaaaatggcgcaggcccaatcccaccttctgctgtactgatctttgacgtcgagctactggcgattgagtaagttctcacgttgaacaaaaagcgagtgaacgctgtgccttcactcgcttttttgtctcatatgctcacgctctgcctacctcaatgagcaaaggggtagaaaaccaatccttgctcggtcactagcatgcaatccatcccacccgcgtgcgctgcctgaagtcctaattgggtatcttcaaacaccaaacactgtttaggtgtcaagccgagttgctcacacgccatcagaaaggtttcggggtgcggtttgtgctgttgcacatcgctggccgtcacaactgcatcaaatttatccaacacctgcgcattacttaataaacgcagcgcgctatcacgttggctccccgtccctattgccattttcttcttaccctgccattggcagagtaattcataggtggcggggatcacttccgcttgcagccccatgctggcaaaccaatccattttgtaggctgcgacgcgatcgggatcgagcgccaagcctaattttttattgatgtgcgtcgtaatttttgcacttggcatcccacctaatccatagagccactgggcatcaaatgggaagtcaaaatgcttcgccgtcgcttcccaagcggctaaatgcgcaggcatggtatcaagcagggttccatccatatcaaatatgaatccttcataaaggctaaagttgacaacagtcacagcatctccaattttttgtaataaatttgtcattaatatttcatataaagctgaaagcgatgaacgacactagtattgatagtttcattattctcagtacactgctgcacgcattgcactcagacacctatctcgttgatgggatgtcaatggaataaaaataacaagtaggtaacaccatgaatattcgccataaactttatactttaggcattattgccatactgggctccatcgccattttctttacaacctcacagtttgcccagaccaacgatgaacttaatcgagctatcaatcaagtcgataaactggaagtcaggttactcaatttaagacgcaacgaaaaagactttttattgcgtagcgatgccaaatatctggatacctttcaaaaaaatactgacctgttcctcaatttacaaactgaactcgatgccatcatgctcaaatatgagctgggtgactccaacgctttacgtactgacctactggaatacaaacagggttttgaacagttggtgcgtgcctatcaaaccctcggccttaatccggaaagtggcttgtggaaaagctactatcaggcgctcgagcaagccaaacaacaagcttccgcagaagagctattagccctagtggatttccatcagcaggtattagcaggctccgccaactcaagcgcgttgaaccaattttctgacctgatcaaatccgctcaagccgtggtgaaccaagcaaaagtgatcggcttgaaatacaacgaaggcttactgggtgccacgcgttctcactctcacgatgtcgaagagatgtttaaagccttctctaaaaccctaactcaagcggttgatgataaacagaaaacaatgaccaccactaaactttcagtgaccatcgctgtggtgttgattattttgttagtgattttccaaatcagccgctcaatcaatttacaagtcagtcaattgttgctggttattcaacgaattgcgcaatctaacgacatttctctgcgcgccgagctcaaagggaatgatgaaatcaccgccgtggcgcgctatttcaatagcctgttggataaatttgagcatttgatcagcagttcacagaccaaatctcaccaattgtacagcagcacttcaagcatgcatgacgagcttgagcaagtgattgagcaatttaatgttcaatctgaacacatgggcttgatggcgacatcggtacaacagatggtatcgaccattagtgagatttcggaaagcactaacattgctgtcgatggcgttaatcaggcagcgcgcaatgcggaacaaggccgcagcgtggtggtgactacggtgaaaaacattgacttactctcctctaccctacagaaaagccaacactctatcggctcattgaatgcctttgttgaaaaaatcggtggtgcggtgagcatcattcaagggattgcagaacaaactaacctactcgccttaaacgccgcgattgaagccgcacgtgccggtgaacaaggacgcggttttgcggtggtcgccgatgaagtacgctcactcgcgactcgtacccatcaatcgacggaagagatcacccgcgttgtctccaatatccagtcacaaatgagtcaagtggtcgatgacattgatttgtgtaacaaccaaggtcaggaaacactaagcgcctctcgtcaacttgatgaaagcttgcagcagatcctgcgtgacatgcatacgattcaagataactcacagcgcatcgcggcagcgattgaagaacaaggcagtgtgatgaaccatgtcagtgagtcaattgctgagctgaacacgatttcagaaaacaatatgcgctccgcacagcaatgtcttactgaggtcgatacagtgtcacgccaagcccatgccatggatgaagcggttgcagagtttcgcaccaatcgtgactgagcttgactttcctgaactcacagaaaggctcttatgagcctttcttctttttctctgtgtgactgaggtgagcatacataaaaccgcgagccagctgcgatccagcttcttgatgaaacgttgtagcatgctctgctatccatagaacaagttttatccatctttgtcatgccatcatcgtaaaaacacccattcacagagcaaataaccaacaatctaaccaaaagacagatcaattcaaataaaatccgcctttaacaagaattaatcaccaatattaattgatacttttattgctttagatcatgcaaagtgcaagttgaactcgtgctacaaattaattttcagtaaattcctgacatacattttacagtttgaaataaacggacatttttggagattgctatgcttgagcttctgattggcttagtcgtgacctttgcggtcggctatttcatcgttaaaggctataagcctgcgggtatcctactcaccgcagggattttgctactcattttaaccggtatcttgggacacaaagtcctacctggacagatggaatcaaccggtaacctactcaccgatgcaatggagtatgtgaaatacatgctgcaaaaccgtggcggcggcttaggtatgcaaattatgttgctgtgtggttttgcgtcatacatgacgcacatcggtgccaacaacgtagtggtaaaacagttttctaaaccactctcttttattaaatcaccctacatcttgttggtcgcggcctatcttgttgcctgtttgatgtctctggccgtgagttcagccaccggccttggcgtgttattaatggcgaccttattcccaatgatgaccgcgatgggcatttctcgccctgcggcagtagcggtgtgtgcctctccggctgcgatcattctctctcctacctctggtgacgtggtcattgcggcagaaaaatccggtttgccattgcacgtattcgccgtagaaaccgtattgcctgtttcgatctgcgcgatcattgtgatggcggccgccgcgtatttctggaaccaataccttgataaaaaagataatacaccaatggagaaagtggatttgtcggaaatggaggttaaatcaccagcctattatgcagtcctgccattcttacccatcatcggtgtgtttgtgttcaatggtgaaacgctgcctggcattacgctggatatctataccatcgttgtactgtcaattttcattggcgtgctggtcgactacatcactaaacgtttcaacggtaagcaaacattggaagatcttgaagcctgttacgaaggcatggcggatgcctttaaaggcgtagtcatgttgttggttgcagcaggcgtatttgcacaaggtttgatgtcgattggtgcgattgacaacctactgcacttagcagaagtagcgggggctggcggtattgctctgatgttgattctgactggtttaaccgtcgccgctgcgattgccaccggctcaggcaacgcgcctttctatgcgtttgtggaattggctccgtcactggctgcgaaaatgggactcaaccccgcattcctgattattcctatgctgcaagcctccaaccttggccgtaccatttctccggtttctggtgtggtagtagctaccgcgggtatgggtaaaatcagcccattcgaagtggtaaagcgtacttctgtgcctgtgttactgggccttgttacggtgatcatcggtactatggtgctggtacctatgcacgcttaactgtccgtgttatgacggacattcaaaagggcgtgaaatcacgcccttttctttttgagtcgtataagcaactcgtaaaaacatgtccaattctggattattcacaagggggcgcgagatggattagcgccaatcctccgagcgaagtttcgcggtatttcttattcatatctttcccagtctgatacatggtttcaatcaccttatcgagtgaaatcaaacatttgctggtgcgcttgagcgccatgcgcgaagcattgatcgctttcactgcgcccatcgcgttacgctcaatacaaggcacttgcaccaaaccgcctatcgggtcgcaggtcatccctaatgagtgctccatagcaatttctgccgccatgcagatttgctcattactgccaccacgcaaagccgttaagcctgcggcggccatggaggaagaaacgcccacttcaccctgacacccaacttcagcacccgaaatcgatgcattggttttgtacaagataccgatcgcgccagacacggcgagaaaatccttaagctgcttggtatcgagcgctttgataaaacggtggtaatacatcaaaaccgcagggatcacgcccgcagctccattggtgggcgatgtcaccacttgtcctccagcggcattctcctcactcaccgcaaaagcaaagaggttaatccaatccatcacttccatcggatcattttcaatcgccgcattggcttcaagttttttcagcaaactcggcgcacggcgagtgacatttaatcccccttctaaaatgccttcggtcgcaaaaccacgctccatacactggctcatcactcgccagatttgatcggccttggcatcaatcaccgccatctcttgaaaagccagttcattgcgcaaaatcattccgcctaaactcaaaccatgtttttcagcttggtgcagcatttcatcggcactggtaaaggggtaagtcaccgtcacatcggcggtcgcggtaccattttgcaactgctcagcggtcgcaacaaagccaccaccgactgaataataggtttcaaaatcaatctgttgtccttgagtatcaaacgcgctcaacgtcataccattttcgtgcagcggcagattatcttgatgaaaaagaagatcctgatggtaatcgaaggcaatgtcatgctgaccattgagacgcaacttacccgtttgcaacgcttcacgtagagtctgattagcgtcaccaatcttgatggtggcaggttgattccccattaagcccagtaaggtcgcacgatcagtgtggtgccctttccccgttaaagacagcgagccatacagatccacttgtatgcgagcaactttattcagctgtggcaataactgctgcacaaaacggtaacctgcaatcatcggcccattggtatgcgagctggaagggccaaccccaattttgtaaatatcaaagattgagagcataactttccccttaagataaagcgttataaagccaatcaggtatgatggcacaaaccgcaattgtcacagccgcgaaaaccaacaaaccatactggctcatcgtcggcgttgcgaagagatgcttctgacgcgcaataaacgcttgctgttgaatagaattatcgccccagtatcggcttatcaccactccggataccaagaaaaacacggttcctataggagcaaaccaaggccaagcaatatccatgagtctagcgccaagcacggcggcgatactgattatgctgccggcgataactcctttctcattggcttgatttgaaaaaagaccaagaacaaatgagcctaggcggataccaacaaaaatcgaggttaaactcgcgatcgttttaagcactgactcattcgataccgcgagcaaagcaggtatcaccactaagcctgcggccaccaaactcattttacgagcgaccgcttgatagtgatggtcaggtgcatttcgtcgaataaagcgctgataaagatcaaacgtcgcaacggttgccatcgaattataggtagagtccagagtggacattgccgccgcagctagcgcagaaataattaaacctatcacccaagggtttgtatggtgaaacacaaaatcaagtatcacttcattactgtttgtaaaatgtcgctcttgataaaaaatgctcaataagacgccaagcaaagcgaaaaagaagtaaataaaaaaagcaccataaccgcacagtaacatcgacttttgtgccgttttttcacatctcgtggctaatgttctttggatgatcaattgattggtaccgtacacactcatgtgtaagaaactgacagccaccactcccgcccacaatgtggtgtcgacacccaaatcgaactgaagattgatgatattcagttgctcccgagatactccatgtaccccatcgacttgaaggaggagtagaacgaagattgccacactccctgcaattaatactgctgactgcaacatatccgtccagataacggtcgagataccaccagcataggtataacaagccgtaaataaagtgatgtaaacaatcgcttcaacaatagatatgggtaaaatctgaattaaaatcaatgcaatagcataaagaataactccagacgaaatacattgaaccaatatgaataccacggagttaatggttcgagcataaacaccaaagcggtgttctaagtattcataaatggacgtaaaacccattcgataaaaaacggggataaaaaatacaactgcgaaaaaaatgactatcggataattcaaatggatgtttaacgcttccatacccgattgataaacccatccaggcataccaataaaagtcatagcactgatgtatgtcgctaaaatagaaacgcctgcggtaaaccacccaaactgtcttccaccagttgaaaaatcagtattcccaatactcctctggttaacaaaccagctgattagtatggtcaatatgagataaatcgcgataacaataaaagttgaatacgtaaccattatgatttttcccgttctctatctcatcaattacacggctaaaaagcttctaatcgagcaataattccggccaaaaataccgaaattgagcaaacatagcgctcatcataagtgataatttccacatcatgaccaaaacaagccatttatgagacatcgatcaactaaacacacaaaatgggtacgcattcatttttaaattgattttgatcacggatcattatcgcgaaacaaatctattcttcttcgcgaagcaaaggttgaaaaagatggagaaaccgtctcaatcacactgttgaattatatttaaatcaatttaaaacagaggtttatcggtcatgaccaccaaaaaacacatgagcgaagttcctatgattcaaagagtagccgcctatctggcgatcttggttggttactttttctattgttataactttgtaattattgactacgtacgcccttacatcgttgaggcttatgagggcattagcctttcagatactgctcaattctatacatggcaatccgttggggcgctgattggcgcattaagttgcgcttggtttgctggccgctttggcaagaaatacaccttgatcacgattactgcactcaacggcggtgcaaccatagtgaacatgatgtttactgactacgcgacatgggcagcgatgcgtttcatcataggtttgtcactgggcggctactttaccgtcgctgtcagcttaatgattggcctctttaccccaacggttcgcggcaaactgaccgcatttgcctcatccatgttctctgtagctttaatggtaatgggggcatacgcggcctttatctctagcatagatgccccctgggaaagtttgatgtgggttggtggaattccgcctttagctgccgcatttgccatggtatttgtcttacctagcgataaaaacgtcatcgcttacggcgaagaagattcctcagctaatacagggcaaaacacacctgcgaaaaaaggctcttggggtgaaatgctcagcaaaccttatcggctccttaccatcacctgtttgcttctagctggccttaatttttacggttttcaattctttagcggtttcgtcaccacgtatttgaaagaagttcgtcagtttgatggtgcaacaatcggtgtgatcttctcaatctccgcttttggttctctatttggagcttgggtttggggcgcggtcgccgacaaatttggacgtaaagtgaatgcgtttggcttcattcttgcgggcatcatggcttctatctttttcatcgcaccgagcgatctgatgattggcagcctcaatatgctggcaatcttgggcttaatttataactttggcctctcgtcttcagcggtttggggtggctacttctcagaattattccctgctcatttgcgcagttatggtgctgcactcttccacggcgggcgaattattggaatgtgggcacctatggttctcatttttatcaaagagcgcaccgacttacagactgcaatgtggggctcaccgattgtgtggatagtggctggcttattatggctatcgcttccagaaacattaaaaggcggtttattcgataaacgtaagagcaaccaaccggctaacgcgtaaacctgattcaaggcgcggatgactctcatccgcccctttcatctcaatgagtcctgttccccatgctgactcaaacagcaaaaagagagttttactatgacaaaatatcaacaagcaaaacgcattgttcgtgaatactttgatgcaatcgaaaacgcatcctatgaaaatgttgctgaagttttaaaagcccataccaccgaaggttatttatggcgtggtgtttatccattccgtgaacagcaaggtgcacaagcggcggccgatattttttgggctccattaatgaaatccatgactcgaatgcagcgtcgtcaagatattttcattgcaggtaataacgaaattaatccagatgaaatttgggtaatgagcatgggccattttatggggctattcgatgctgaatacttaggcatgcgtccaactggcaaaatcatgaacattcgttatgccgagtttaactgtgtcgaaaatggcaagatcagcaaaacgggactgttcctcgatctattgggtgttatggatcaagcgggctgctatccgttaccgccatctacgggcaagcattttgtctatcctggcccacgccatcataatggactgctatttgaagatgcggctccagaagaaggtgtggctaccttagatcttgtgaatcaaatggttgcagacctttcagccctgaacgatagtggtgctatgggctgtcctccggaagtgcttgagaaaagctggtcaaaagacatgatttggtatggtccttgtgggattggggcttcgtacactatccctcgctaccaacaacaacaccaattacctttccgtaacaacttaaaagataagaagtttaacggccatgtctgccgatttgcagagggtaattttgcgtgcttctttggttggccaaacctttcgaatacgccgattggcggtttcttgggaatgccgggaggagagatccgcgccgatatgcaggttgttgatgtctactatcgcgacggtaataagctctctgagaactgggtattgattgacctcccttattggttaaaacagcaaggtttggatgtgtttgaacgcactcaaaagatcatgaatcctgccttgtaagctgcgatctggattcacactctctcgattaaatgaactctccctaagatctgggagagttcctctatatcacctcatggacgaggcgatcttcttactatggatatctcagagctgtttattttgggtataacccaaaataatgagcgaataaccgtttaccgctctaaattatgtgacgttgtgttaattgaattgatgactacgtaactatttatgctaggctgtagtcggttctaatgactgataaatcacgagttatgcattctgaaaaagccaccgtcacctccaaagatgttgccaagttagctggggtttctcaatctaccgtatcacgcgtttttgtaccgggtagctcggtatctgaaaaaacgaaacagaaagtctttgaagctgctaaagtccttaactatcggcctaatgcgtttgcacgcagtttaaccacaaatgagtccaaactgatcggcttggttttcccagatgcagattaccctatccatatgaaaacgttgcagttaatttctagcgaattgcaacaggtgggttattcggccgtactgatcccttggcaagtagatgaacaagataaccactccattccgaatattttccaatatcgagtggatggcgtgattgcagcttctgcaacattcaataaaactctttatgaagagtgtgaagaattcaatattcccattgtgcaatacgcgcgagtcgttgaaggcaccaaaagtagctatgtgatcagcgataactatgaagcaggtcgacaagcggctcagttattacatcaagcaggtgctcaatctgcagtttatttaacaggtgaagtacccacttttaccaatgatgaacgccaacaaggtttttgtagtgaattcaaatcactgaccggtttcaccccgcctgtggtgaaagcgacttatgactacaccggatcacttgataccatacgccgtctgattgctgactcgtctcgacccgcggccattttctgcgcaacagataaccttgcgatggccgtcatggacattgcaagattcgagttttcacttcggataccagacgacatacaagttattggttttgacaacattcctcaaacagaatggctcagttaccaactcaccacttttgcccaagattttaagcggctagctcgcgagtcggtcaaaattattgtggatcagattaccactaggaatcagagcttggtcaaattaatggtgccgaccaaattaatccaacgtaaaagtacactcaaatcctagacggttggggggaagacactcccccaaaaagtcagctcttgttgttgaggctaagcattagcataccgctctagataaagaatcgtggcagcggtgcgtgatggcacatcaagctttttcagtaagcttttcatgtgcactttgacggtagattcagaaataaacaggcggtcggcgatttgtcgattgcgataaccctttgccacttctgacataatttgcatttcacgttccgttaatgcttcaaaaggattactcgtatgctcgcgatttaaaaggtagcgttcgaccgactcactaaaggctttttcgccttgcatggcttgtttaagcagcgccaccagttgatccggctcagtgtctttgaggagatagccatcagcccccgctttgactaatgcttcaatatctgcggcgctgtctgaaaccgtgaggatcaccacatatgcgtcacactcatcggtgcgcagcgcagtcagcgtatccaatcccgacatccctttcatattgagatcgagcagaatcaagtccggttgtagatcatgcgccagagcgatcgcttcagccccactccccgcttcggcaaccacctcaaattcttcttcaaaactcaatagttgattgataccacggcgcatcagcgggtgatcatccactaaaaggactctacaactcattcttatttttctcctcgctttgttggtaagtcagcaccactttgcagcctttacccggagcggattcaacctttaattcaccacgtaaacgggcggcgcgttcttgcattatgctcataccatagtgattgatcttgtgatcttgcagatcgaagccaaccccatcatcttcaatcgtgacttggactcgtccctgctgctcttggcagttgaccttaattttagtggccttggcgtgctttatcgcgttaatcgttgcttcacgaatcaactgcaccaaatgcacttgctgatgagcatccagcgcaattgaggaaagcgcgttattgagttcaattttcgcatcggtttgccccgaaagttgagtcagcatacccagtagagattgaccaaaactgccttcggttaaggtcaggcggaaggtggtgagtagttcacgcaactgggtataagcatccgacagacctttgtctatctcgcgaatgatgttttccgtcttacttaaatcgccatccgactttaacggcgtgacggaacgtttcagcaaggttaactggatctttaaataagagagcgattgagcaagcgaatcatgcagttctcgcgctatggtggctcgctcttccattaacagcagttgctctgcttggcgctgcgcttgattgtagtaaatcgcgcgcgacaatatcagcgcaaagttatcaatcaaagcccgatctggctcaggcgaacccgcttcccaatacaaaaagccaagatgatgaccatctaaggtgagtggtgtttgcaacatcacggcaccgcttggctttccttcttgcaaaatcaatggcttgccagcttcctcttcaatttctaatcgaagagcacaaatcccttccaacgcgacccaatggcgcaaaatggtttggaagttactcgccgtgatccgtgaagccgtcaactcttgcgaagagtgatacaagacctgcagcgattgattggccatttgcagcttgttggttttctcattcactgcgtgctctagcccgcgataaagtttgccaagatcgcccgccatgctgttaaacgttcggctgaggatccccatttcagtgctgctggtctcctccagcatgacatcaaaatttcgatttttgatcttttcgctggcatcaaccatggcattgagcggccgcacgacctgctcccggatgtaatacaccacaaagagggataccgcaaaaatcccgcctaaaccaaaactgcctactgcagctaacgcaatcaatttacgctcagaaaagcgctgtaacttgagtacaaagccatccactaagctgacaaaaggcgcaacttggtcaagatattgcgctttttggtcactattaagcacttttttgagctcatgccagcgctcaatcagctggtagtaatcttgttgaatgtcactgggtaccgtccagtcgagcaaagcgagcatggagggtgagtacagtgagttttcaaacagaaaaatatgcgccttgtagtcatgggattgggtttggatgtcatacgccaaacgataactctgcatgcgcatagagccggagacgtttaccgcttctgcatcattcaaagaagacgccaaagtgacaatggcgaccccagtcgtcaatgccgagagaaacaaaatcaataacatggctttcgccatagtacgggttaatgaatgtcgtactggagtgaacaatgcagtctctctctgattgataaccaagcttccacctctttagggctacacactatccgaaacgggcaggttaatttattgatccaaaacaatccaccaccccaattacctcctaagaggtatttatacaaatatgtcaaaaactacaatttgtgtatgggaatatggcaggttgtgaacaggtgtggagaaaaacatggtcgacttaagtaaacgacgttggttcactccgaatcgtcagcccaaccaaagccaagttcggctgccttggttagcacgtccagacgcgtttaccgatgagtgtactcgctgcggcaagtgcgttactgcgtgtgagactcacattatcgaaaaaggcgatggcggctttcccacggtgaatttttcgatcgatgagtgcacgttttgttaccagtgcgcacagagctgtccggaacccctcttcgtggcgcaaagcgaagcgccatggcaagcaaaggtgcacattacccatcactgtttggctcaacagcaagtggagtgccgctcttgccaagatgcctgcccagaagaggcgattcattttgctttgcaaatcggccgcaccgcaagcccgcaggtcaacagcgaacagtgctccggttgcggagcttgcgtttcggtttgtcccagtaacgcaatgacggttcactacacccaacacatcgcttaaacggcgtggataaattggagagcaagatgtcacaaccctcagcttcactgcacgaagtacacatttccagcttggtggttcacaccttgccagagcatttgctcacagtgaaacagcaggtgagcgagctgcgtgatgtggaaatttacggcgaggatccgcaaggcaaactcgtcgttgtgattgaaaccgatcgtcaaggcttcatcaccgaaaccatagaacatattaataatcttcccaatgtgctcaacgcttttctggtgtttcatcagatagagacggtaacggaagaagaacaattacacactggaaataccttttctgaactcgagggtaatgtatgaaaatgaccagacgtgcgtttgtgaaagcaaacgcagccgcctcagctgcggcggttgcagggatcaccctccccgcatctgccaccaacttgatcgctagctccgatcaaaccgcaattcattgggacaaagcaccttgccgtttttgtggtacaggctgttctgtgctggtcggaacccaagatggtcgcgttgtcgccacacaaggtgatcctgaagctccagtaaacaaaggccttaactgcattaagggctacttcctctccaaaatcatgtacggtcaagatcgcttaaaaacgccgctgctgcgcatgaaagatggtcaataccacaaagacggtgaattcaccccagtctcttgggataccgcatttgatgtgatggctgaaaaatggaaagcttcgcttaaaaccaaaggcccaaccagcgtgggtatgttcggttctggccagtggacagtgatggaaggttacgcggcggtgaagctgatgaaagcgggctttcgttctaacaacattgaccccaacgcacgtcactgtatggcttctgcggtagtgggctttatgcgtacctttggtattgatgagcctatgggctgttatgacgactttgaacacgccgatgcgtttgtgctttggggttccaacatggcggaaatgcacccagtgctctggacgcgcattactgaccgtcgcctaagccatcctcatgtcaaagtgaatgtgctctcaacgtattaccaccgttcctttgagttggcggatcatggctacattttccacccacagtctgacttagcgattgccaacttcatcgccaactacatcattcaaaacgatgcggtgaactgggactttgtcaacaagcacacccatttcaaacaagcggtcacagacatcggttacggtctgcgtgacgatcaccctctacagaaaaaggcgaaaaacgccaactccggtgatgtcagcgatatttcgtttgaagagtacaaaaaatcggttgcgccttacacggttgaaaaagcgtctgaaatttccggagtatcaccggataaactgatcacgctcgcgaagcagtatgccgatccaaacaccaaagtgatgtcactctggaccatggggatgaaccaacatactcgcggtgtctggatgcaaagcttggtgtacaacctgcacttacttactggcaaaatcgccactccaggcaacagcccattctcactgaccggtcagccatcagcctgtggtacggcgcgtgaagtgggtacctttgcacaccgtctgccagccgacatggtggtggctaaccctaaacaccgtgcgattgccgaaaaagtgtggaaattgcctgaaggcacgattcctgagaaaccgggcttccatgcggtgcagcaagaccgcatgctcaaagacggcgtactgaactgttactgggtgcaatgtaataacaacatgcaagccggtccaaacatcaatgaagagcgtttaccgggctaccgcaaccctgaaaacttcattgtggtatcggatgcttacccaaccgtaacggcgcaagcggctgaccttgttttgccaaccgccatgtgggtagaaaaagaaggcgcgtacggcaacgccgagcgccgtacccaagtgtggtatcaacaagtgaagactgtcggtgaatctcactccgactcatggcaagtgattgagttttcaaaacgcttcaaagtcgaagacgtgtggccggaagaactgctggcaaaagcaccgcaataccgcggcaaaaccctgtatgacgtgctgttcaaaaacggtcaggtggacaagttcccactgagcgaagcacgtgaactcaacgatgatgcgcaccactttggtttctatatccaaaaaggtctgtttgaagagtatgccgagtttggccgcggccatggtcacgatttagcgccttacgatgtttaccaccaagtacgcggcctgcgttggccggttgtcgatggcaaagaaactaaatggcgctttaaagaaggctctgacccttatgccaaagccggttcaggttgggatttctacggcaaaccggatggcaaagcgtggatcatctcctcaccttatgaagcgccgccagaaatgcccaatgaagagtacgatttatggctctgtactggccgtgttcttgagcactggcacactggcactatgacccgtcgtgtccctgagctgtataaagcggtaccggatgcgctgtgctttatgcaccatgaagacgcgcaagcgcgcggtttacgccgtggcgatgaagtgctgatctccaactcgcgtggtgaagttcgagtgcgcgtagaaactcgcggtcgtaataagccgccaaaaggcttggtgttcgtgcctttctttgatgctcgcattttggtcaacaagttaatcctcgatgcgaccgacccactctcgaagcagactgacttcaagaagtgtccggttaagatcaccaaagtcgcgtaaccctgattgcactgggctgcccgtcagcccagaccaagtattaagccgcaaggcggagaatttacgatgaaaaaacaactcattgccttactttcagtgtttaccgtactggctggcattgctcatgctgagctgaacaatccaggcggtatcggaggtctagaatcactgcgcggagcaacagaaattgaagcgactcgcgccgctgatccaatgaagaaatacccacgcgaacaagcgctagagagtgattttgtgtatcaaccaccactcatcccgcacaacattcgcaactatgaagtatcgttgaacgccaacaagtgccttgcgtgccacagttggaaaaacgccaaagaaatgggcgccaccaagatcagtgtcactcactttgtgaaccgcgaagatgcggtactgtcggacgtctctccacgccgctacttctgtttgcagtgtcacgtccctcaggcggatgcaaaaccgctggttgagaacgatttcgaacgtgttgattcacttcgttaaccgaaaagaggccatttatgaaatttctaaaagcgttttggcttcgtctatcgagcccaagtaaagccgccgtgggtgtggttttgctgatgggttttgtcggcggcctattattttggggcgccttcaatacaggaatggaagcgaccaacagcgaagagttttgctcgggctgtcacgcgccgattgtggccgaaatccaagagacgattcactattcaaaccgttctggggttcgcgccatctgttctgactgccatgtcccccatgaatggacggataaaattgtgcgtaaagtgcaagcgtccaaggaattggtggcacactttatcggcacgattgatacgccagagaagttccaagcacgccgcgcacacttagctgaacgcgaatgggcacgcttgaaaaagaacgattcgttggaatgtcgaaactgtcaccagttcaactacatggatttctctgagcagagtagccgagcagcgaagcaacactcgaccgcactcgcctctggtgaaaaaacctgtgtggattgccataaaggcatcgcacacaatctccccgacatgcatggtgttgaaggctggcaataaggagagccactatgagtactcttgaatcgattttttggcacgtgctcggttacagcgccatgccagtcatcattctggccggtttccttggggttgccgtcgtctcaattggcttactcgccatgaccaaagacaaataggaatgcagagagagaaaatccggtgctatttgtaccggattttttatgcccattcggttgggctttccgctatcgagagctgatagtattgctggctattgcgcacaatcacatcaaacacttggctatctaaccgaccacaactcacttcgtgacgcataatattcatcacctcgttgagcgacatgctgccgcgatatggccttgcttgggtgagcgcctgaaacacatccgcaatcgcaatgatccgtgaaggcagatcaatcgccgccccttggagtcctcttgggtaacccgaaccatctaaacgctcatggtggtttcctgcccactcacacaccacagattggccaaacaccatttgcaaggtataacgagaatcggtcgaatggcgttgaatacaaagatactcgctctcattgagtttaccgggtttatgcaagatctcttctggggtgtgcagcttgccgatatcgtgaaccagtcctgtcaggtaaagggctttttgcatctccacgttcagccctagctctttcgctaagtgctgacagagctcagctactttttgcgaatgctgaaaagtgaactggcttttcgcatccaccacgtttgccattaacatcgcgatagacatgatctcttccacccccaacttctgctcaaaaaatggggtggatggcaaattgtgacccatcgcttcaatatgatgatgctccattgaaaaccagatgaactctttactcagcaaatgttgcatggtgcgtaccaagtcacgctcgaacaagcttccgctcaatcgaccaatttctaaacagacttgattacgagcttcctgagtcacattaccatactcatctcttggatagagctctttaaggtaatccaccctatccgctaaaaaaatcaacgccgcgaaccgtttgtttcgatccgaaatagcaatatttttcagctcatcccaaggcgtatggtggtacaaaatcgcatctgcaaacggcgcaagcggtggacaattcgacagcaactcattgcctcgcacgcaatgctgctgggtattgtcgggttgcatattttcgagtaaacgatagaaatcacgcttctgagccacgccacagtcatggatcaaacccagcgcaaacaccagttgacactcctcttcgctccactccatggcttgagcacaagaataggccatataaccgacacgatgcccgtgattgatatcatccacaccgaccgagtcaagcgctcttgcgatacaaaaaaatgcctgccttagattgacgttccattcgatatttaccgatttcatagtgcagcctatttctgaccatctcattgctcatcccataataagaatgtagtagaccaccccaatcttgcccaacgaaatgaccaactctgcctgtcagtgatgcttcgtgcgacaagtcgcagccatcgcacaataaaaatattacacttttgtgaatttgattttgctaggtgataaacatcatgattaccatcgcgctggtggatgaccacacgattgtacgttcgggcttcgctcaactactcaatcttgagcaagatattagggtgcaaggtgagtacgaaagtgcaaaagcggccttttatgccctcacccaagcggaagtcgatgtcgctatcatcgatatttcaatgccggatgaaaatggactgagtctgcttgagcgcttgcggcaacataacccgcgtttcaaagcgatcatcctcagtatttatgactcggcttcatttgtgaaaaaagccttggatgcaggagcgcaaggttatctttcaaaacgttgtggcccaagcgagctagtgagtgcgattcgtaccgtagcttctggcagacgctatttgtgcgccgatgccttggtcaatttgagtaatcccgatatcaataatgtgcttgccgaccttaccaagcgtgaagtagaagtgtttgatttattggtacaaggcaaagaggtgaaagagatcgcgcaaacgctgtttctcagccataaaaccgttcacgttcaccgagccaacattttgagcaaattaaacctaaccaataacgtggatgtgatccgctttgctttgcagcaccaactgctcgtggaaggttaacgatggccaagctgtttccactgatttttgcttttgtgctctacagtattagccaatttagtctatggaatgtcagccaatatttgagccacaatccgctccaagcctacttactttttcccacaggcttacgcttggcggtctatttgttagctcgcccaacctatgtttgggtttggttactgagtgacatgcttttggctggcgtgatcttggtgttgcttccagaccaatccagcccgttgatgctgctcatgccttgggtggtttggctagccgcagtcattgcccgccaacactggccgaaattacatttgtattggcaaaagttactgctgattgtggcactggtgctgctgcacactattttggtgggtatcacttttaccttgttggcgaaaccgctacacatgggggcggagacgttaattgccgtgagtatcgcttcgctcacgggaggcattgtgctgaccccatttttgtatctggtggccgactaccttagtcaccaaacttggcatccgctttctccacaactgattcaccacgatgtgaaacttaaaccgaaaatgttgatgtggagcttactgtttttcagcttaggactgctggcggagctgacgttacttgagcagatgaagccgtttgccctattgatcatcttgctcccgacgatttttcttgcctatcgttatggctggcaaggcggtgtattggcgagcagtttaaactgcattctgctagcgacggcacgccagttcagtggctccttttcttcggatcaagagctgctgatttttatgtcgagccaagcttttgtcgggcttggattgggtatcgccattagccgccagcatcagctcgctttattactgcaaaaaatgaacacccgcttagccaaagagctgcgtgaaaagcaagatctggcgcgccagctcgtttctgtggaagagcaaattcgcaaatccgttgcccgcgaactgcacgatgagattggccaaaacattaccgcgattcaaattcaatccatgctcgctgaacgtttagccagtaatgatcaagccaaacaagcggcttctagcgtgcagtcgctcgccatgcgcattcatcaatccacacgtcagctcttaaagcaactacgcccgcacattttggatgaactcgggttagaacatgccattcgtcagctggtgcaagaaatgcgttttgccgaacaaggtatgacagttcgcctcaatatgggggtcaatccgcaaaagctggacgataccacgcgagtcactctgtatcggattgtgcaggagttgctgaacaacatttgcaaacatgccaaagccacccgcgtacacatcagcctatttccgggaagtgaaatggttttggaagtcaaagacgatggcattggtttgcctaccgactggcgggtgcgtgggcacggcttaaaaggattgagtgagcgtgtatccgcactcggcggtcaattaaagatgacttcatccactttccaaactggcacgcgaataattgttaacttacccacaaaacgctcaataaccagcgaaaaactaggaaatattcctagatgaatacaactccttcccatgtttttcccacctcgcttgattaggatgaaactcaataaggacaagcaatatgaagattgtacctatggtgcaacccattcaggcaatggaaatcgatcaggcttatcgccactggcgcattcatttaatgatttccatgtatgtcggttatggcgtgttctatctcacacgtaaaagcttcaattttgcgatgccgcaaatgctcagtgagttaggactcgattactccgatttgggttttctcagtacgctgttctacctcacttacggggtgtctaaatttgtttctggtttgatgatcgaccgctcccgctcgccctatttcatggggttgggattgatggccaccggcatcatcaacatcgcttttggttttagttcgtccttgttggcttttaccttgttatggacggcgaatgctttttttcaaggctggggctggcctgcgtgtgccaaggtgctcacccactggtattcacgtagcgaacggggcttttggtggtcaatttggaatacttgccacaacttaagtggcgcattgatccccatcgtgattggttttatcagcttaacctttggctggcgttacggattcttgtttgccggcggagttgcgattttcgttgggctttggctctgttatcgcatccaagagaagccaagcgaaatggggttgccttcggtcggcgaatggcgcggtgatgcccttgaactggaacacgaaaaagaaggccaaggtctcgccttccgcgttgcggtttatcgctatgtactgactaatcgctacatttggctgttgtgtggatcttacttgctggtgtacgtggtcagaattggcattaacgactggggatcgctttatctggttgagcggcacgcatacaacattctcagtgccaatagcgcagtagccatgtttgaagtgggcggatttttgggctcgttgcttggtggctggggttccgactattactttcgcggcaaccgtgccccgatgaatttgatttttgcgttaggcatttttgcctccgttgcggccttatggctgacacctatcgatcatttatggtttttggctggctgcttcttctgtatcggattttttgtcttcggcccgcaaatgatgattggtatggctgccgcagaatgcgcaaggaaagatttggcaggcaccgcgaccgggttcgttggcttatttagctatctcggtgcagctttagccagctaccccatgtcactggctattgaagcatggggctgggaaggcttcttctgcctaattactgcggcagcagccgtgatcagtttacaactgctgccctttataaaagctcagcaaccggtgacggaagatgagtgataaacataaccaatctttaccatccaataacgtaactgtgctccactttatgacctgacgcagtaccgacctgacaaggacacaagggagcatcaacaagagggaaaacccaatgattgttaatgcaaaacgcacgctgctggcactcagtgttcttggttcgatgatgactgcgccgctggttcatgcggaaggccgtttggtggtttactgcagtgcaaccaatgcgatgtgtgaagccggaaccaaagcgttcgctgaaaaatacaatgtgaacacctcctttgtacgcaacggttcaggcagtacactcgcaaaaattgatgcagagaaaaacaacccacgcgcggatgtttggtacggcggcacgcttgacccacaatcacaagcgggtgaaatggacttactccaagcttaccaatccccagaactggccaacatcatggaaggtttccgtgatccagccaaacgcaaaggtaactactcttctgcggtatacatgggcattttgggctttggtgtgaacaccgaacgcttggcacaaaaaggcattccgataccgcgttgctgggcggatttgaccaaaccagaatataaaggcgaaattcaaatctctgacccgcaaagttctggcacagcttataccgcactcgcaaccttcatccagctctgggatgaacccaccgcatttgagtatttcaaaaagctcgacaaaaacgtctctcaatacaccaaatctggggtaacgccctcacgcaactcggcgcgaggtgaagtagcgattggtattggattcctgcacgactactcactggagcaagccaaaggtgcaccactggaactcatttctccttgtgaaggtacaggttatgagttaggtggcgtaagcattattaaaggtgcacgcaacctcgataatgccaagctatttgttgactgggtactctcaaaagaaggccaagaagtggcatggaaacaaggtgattcctaccaaatcttgaccaacacccaagcggaacagtcgccgaacgcgctcgatccgaaaacactcaaactgatcaattacgatatggaaacctacggctcttctgatgagcgtaagcgtttgatcaccaagtgggttaacgaaatcaaaatgggtaactaacccgaaatcgtagtcgcaccgccactcggtggcggtatttctcccctgacacttagcctgctcacagcttgcgggcaggttaagtgcgactcaataataaggtttgaccatgcatgagccttctcaagcgctgaaactgacactccaccagccagtcaaaaccgatccggttttttactggctggctgcggtgctgtttagctttattcttctgccatcctttgctctggattatgggctatttgaatccactccagatgaattttatgccgccatgggttggagtgaaccaaacatttcttggttctggtttagtttgcctttattgctcgcctttcgacctcggcaagctcagggacgtcagtccacaaaccgccactatctcgatattgcctactctagcttctgtatgctggccattttgctcagcgcttggctaagcggtaaaggattgggttattccagcatcattctgttcactgcccttggcgctattatgacgctggccttcgcccgcttggaatacctcggtggcgaccattttgtcattggctcactgatcagcatcattctgctgattgtgatttttattgtttatccgagcatcgccattttcctgccgatgtttaaagatgacatgggcaactggactgcatggcagttcatgacgatcctgtcccagtctcatacccttaccgtcatttacaactcgattgcactaggtattgcggtaggcgttggcgccaccttcttcggactgatttttgccatttacaccacacgtattgccaaacgctccgcctttatcgcacgtgtattttccattttaccgatcgtcacaccgccctttattgtcgggttgggcgtgactttaatgctgggtcgctcgggttatatcactgagttgatggtcgatgggtttggtttacagaaaaccaactggctgtacggcttcacgggcatttggctcgcgcaagtgctggcgtttgcgcctatgtccttcatgattttggatggcgcactcaagtcactgcatccttcgttggaagaagcttcctacacgctcaaagccaaccgttatcaaaccttcttcggcattatcatgccactgcttaagcccgcgttagccaactcatttttgatcatattcgtgcaatcattggcagatttcagtaaccccttggtactgggcggcagttttgatgtgctcgcaacacaaatctatttctatattgcaggggcacaactggattacgcttcagccagtacactcggctcggttctgctgctgttctcacttgcgatttttgtggtgcagtatctgtggatcggccagcgctcctacgtcaccatttctggtaaagcctaccgcggcgatgtacaagagatgccagcctcactgaaattgggcgtcactgtgactttgtatgcgtggatgatctttaacgttctgctctacggcagcatcttcttcggcagctttacggtgaactggggcgtcgattacaccctgaccttcaaaaactacctcaatctgtttgggaatggcatgtctgatggtgcttggccttcactcatcaccaccatgatttatgcaggtgtggcggctccgattactgccctgttcggcttattgattgcttatgtggtggtgagacagcagttctacggcaaaaaagtgatcgagttttccaccatgctctgctttgccgtacccggtacagtggcaggggtttcctacatcttggcgtttaacgatgcgccgatttatttaactggcaccgcagcaattgtggtgatctcgatggtgatgcgaaacgtgcctgtggggatccgctctggtattgcaggactcgggcagctcgataaatcattggatgaagcgtcactgagcttacgtgccagctcattacaaaccattcgctacattattttgccactgctgcgccccgcgattctttctacgctggtgtacagttttgtgcgggcgatgaccacggtcagtgcgatcatctttctggttacaccggaaacccgcgttgcaacgtcctacattctgaaccgagtagaagatggtgagtacggcatcgctatcgcctacggttccgtgctgattgtcgtgatgttagccatcattttgttgttcgatttactggtcggtgaagctcgcgtttctcgttccaaagccaccaatcaagattcttaggagacatcaccgtggaaaaacaaaactttgttgtactcaaaaacatctgtaaacgctttggtagcaataccgtgattggcaacttggatcttgagatcaaaaaaggcagtttggttacgttacttggcccttctggttgcggtaaaactaccgttttacgtttggtggctggcttagaaaaaccgaccagcgggcagattttcatcgatggtgaagatgtcaccgaacgctccatccaacaacgcgatatctgtatggtgtttcagtcttacgcactgttcccgcacatgtctctgtacgaaaacgtggcttatggcttaaagatgctcaagttaccgagtgaagaagtgcgtcagcgagttgatgaagcacttaaaattgttgatctcgaaggaatgggtgaacgctatgttgaccagatttccggaggtcagcagcaacgtgttgcccttgctcgtgctttggtgctcaaacctaaggtactgctatttgatgagccgttgagtaacttagatgccaacttgcgccgcagcatgcgtgaaaccattcgcgaactgcagcagcgttttgatattacctcgctctacgtgacgcacgatcaggcagaagctttcgcggtatcagataccgttatcgtgatgaaacagggcgacatcatgcaaatcggcacgccacaagagttgtataaagcacctaagtcgatgtttatggcaaactttatgggtgaggccaacatgttccaaggccattttgacgggcagcagatccacattaatggctatgcaattgatgccgatcttgaagtgacgcgggataagcctaacggcgaatatcaaattggtgtccggccagaagcgatcaccttacatacgcaaggcagcgaaagccaagcctgccaaatcctcaaatcggcgtatatgggttcaatgtatgaagtgaccgtaaaatggcacgatcaagaactgctgttacagctcaattccgcgcagtttaatcacacgttaactcagcacgcgtatgtagtctttaaccctcgcggcctatttttgctgccctacgcagaatagtgataataccctgagtaaagccctctttctcgatatttaaattcaagtacagtaagaataacgccaccctgaggtggcgttacttttaagcttcttggatgggtaatacctgttttacatactcacccggtgcactgtacaacaccggatagtcggcattacctaatggataaggttcaactttgctgccatctgcaaagccgtttaaccattcattccaatgcacccaccatgacccttctcggtgctgagccgtttccagccaatcttccgccgaatcatccaaggtatcgttaacccagtaaccatacttacgtttgtcaggatggttaacgattcccgcaatatgcccagattcacccagcacaaaggttttgttcccccccgtacgcaatgcgccgcggtaagtaccttgccacagagcaatgtgatcttccttggtggaaatgaaataactcggcactttgattttatctaaatcaatccagacaccaccgactttcacgcccttatcctgaaccaacttgttttcaagatagagctctcgtaacaagaagttatgacaagcacctgccacgttagtgctatcgctattccagtacagaagatcaaaatcaaccggactctgccctttcaggtagttgtccacgtagtaattccagtacaggctattttcacgcagcaaactgaacgtgacgctgagtgagcggccatccatatagcctttggcattattttgcagctcaatggctcgaataatggtgtcgttgatgtaggctcccacttctcccggttgagagaaatccagcaaggtggtgaaaaagctcgcggttttgatgcgttttttcatgcgtttggccgcgtagtaagcgatggttgtcgctaatactgttccaccaatgcagtaacctgccgcgttgatctgctcttgcccggtgatcgattcaatcgcattcaccgctttaacaacgccttcgagcacatagtcttcaaaattgagttgggcttgcgctgctcccggattgcgccatgagatcataaacacagagtgaccttgctcgactagccagcgcaccatggagtttttctcacgcaaatcgagaatgtagtacttgttgataaaaggcggaacaatcaacagtggcgtcacggccacttgctcagtcagaggtttgtattgaataagctcaaacacctcatttttgaacaccacttcacccggcgtgttggccacatcttcaccaaggcggaaagcattattgttggtcatgcggattttgagaatatcggcactggacgcgacatcctctttcagttgctcaagacccgcaatcaagttttcaccatttttctctaaggttagacgcagcaactctgggttcgtcgcaataaaattgctcggagaaagcgcattgatcatctgacgtgagaagaacaaaatccgctctttggctttttcatcaagaccttcgatagcattgatcgtgtcaagataagtcttactgaacagcagataggattgtttgatgaagttgaagaaaggatcttgctgccacgcttcatggctaaaacgcttatcccctttttcggcttccatgatggattgaattttcgactcaagcaccactttttgccaaatctggagttgctgctcccaccattgggtttgcactttcagcagagctgcaggttgattcgcggcttgctcaaagaacttgagcgagtcttccagattcacttcttgcatcgctttattgagtggggaattcacggcggctttgctctgttcgacctctttccaccaacgctgattcacttgttgtaattggacaaggtagtccgtaaaggcatgttggaacatacacttactccttaaaacagaaaaaagcgccgcccgtaggcggcgcgaaatacagtgttacgcaggggtcactgtcttaaggttttcagaggcaagtttttctacatcatctttaaactctttcgcgatgttttgcagttttttgctgtcatccatcatttgctgagagagtttattcagcacgcctaactgctgtgagttaaatgcagttaaagaggttacatccttgatttcactggcagctttcatctgcgccagacctaactcgctataagtgcggatggcattgagttgtagctctgtcagcacttcaacattcttggtcaccaacttgttgaacttgatatacggttcgaagttcttctcagtttgatcgctgaatgttttaaaaaattccgtgtacatacgttatctcctagtgaatgaatctaaagttaaactgttttaatcacgatcgcggtacccatgccaccgccgacgcagagtgaagcaacgccataatgtttttggcgacgctgtaattcatgaagcagagtaaccagaatgcggttacccgatgcccctaatggatgccctaacgcaatggcaccgccattgacgttggctttttctaaaatcgcctcaggttgaatcgcgtgttgctcagctaaaccgtaaacgacacctaatgcttgagcggcaaacgcttcgttaagttcaaacagatcaacctgagtgatagataattctgctttcgctaatgcttgagtgactgcactcacaggccctaagcccatgactttcggatccaaccctgtttgtgcataactcataatttctgcgataggggttaagcctagtttttttaccgcactttcactggcgataatcaccgcactggcaccatcgttaattccagaagcattacctgcggtaaccgtaccttgtgcatcgaacgcggcgcgtaagccttgcaatgctgccaacgtggtcgtcggtttagggtattcatccgtatcaaacacgacggtttcacggcgttttttgaccgaaataggcacaatttctcgcttaaaatgtccggcttcaatggccgctgtcgctttcatttggctggccaacgcaaactcatcttgtgtttgacgagcgatgtcgtactgtttagcgatattttctgccgtcacacccatgtggtattgattgaagacatcggtcagaccgtcatggatgagcagatctttcacttcaaacgcgcccattttctgcccatctcgtaagctggcaggcgtaacaaatgggatttgtgacatgacctcaacaccagcggcaacaacgacagaagcatctcccgctttgatgtgcgcaaccgcatccatcaccgatttcatcccactgccacacaccatgttgatgctgtaagctggaaccgactgtggaacaccagccgctaaagccgcttgacgcccaacacccatgccttgtccggcactcacaacgttaccaacaatcacttcatccacagcttcaggtttgagttgtgcggcttcaagagcggcttggatgacttgccctgccaaagcgcctgctgaacactctttaagtgaaccaccaaaggctccgatagctgagcgctttgcgcccacgatatagatcttttccatacttcctcctacttagcgcatgtataagccgccgttcaccgacaaggtttcccctgtgatataggcggcggcatcgctggctaagtaactgacggcattggctatctcttccggcttagccaagcgtttcatgggtacttgatccacaatggattgcaaaacttcagcgcgcatttgctcaaccattggcgtcagcgtatagccaggtgcaatcacgttaaccgtcacaccgtatcgtgcgccttctgcagctaatgctttagaaaaaccaatcatcccagctttggctgccgaatagttagtttgaccaaactgacctttgagaccattaaccgaggagatattgatgattcgaccaaaccctttttcacacatagcggcaaacaaaggctgggtgacattgaatacgctattgaggttagtatctatgacctctttccatgcttgatggggcatttttttgaacacactgtcacgcgtgatacctgcgttgttgaccaccacatcaatggtgccttcttcttcaagcagtttggctaaacgctcagcacactcttcggtattggtgacgtctagctctaagaggcgcacttgatcctcggtaaattgtttttcattaaaccaatctaacgcacattggtaattgcccgtgtagtaagtggcaatgactcgataaccttcactgaccaactgggttgaaattgcagaaccaatcccgcctttcgatcctgtgatcaaagcgatttttctcattcaagactccattctcaacagcaatattagatttatacctctccaactctgacactcagtgtggtttgaattggcgaaggtatattacgctcaacatgaaataaaaaatgcttattcgtaagtagttctataaccaaattatttattaaataatcagttagataggttattcgaattacttatcctatttaaacctaatcgaggtttatgacatttcaaattcagttttgtgtatttttataaaagttgatcaatatcgctattcaaatgaaatgataataaaatgttaaataaataaatgttcttgaaagataagaggttttaactcaaaaattcagagtgaaataaaaataaatcaattttatcagcgagttaaaatcaaaaatggttacataagaaacattaaacgtaacacattttcgatgtgttaatgatagataacacagattcgaacagtagcgatttagtctctgattacagacgtactattaacaggactgacattaacaattttatatcaggatagcgttattattatcagcaattaaaccaacaaatattgaattaacaaatataactatagatacatttagcaaaataatagatttaatatcttcaaatacaaataaagccagtacaaactggctttattctattttatatgagcaatttatggtgctgcatccaactcaacagggagatagtgcttcgattccaaacctaaccattcaggtaacacagtaccaatcgaaatcgatgaccaagtccctgaaattatgccgataaacatggcgatggcgaaaccttgtaacggggcaccgcccatcagccaaagtgccgaaatggtcatcaaagtggtacctgatgtcaccattgtacgtgagaaggtcgcaataatggcttggtcattaatatctgcggttggcgtctgctgcttcgctaacagtaattctcggatacgatccgaaataatgatcgagtcgttcaatgaatagccgagcaccgctaagactgcagcaaataccgtcaagttgaattccatttgcgttatcgcaaagaaacccagtaccaagatcacgtcgtgcagtagggctaatagggctccgctcgctaaacgccattcaaaacgaaagctcaagtaagccagtattgagagcagacaaatcaacaaagcgagtccgccttgatcgatcaactcttgcccaacttgcgatcccaccatgctgttactgacaatttgcacttggtctgagatgtgatgcagctctgtcgcaatgtctacaggcgtagcatcttcagcagctaatggataacggatcacccaacgcccttcttctcccgaaggcgtggcagaaaccgactcccccagtaccggctgtaattgatccatcagctgagacttggtcaccgagtgattaatgatcgcttccgtgaccatcccgccggtgaaatctaagcccatattcaagcctttgattgcaaaagcccctagcgagatcaccatcaacaagaccgaaataatgccagtgatgtagcgaatcggacggattcgagattttaaatagtcaaccatggcttataccctcacatcacgacgcgtatcgcgtccccaaaccaaattaatcaatgctcgtgaagcgaatacgccactgaacatactggtgagtaggcctaaacccaaagtcaaagcaaagccttggataggaccattaccgatagaatacagaataactgccgtgatcatggtggtgatgttggcgtctaaaatcgtgctgaaagcactgtcaaacccggtatcaatggcttgtgcgaagttacgcccttcactgagtttgtcgcgaatacgttcaaagatcagcacgttagtatccaccgccatacccacggttaacaccaaacctgcaatacctggtagggtcaatactgcccctggcaataaagcaatcagacccaacaaacaagccatgttgaccaacaaagcgacatttgccacccaacccaagcggcgataccaaagcgccatgaaagtcagcgtcattgccataccaagcgccaaagcagcaaaaccgttggcaatattttcttcacccaaagaagcaccgatggtgcgctcttcaacaatggtgacaggtgccgtcagcgagcctgcacgcaacagtagggcgagctgctgtgcttcttccattgaacctgcgcccgtaatacgaaattggctccccaactgagattgaatggtggcaacgctgatcactttctcactgcgaacggtttcgccacgcgcattggttttatattcgcgatagacggtcgccatcggtttgccaatgtgtttaccggaaaaatcactcatgattttgccgcctgcgtgatccagtgaaatgttcacctcagacatacccatgttgtccacacccgcacgggcattgacgatatgctcgccactcagcactggacgcttagccagaatcacaggacgtccattgccatcttctaggattaaatcgtcgtaactgcgcgcatccgttggagattttgcttcataaaacgctaaacttgcggtcgcaccaatcacattcttcgcctgtgaggggtcttgcacaccgggcagctcgatacggatcgcatgttcaccttggcgttgaaccagagcttctgtaatcccaagttcttcaatccgatctcgcatgattttcaagttctgttgaatcgtcgcagtttgaaactctgatttattttgttgtgatggctgaacttgcaactgatctgagccttgacgaatctcccagcctcgataattttcttgcaagtatttgcgtacatggctcaaggcttgcggctgttcagttttgacctcaaaagcatcattacccatcgcttgcaccacaacaccgcgcaaacgctctgcacgcagcgaatcttttactgcatccatcatactgtcgcgctgttcttgaaaggccttatcgacatccacattcagcagaaactgtacgcccccgcgtaaatccaagcctaatttgatgggtgaaaaacccaaattgcctagccactttggcgcaacagacacataagaatacgtgatcgtatccccttctttcacaagcgcatccagtgcatttctggcttgtgattgctgcgtttcgttggcaaaaaccaaggtggtgttatccccttgttgggtaatttcatcggcctgaatattttgcttattgagcaattgcgtcagctcaggaacgttgcgtaatacactcgttgcatctttagattgcaactgaatagaaggttgttcgccataccaagtaggaatagcacttaaggttagaatgatgatggtggttaccagaaccacatacttccaagcggaatagtggttgatcaggcgtttcgccgcctgattttgtgtttttttcttcatagttccctctcagcctaaactgagtgattcaaaaagtgacaatgtcacactaaaaaatgaatgtgggaacgttagaattggctgttgagcgctacatacatagcgttactctctttccaacccgcaagtcggtgagaggaggtgaaaaagtcgtaacttcggttgcagtagtcggtcgttgtagcaaaaagcggccgactgtgagaagtgcctaattggggctcatcaaaatcagcgtccaacggcagatcagagccacaccctacgagaagacgttgtgtcggggcgtgacgcgaatgatttaaaatggcataagcactatgactaacgtgcgactgcgaactcggtatggcaggctgcggagctgaactcaaaagccaatcggattcaaggatcggatttgtcgaaatgctggcttctggacatgcggagcttgcttcactttccagcgcataagcaaaaatctgcgaaggtagcaccaccgcaagtaaagcaaaccaacactggatcagaacacgcaagtacatgacttcagatctcgcctcttagataagtgagcagtgtaggccgatgctcagtgaagctcaagcgaaaaaatgtgatctagcgatagaaaatttggccagtttgcacgttcaggtagatcttatgtgtctggctcaaacctccgcagtagataaaatacaccggctgctctccgaaagtgactgagcgcacccagcctccgagctcttcaaaatctttgggcgagcaatttccctcttttaataaggtatcggttgtagtcaggaatttttcttgatgcaaaagaaaatcatccgagctttcgatgtagcctgttaaggttttagttcgctcttctggcgtaatcacaggcggttcgacggtcaatccttctaagggtatccactctgccacttcaggccccccttcctcatacacgtaataatccgaaatacgcccccatcccccttttttttcaagcaaatgaaccttgtcaccacgatagagttgcttatcaacatccggataagcattgggatcgggttgctcacgaatgcttaatgtcaccgcatcgacataaaaatccataatctcaggtttggcttcgatagcgggagttggctctgcaggagtctcaggcgcagtttcaggtacttcattggctttagccgcttccgcatccatctgcggtttgagataaaacagataaaatcccgcacctgctccacctaatccgagtatcagcacgagtagcatgagtatttttttcattttcccccgctcgtaaaatttctctagcgcaacgtcattgatatgaaaatgcgacgaatcttactttcttatcaatatagcgggatatttgaacaaagcttgaccagaaatcttctgataaaaagattttttgaagtaaaggcacacttcatgctgcggttatggaagatcatccgtcaccgagtcgcccaatcgccccccaaatgaatgcgagatttacaatgtaaatggggcagacatcatcggactgcctcttttaatcggatcctctgctgaaaagttgagcatggttcgtttgttaacaaacacaaactatgatcgagtgcacgaagtaaaattctggaagcgaaatctcatttgattcgttctatagtatgcactcaacgacttatacatcgaattatgtacacctcagcccgtaaatatttcatacaatttgccattgttgcgtttgtacttggtttcattcctacactgtatttcatacatgctgctagccagcttgagactcaagcggtcagcagcgttgaaaaacagactcgcttacagcttgagttcagtcagcatgacttgttacgaatgctggaaagcacacaccaagccacccagctgttagctaaaaatgaccttttattcacggctgtcaccacaccaagcaaagaagcactcagtcaactcaaaacattgtgggatgtgacgttaagatcgcaagcgattttctcttcattcagattgctggatagacaaggaaaagaacaacttaaagcgatttacgatgggcaccaagtcacctttgttgaatctgctcaaacgacagatccgttcagccagcaaattgtggctcaatacgcccaactcacgacgcctcaagtttgggcaacgcaagtcgcgatgtcagcagatacgccttctggtatgctgccgacctttcgttttgtgacgggtattgagcatcaaggccaacggcaaggttttcttgtcgtgacggtgaagctacagtctctctatcaacgtctctcttttatttatgatcagtttgattcaccggatattttgaattcggcaggagaattactgctcagtgaacacaagccatccggtacacgttcaacctcttcactccacttttcagcccaacacccagagctttggcaaaaaatccaactcaaccaacaaggctttgctctatccaatcaaacctggtttagctatatcaaagtggatctcagttctgtcttacctgactttaaacctttggtattggtactgcgcatcaataaggcagaaatagataagacctacgcaaatgcgcgctgggcactgatgagtcaagcggtgacagtgttatcgctactctctatcattgcggctggatttgcggcatggaacatcaaccatttaaaaaatagccttgacagtaaattggctcgagcagcgatggatggcatgtcagcggtggtcattaccgaccgccagaatcgcatcatcaaagtaaacaacgaatttacccgcctaagtggttacacttttgaagatgtcaaaggtaagcagccgtccatttttgcttctggattacacaaagtcgaattctatatgcagatgtggaaagctctgcaagacaatggcgtatgggaaggtgaagtgatcaacaaacgcaaagatggcgaaagcatcaccgaaattctccgtattcaaagcatccgcgatgaagacaatgtcattcaattctacgttgcctcttttgtggatatttcacatcgcaaggcgctggagaatcgcctgcgtgagctgagcgaaaaagatgcgttaaccgatttgtggaatcgacgtaaattcgatcaaaccatctctttagagtgcgctaagcgtcgccgttatcccgatcaagcccagagctgccttgctatcattgatatcgaccactttaaacgcattaacgacaaattcggacacaacgaaggggacctagtgttacggaccgttgcgaaaggcatccaagatcagttacgggaatcggattttatcgcacggattggcggagaagagtttgccattattttcccctacacttccattgaagaagccgaacaagtacttaaccgcgtacgcctgcatatcgcttcattacaccatcaacaagtgaccctaagtggtggtgttaccgatgtttgcacatcacccgaccaaagctacaaaagagccgatctggctttatatgaatccaaaacatcgggacgcaaccaaatatcagtactcaccgccatggaaatgcatcactttgcgtgatgcaaaatcgatgtatgcagcaaagattattaggagatacctcacagcttgtagcgattttcactcagccttatcgagtgtgcgcctaagccctccgctaacttttgcgtcttgtactacgcttcataggttggttttactacaaacacacctaaactcattggtgttgcaggtaggcggcaagtgaataaattctcgtgtacgtagacaaactatgtgactggggtgaatgaatattgccaacaccactgcaacttcaaggaggaaggagttagtcacagatcgattcatggagacgctttatgcaggacactttagctgtgattctcgcaggaggaatgggctcacgcctttccccgctgacggatgacagagccaagcccgctgtaccttttggtggaaaatatcggattatcgatttcaccttaaccaattgcctgcattctggattacgccgcatcttggtgttaactcaatacaaatcgcactccttacataaacatcttcgtaatggctggtccatattcaatcccgagcttggtgaattcatcaccgtggtgccgccgcaaatgcgtaagggaggaaaatggtacgaaggaaccgccgatgcgctgtttcacaatatgtggctacttgcgcgtagtgatgccaaatacgtcgtggtgctttctggtgatcacatctatcgcatggattatgctgccatgctcgaagaacacatcagcaaaaatgccactttaaccattgcctgtatgcaagtgcctcgacatgaagcctctgcgtttggcgtgatggcgattgatgacgactctcgtattacctgctttgttgaaaagcccgcggatcccccttgtatccccaacagacccgatcacagtttagcctcgatggggatttatattttcaatatggatgtactgaaaaaagcattaaccgaagatgctgaaattgagcaatccagccacgactttgggaaagacgtcattcctaaattgatcgcgacaggcagtgtctttgcctactcgttctgctctggtaaaggccgcgtcgctcgggattgctattggcgagatgtcggaaccatagactctttctatgatgccaatatggatttgttgcagcccgttccgcccatgaatttgtatcaaaaaaactgggcaatccgcacttatgagcagcagtacccgccagcaagaaccgtttcatcggccacgggtaacgaagggatttttatcaattcaatcattgctaacggcgtcatcaactcgggcggctcggtgcaacattcgatcatctcttccaatgttcgcatcaatgattctgcgctgatcgtcgacagtattttgtttgatgatgttgaagtgggcgaagggtgtaagctcattcattgcattatcgataaacacgtaaaaattccgccctataccgaaattggccttaatcctatcgaggatagaaaacgctttcatatctcagagcgaggcgttgttgtcgtaccagaaagttatcagttttcgaccgagtagctttcccggaaagtggggtctatacccaaacaacttggagttgcaggtaggcggcaagtgagtgaatccccatgagcatagatacactatgtgattggggtgaacgaacgtagccaacaccgctgcaacttcaagtaggaagggtatataccgtttaatatattaggccgttcatggctcatctatcgcaaaccatacactctttagtgactgaataagaagaacccccgcaatgcgggggttcttgatgacctgattcgaacagttacgcctgagggcaagtcacttctttccagaaccagttagattgtgtcggtgattcccatacgccggggttattttgagctacaaagcatttaccgttgtaagtcaccgttgtgccattttgaacttgggtcgaaccgggaacccactggatgacatcacccgttgagccaccacccgtaccaccaccagtgttaccgccggtattacctcccgtattgccacctgcagtcaaatcggcgacagggagatccggttgctcaaagctaaacgcgtactccacattgttgattttcactgtgtagttcgctggacctgaaatcggcaggtagtaaaccatatccaattcataggttgccccagcaggaagtgatttccaagcgggtagagagaacgccacgcgatgcatcgtaccgtctaacccgccaatgttattggcacgggtatgacctgatgcaatcactttcaagccgccacccgattgatccttcgcgttatctggcgctgaaacaggaatatcgaattggaactccgttcctcccgggatatcaatccctgtattgttggtgaaggtaatcttcggattgattgggtagttttggtcaccgactttgaagccaccgactttcaccgcaatattcaccgcttcagcagggattgcgcccgttgccaccttgttaccataaggcgtggcgactttgaacttgtcgtagatggctttggtcatggtattgcccatgtggtactcacctttaccggtggcacacgcttgctcagaagggtccactgaggtgcgcttgccgttggcatcaaggttgtaacagctatagtcacccgccaactcccagaacatgataccgccaacctctttgtcgataacgtaatcggctttcacatcaattgactgtttatcttcggtcgacaagaacactttcttctctgcgttccacaaccaaggagccacggccacactgtcataattgcgtacataagtaccaatcagcggtgtggtggttggatcgagcttataagccgctgcgtatgaaccccaaatgcctttttctaggttcttcgcatgccacattgggttagagcctgcgcccatttcgtcacctgcagcgttaacgtcatgccacatgttgtcgataccggttgcaccgtgaccacagttgtttttctccccttcaccagtacccggtgcacagagattttggttcggcagtgccgctcggccccagagtccattctcaccaccggtgacaccttgccaaccgcgggtatagtaaggcacaccaatgttgatacgacctgcaggcattgagccacggaagtagtgatatgcccagtccgtattcaggtaaccgataccaccgtattgcgctgtaccgtaaacgttccactgcgccaattcagagtctttacctgtatcgtagagcgcggcgttgtgaccaacgtgatcgttccacgcaccatgcaagtcgtaagacatgatattgacgtagtcgagatacttggtgacatcgaatgtttccataccacgtaataagtaaccagaagatggtgcggcaatcgtcagcatgtagtgatggccatcttgcgccgaggcttgatcgagtttttcacgcagaacacgcatcaactcttggtaagaagcccacaggtaagcacgacgtggctccataaaacctttatcatcgggatttcctgcgcccgccatggaggttgggtattcgtaatcgatatccacaccatcaaatttgtacttacggatcatctcaactgcagatgccgcaaatttttcaatcgctgcgtggttgatggaaccatcagcattggtggtcatagtgtagaagccaccatcagccacacggttaccatttgcatcaaagtgaccgccggtttcggcccatccgccgatagagatcagggtttttacaccgtatttttgtttgtaagtggctagagcaccaaagtgacctttaaaacctagcgttggatcgatttctacccctggccactctttaccaacggccgcgttatttggatcgttgacatcaccgacattcactttgccatccgaaccaatgctgacaaacgcatagttaatgtgtgtcagttgctcccaaggaatgtctttaaccaagtaagcggcttgcggatcatcgcctgaacgccagctggtaaagtaaccaatcacacggcgtggatgatccacgcccattttctcacggccatctgcatcgtaaacggtacagtatggcacttgtacgccttccgtttgatacaaaccatccggacggcaattcgcaaccggtgcgacgccattcaccaccagcgtggtcagtgcagaatctgtggctgcccctaagttgtcggtagcacgcgcgtaaaccgctagtgaacctgctttggttgccgtgtaattgagagtgtaaggtgcttttgctgaagtgccgacaagcgcaccaccaacatagaaatcgactttctctactgagccatctgcatccgccgcttctgcgctcaacgttacgaccgtcccaacatccacgcttgatgcagagagagccaccgccacggttggcgcttgattcgctggaccagcgtcactcaccgtcagagtgactgcatttttggtgctgacagcccctttatcatcaaaggcaaccgcactaaattcatgcgttcctttggtcgctgtccagctcgcgctgtacggggctttggttgcctgaccaaccaatacgccatccactgagaactcaacacgcgcgacagaaccatctgcatcagaggcgtttgctgcgagtgtcatgacctctccggctttcacctgcgcagtggcaagcggtgcggttaacgtcacactcggtgcttggttagtcccccccgatgtgctgcatgaatccaacagtttccattgggcatagttaccagaaaaggtttcaggatcgttgttttgagtccagtagttggcttggtaagcattgcccttgtgctgcactttggcaccaccggtatacaccgcagacgattgccattcaggtaacgtcgagcaatccaccgcagcatagctgctaaaagccattaaacatgaagcggttaaagtgcttagtgtaaaaacactcttccctgcttttccttcgagtacacgcattgttgttcttccctcaagttattatttcaaccattaaataaaccacgtcgacatcggctcacttaaaatcttgcgtaaaacaactttagaatagagggataatttggcactcaaaaaagtgtgaattttaataatgactcgcaaacgagtgtctgatttatgcaaatcaaagcgagttattttgcatcaacaacgaattactcataaatttttcaccataaaaaaagccccgtttttcagaacaaaatacggggttcaacaatttttgtgtgacaatttttcctaagagggagcacaagcctacaactatgcttattgttacaaaagagtaaaacatcaataattttacttcctcttttgttaacccttgcgatacccaaacaacttggagttacaggtaggcagcaagtgagtgactccccatgagcataggcaaactatgtgattggggtgaacgaacgtagccaacaccgcggcaacttcaagtaggaaggggatatgaaatgcccatttcctcgcacaatacacaaaatttcctcgcaaaatgacctattgtgttttgcagatgcgtaatagcattcagcctataaacttgtgggctaacggcagcttgggctgctcgtttttccgattcacggctactccaaaaaccatactaatgaggtgagcagatgcagtttagttacgtcaacccaaccatgatccattttggacaggggcagatcgccagcatccgtcgggatattccaaaagatcacaaagtgttagtgctgtatggtggtggttccattaaacgtaatggcgtttatgaccaagtggttgaggcactaagtgaacatcaatgggttgaattttccggtgttgagcctaacccaaccaaggaaacactggataaagcggtgcacatagtgaaaaaccaacacattgactttattcttgccgtcggcggtggctcggtcatcgatggctcaaagtacgtggccgccgcagcattttatgaaggcgatggttgggatattttgaccgggcaacacaccgtaaaacaagccacaccgatcggcgcgattttgactctgcccgctaccggctctgaatccaatactggtgcggtcatcaccaaagcggaaacacaagataaattggcgtttctctctcccgccgttcagccacgttttgccgtgcttgaccctgatgtgatgaagagcttgccagaacgccagttggtgaatggtttagtcgatgcttgggtgcatgtgtgtgaacagtatttgacactccccactcaagccatggtgcaagaaggctatgccgaagtgctgctacgcaacctgttagccttaggcgcagattttgtaaatcgagacaatgacgcatggcgagctaacctcatgtggacagccaaccaagcgctaaatggcttaattggcactggagtaccgcaagactgggcaacgcatatgatcggtcatgagctcactgcgttatggcatgtcgaccacgctcgttcgctagcgattgtgcaaccttggctgctacgcaatcaactgaagcataaaaaagccaaactcgaacagatgggcaaaaatgtctttggtttaccgcaatccgatgatttagcggaaaaaaccattgcggccattgaagctttttaccaccaactgaatgtggcgacccaatttggtgaacacggcatggcaaaagaggctgccgtcgatgcggtattgcagcaactgacagcccacggtatgcataaactgggtgaacaaggcacgattgacttacaagagtcacgcaagatcttagaaaacgccttgtattaaatctgagccaagcagcgctattcgctaaacgataaatcctgttacactcttgcagcacgtcaatccaatgcggatggcgtgctgcattttttgagtttcgtttatggtcgttttgcggatgttattgcggatgttattgcggatagagttatgtggctgttgattattgctctttgtgttgttcaattaatcacgattgatcgcggtccacgttggatgttctatctctcgaagcccaccccgatcctgctgatggccttgtcgattgtgatcacccctaacccattatccgattttgcgtggtggatcgtggcaggccttttgctctcagcgcttggcgacatattactgatgcatccaaaggataaatttgtctctggtttgctggcttttctgctggcccacatcgcttatacgctcggttttagcaccaccatcaccacctttacttggtggccgctcgccatttggtcagcactgggcgtcatcgcttttttactgctactgcccaaccttggcaaaatgacttttccagttgcgggctacattgccgttatcgtattcatggcgtgcaccgccacagagtactggctaggttataacaacaatgcctcacgccttgctctcatgggggcggcgatgtttatgctttccgatttggtgctagccattgaccgatttcgctcttcatcgcagttttcacgacatgtggtgatgtttagttactacagcgcgcaggctttactaaccttgtccgtcatcccctaacctcgggctttaaacgcatctttctctaaaccatgctttttcattctcagatagagctttttacgcggcacttgtaggtagttcgcggcatcggctactcggccagaaaacagaaacagcgcatcttcaatcacttgcttttcgtaatcgtccaccagctcatccaatggcgacagcatctcttcttgattgtagagacgctctttgcccgccagttttacaatgccaatcgcatacaactccgccacattacgcagctcgcgcacattccccggccattggtgggcgcgcaacaaggcaagataatgcggctcaacattgggcatgggtttgccgagcttatagcagctctgttttaggaagtagtgaaacagcgccgcaatgtcatcgggtctttgacgcaacaaaggcacatcgatctgcccttgattgagcaaatagtaaagctctggcaaaagctggttttgagcaattaactgctcgggtggctgatcaatcaccgcaatcactcgcgttctggggcgattgagtcgctcttggttgagtaaactctgtaccacattgcgctgcacttcctcgctgagcaactcaatatggtcaatcaacaaggttccacccgcactctcttgcactttaggttcaacggtactccactcggttttggccgaagcgactaactcaacccagggcaagtgaccgttattggtggtcagttgatggataaggtaggcgatggtgtgccgcccacagcccgactcccccactatcaccacatggcgattcagcagcgcatattgcgccacatgagagcgaatttgctccatttgtgctgattttccgactaattcacgtttgactgaacgggataacagcagcttttgctcgatgaacgagcgacgcagctcaagatgttgcttgatcagcgtgagcaattgcggaggattgatcggtttttcgagaaaatcacacgcgcccattttgaccgcttccaccgccatcgggatatcaccgtgtcctgtgatcacgatgaccggaattttgtcgtctacggctttgatctgcttgagcaattccatgccatgcagttgaggcatgtacatatccagcagcacgacgccattccaatcgggttggatgtggctcatggcttgagtaggatcgatcaccgctttggcggttaatccggcaatcgacatcaaatgtaggtaggaatccaacacatcctgatcgtcatcaatcagcagtacggtacttttcatcttgctgtaactccaaaataaccattgcacctttttccaaattagaggccagtgcaatccggccttgcatcttttccactaatgactggcaaatgctcagcccaagccccaagcccacctctttggtggtggtaaatggggtaaataatttatcaacgacttcgtgttcaaaaccctgcccactatcaatcaccgcaatccgctgcatcccttgctctgtgcctaacgcaatcagcttgacccaaggttgcgcgaaggttgttgaagcatcacagccattcacaatcagattgattaagacctgctctaaactcaatgcatccgccattaccatgagatcatcgggtaaggtattgataagtttgatctgctgtcgtttcgctttggtttgcaccaataccaatgcttgttctacaacgctgttgagccgcacgggctgcaacgattcatcgctgctgtttttgcgggcgaaatggcgcagactgttcacaatcttacccattcgctcagtgagattttcgatatggtcgagcgatgttgccagttgagcctgtggtgcctcctctaatgccaatcgagctgaaaacagataagccgacatcgcactcaacggctgattcaactcatgggcaagactggtcatggtctgcccaacgaccgccattttcgccgcttggatcagctcgccttgtgttttcttcaagtgcgcttcagcgcgctggcgctcttcgacctccgcttgtaactcacggtttttctcgcgcagtgattgggttttctctttgactcgttgctctaacaagcgattggcgtgttcttggtcggtcacatcggtgatggtgacaatgattttatcgtgcaagccttggctgtagcggcgcaaatagaggcgcaagtaatgaggcttttctggattaccgagtgataaggttaaactctccgcccctttctgaattaaattccctttcttatcaaataattgaccgactttaggttgtacgtgtttagcaaaacagctccatagcgtcaagggttgcgcgagagattctaaacgcagcgtggccatcgcactcgggttggcggattcaatttgcccataccgatcacaggtgatcagactcgcttgcgtgttattgatgagactcaacgcgttagtgcgttccatctcttccacttttttgccatacaagatgagctgttcactcaatgccccgatctcgtctttaccatccacggtgatcgggtgagaaagatcgttatgaataatcgcatccaagctttcacttaagcggtgtaagcgtccgacaatccgtttatgcacaaagtaatacatcagcaacaagctcaaaccgatggagagcccaaagcagatcagcagcactcggttaccttcttgcaccaattgagccgtttgtcctttgacttgtacaaacagcgcatccgcattcgccaccaaatctgcgattgccgtatgctgttgatcgagctgaatttgcagttgttcactcgtgctctctaacttttgggtcagcaccaccctatcacgcaggctttgctgaaaatcgccctctaaacgcagcacattacgccactcttcaagcagttgttgataggcaatcgacgatggctgagtaaatagcggttggcttaatcggctcaattcatcaagtcgatactgcaaaacgcgcatgccgttatccacttgggtgagatgcttggctttcagtagttcatccacaaacaaaaaggcttgggtttcaccatctaagatagtttgaataagattaatggtctgaaacatcacttgggcttgtggctgggctgcgccacctcgctctaattgccactgcagctcttggcgcatcggcgacagctccatcccaatatcttgatgcagccaatccaactgctccgcaaacagagctaaacgtcggtcgacatcaatccgagccgaaaccagatcgttaatctgttgcgtggtttgccgcaactctgtgtacccttgttgcagcgccgcttgctgttcattttgtggcaaactcgccaacgctgcgtggatcgcggtgaaatcctcttgcaaacgctgatattgctggttgagtgtcactttgctggttgcactgacgatcagttgaattcgtctgcgaatctctgaactgcgggtttccaatacatagctggtgttgtacttgggtacgctttgattgagcagttccgccacttgataatccagtcggctccatgtaccccaagccactaagctcacgatagtcaaaagcgaagtgctgaacgcaaatgccagcaacagtcttgcgcctatggtgtggcgagtggtcaaactcattgcgcttcctcagccagcaagattttcaattcttggttagcttgctcaagctgtttttccaaacgcatttgccattcatgccccttttctgcaagcagcatggcagattccgcttgctgctcttcactcagcgccgagtttggcgcgatttgtatggctaaagcatcaacctcttgctcggaaatcggcatggtaaaaaccgtgcgttcaatctgctcaattttagccaatacagaaggacgacgtgcaaactgcgccttcgcttcaagtaccgcaagtagcgtatcttttagttgcggcagttgcttggtgatggccaaatcgaataaatcgttcaggcactcttcgcggcgaataatgctgcccatgggcaaacgggtgaatcgctcgttgactagagactgatcttgcacgctgtgtttggcaaaatcgttgccttccatgttagtttgtacagcgctggacatcagaagttcgataaatgctttagcgtactgatcgttgtgattttgccgaatttgggcaacatacgtcggcatcaaggtaaaactttcatcgtaaacaaactgtacgtagtcgagtttacgaccaaggatcagggcatagctgtcaatggtcgggcccaccgcaaactgaccattggcgatatagtcactcacgccaaaacttctggccgatgccgtcgccaaattggcaccgacgcgcagcaagatctcccatcctttttgccagccatatttggccagtatgctttccaccatcatctgcgtggtgccagagcgtgctggtgtactcatggtgacatgcccaaaatagaccggtttcgccagatcgctaaattgcttcggctcaggcaattgatgcgttttgagatagtcttgattccacactaatcccgcccctgaataaccgatcgtcgccacatgttcggtcatcggcagtgcgtaaggtttcaaccattctggggtctgcatcggctctggtaaggcggccaacttaccgctctgtgccaaattctgcatcaaatatggcgatgaactcagcaccaaatcaatattctgaatatagcttttgttgagcagctgcacgctcgactgcgcgcggcggtgaatgatctgcacttcaatgccttgataacggcgactgaactcctccaccaaaggcagtaagggctcacgtgaaaatgtagtgaggatcaccaactctctctcggcagcctgagcttgagtggatacgcccaaactcagtaagaggcagggcataataaaggcaaaaatccatcgcggcattaggcaaatccctagtttttgtgcgttcactcaaatctctgtcatttgttgaaaaaaagtcgtccacgcatttgggtcaactctgaccttttctgtcattaattttatcagcaattgcttatccactgagggcaaaattcccagttttgactcacagctaacgcgcatttgggtcatttctgtcccaaaaaggtgtttttgagccacaactggctttggctaatgatgcctcccgacaaacagctcgtttgaaatcgtgaactagggagagctcttatgcttaatttctttaaaacccgccccgatctgcctttactcagcagctcaaaagcggaaatgttaaaacgctacaaaagctatcaatggcaagtctttattggcctgattttcggttatgccatgttctacgtggtacgtatggcgctcggcgtagtgaaaaaaccgatgctggatgctggcatcgtcaccctcgaagaactcggcatcatgggttcggccttcttctttacttatgcctttggtaagttcctgaacggctttctatctgactacgccaacattggccgctttatgtcgttctcgctgctgctgtcgggcgttgcttcgatcttcatggggatgaacacggtcgcgttcttcttcgttctgctgtggggcttgaacggttggttccagtcggtcggttctgcaccatcttgcgtctctatctaccaatggttctctccaaagcaacgtggtagccgttactccatctggggcggctcacgtaacatcggtgaaggtatcacttggatcctaaccgcaagcttggtgagctactttggctggcgtgcaggtttcatcggtgcgggtatcgcgggtgtcgtggcttctctcatcatgtttaagctactgaaagaccgcccacaaacttatggtatgcctgatccaggcacagcgtttgaggaaggcacggaaatcaaaaaagccaacgatccaaaagaaacacgccgtgcgcaaatgttcatcctgaagcaacctgtggtatggcttatcgctctggcttgtgcggcgatgtacatctctcgctacgccatgtcttcttgggcagtgctgttcctgcaagagcaaaaaggctactcactgattgacgctggttttgccatgtccatgtacccaactgcgggtctggctggtgcgattctgtcaggtatcttgtctgacaaagtgttcaaaggtaaccgtaacatccctaacctgctgtacggattgaccaacatcgctggtatgtgtctgatgttcttcggcccagataaccgtatcgttgatgctgtagcactgagcatgatcggcttctcgatcggtggtctagtcgtgttccttgccggccttatcgcttgtgacctaatgccgaaaaacgcagtcggcgccgtgaaaggcctgatcggtctctgttcttacatcgctgcttctgctcaagaacttatctctgcatcactgatcacagtgactgaagtcgaaggcgtaaaacattacgacttcggtaacgctcagtacttctggttggctgctggggtggtttcagtactactcgccctaaccgtgtggaatgccaagaaagtcgtcgatatcgacgaagcagaaggcaagccgttgaaaacccaaaccgcttcttaatcgatacccgtcctacttggcgctgtagtgccaagtaggacgacgatgccagaaggagcctagctcctgcttactttctcttttttattttcttgttgagcgtcgttataggaattacaacatgtgtaaaaccaaaattgtggccactttaggccctgctagccaaactcgtgaaactttgactcaactcatccaagctggcgtgaacgtggttcgcttgaacttttctcacggcagcgctgaagaacacattgctcgcgcggaaatggtgcgtgagatcgcgcagcagctcaatgtgagcgttggcgtactggttgatctacaaggccctaaaattcgtatcgcttgctttgcagaaggcgcgattcaactctctgcaggcgacacatttattcttgatggccatttagatggtcaagccggtacgcaagagcgcgtgggtttagactacccagaactaattgatgatctaaacgtaggcaacatcctgctcctcgatgatggccgcattcaactggaagtcacggccgtcgatatgcaagctcgccttgttcacaccatcgcactcaatagtggcaaactgtccaaccgtaaaggcattaacttgcttggcggcggtctttccgctccggctctcacagaaaaagacaagctcgacattattactgcggcggagctgcaagccgacttcttagccgtctctttcccacgcaatgcggaagatattgaatacgcgcgccaactcgccactcaagcaggctgccatgcgcacattgtcgccaaagttgagcgcgcagaagtggtagccagtgaagaagcgatggacagcgttattcgcgcgtctgatgtgatcatggtggcgcggggtgatttgggcgtggaaattggtgatgctcgtttgccaagcgtacaaaaagcgctgatcgcgcgtgctaagcacttaggtaaacctgtcatcaccgccacgcaaatgatggaatcgatgatcgaaaacccactgccgacacgcgcagaagtcttggatgtcgcgaatgcggtgattgatggtactgatgcgatcatgctttctgcggaatcggccgcgggacgctaccctgtggaaacagtgcaagccatggtgcgcatcgcccaaggggttgagcacgaaactcactgtgcgcaaaattgttgggatgcgctacaacatctgtgcagcgatgcgggcaaaagctttgctctgtcatcgatgatttcagcatccaaagtcaataaagatctcggtgttgcgattgtgactgagcaaggtgaaacgccgcttttgatgtcacgctgtcaaagccaagccaccatttgggcggtgtctgataaacctgcgctactgcgtaagcttgctattttgcgtggtgtcacaccgacctatttcccacatttagataagcaaggtgatattgcgactcagctgattcatttgctgcgtaaacccgcacaagagaaaaaaatcgcctcgattttggtcactcaactggaatcggtcgaaggggttggtcacgtcaacgtgtgccgactactgaatttggcgcagcaggaagccctgttcgcctaacccaataagtaacgcggaaagtagggtttcgcgttacttatatcccccaaaactttgtaattatactctcccaaatgctacacatagggatttggcctgcgcttgtcgcaggtcttttttattctttactcagcaaatccaatgcattacgcaaagcctgcttggcattttctaccgcatcaaccagaggcgtttgttgatatgcagcggcaggcgaatcggctttctcgatttgctggcacagttggtagagttgcgttagccacaatgcgccagcagaacctttcaatttatgagcttggcttttgatctgtgcatcgttatcacgctctgcctcacacagagcgaaaaactcagcacacccttgttcaaaatagccaacaatctcacgcattttctccacaccaaggatctgcacatcctgctcaaatttggcgtgatccattaccgcgacccattctttgcgcacagcttgcgcttcaggcgaaggctcgccctgcggttggccattatcgaagatgctgcttgtatcatggctctctgctttatcgcgcatatcggcatcatctccgctcttcgccgttaactgttgacgcaacatggcggctaattgttctttgaccagcggtttaggcagatagccatcaaatcctgctgctaaatatccggcgacttcttcattaaacacgtgggcagaaacggcaataaatgggatcaccgcattgtgaatactgtcttccatttgtcgcaggtcgcgcagcagatccaccccattgccatcgggcagatgaatatcaagcagagcaatatcaaagcgttgctgctgaaagcagagtttcgcctcttgcacacttttcgcgagagtcacttgatgacccagactggttaaaaaaccttgcgcaaccaaacagttgacttcgttatcttcgaccagcagcacgttagccacaggcacatcatctacggctagggcgggcgtttcaactggctctcccactggtagcggcaaggtaaaccaaaaacagctgccttgaccgagctgcgaagcgagttgtaactcgccccccatcgcctgcaccaacttacggctgatcgctaaacctaaacctgtccctccaagcttgcgccgtccggcgtcagcttgggtaaaggcatcaaacaaggtcgcttgctcttcctcagcaatcccaatacccgaatcttctactgcaaagcgaatgccttgcccatcgggggcgaggcggatacgaatacgcacttcgccctggtcagtaaacttgatcccgttgccaaccaaattattgagtacttgcccgatacgaatctcatccccttgccagtattgggtgacatcctcatcaatgtggtaagtgagggtgatgcctttttctcgcgcccggctttgcatcagctcatgggtttcactcactaatcgatacaaatcaaaatgagtgtgatggatttccagatgccccgcttcgattttggagtaatcgagcacgtcgttcaggatcgccagcagcgaccgtccgctgcggttaatcacttgtacatagtgctgctgagtggaagtcagcgtggtatcttgcagtagacgcgccgtacctaacaccccattcatcggggtgcgaatttcatggctcatggtggccaagaaggcagatttggcacggctggcctgctccgcttgctggcgcgctttggcgtggttcagcacctcttgattgagcttatggttcatctcgctcaattgacatgtacgctgttcaaccaactcttccaaatgttctttgtgctgttgcaactcgcgtttggctaatacttcactctctgccaccactttgagcgctttggcggtatcgcgcgcatgggcaatcgcctgccccatctgacccagttcatcatttccttgagttgaaacgtcgacgtcgagctgcccttttgccaccgagagcagcgcggcggtgtgttgatcgagacgctggatgaccgagcgataaacgaccttccacacgatccacaccacaatcacaaggccgagtaaccccagcacggtgaggatcaattgcgcgtcatagagggtgttagagagtttactcaccgctgcggtggtcacttgatttgacgcatccaccagctgattgaccgtgttattgagcttggcaaattgggtcaaggtatcgtgcagtaattgctgcgcggcttgttcattgctgtagcgctgtttcaatagttcgaatacgattcggcgcttctccaaccctcgcagcaagctaaccatttgtttggagcgcgtcgggtcttccaccgcctgcacacggcgctgcataatgctcaagttggcagcaaattcgctatctaacgccaaaatccgctctaaatcagtcacggtttgcgtctcttcaatctcattgagcactttaaacgccaacagatgcagctcatgtaagcgttccgctaaatccaaatcgacttccaccagattgtctaacgcctgataaacctgcgcttgctgctgcttttgcaataaatcgtagatgtgcgtgacattggcgattgcaatcgtgctggtgttgagcacttgggtacgggttagctgctccagctcttgtgccaatttgcgcatctctttgacgcttgtactcaattggctctccaacgtgagtcggtgctcaacgcgccttcctaattgcgcgagagtatcaatcacgttctgtacgtcttgctctaacctatccagcaacacgctatcaaacgcctcttctcccagttgctggatatgagtgagcaacgtttctaattgcgagaaaaccttctgcccagcggcttggtgttcttgctcatttttggcgtttgaaagagtctgtacagaagcaatgatttgatgactgagctcagcaacttggcgcgcctcgatcatcgaaggaatggcattattgaccacatcacgttcagttttggcaaccagagaaaaacctagaacgccgatcagcgccgagagaagcacgagcaacgccatcgcgctaaaagaaaataagagcttgcgaccaatactggctttggcgagacgcatggggaaaaccttcttgttgacttcttctgcgtggcggattgggctatattgtgcagtgtttactccggttcgccaacgaataacctcatgccaaatctgcgtttgcactcattttcactgatttctgcacttttgctgctctctgcactgccagcggctgcggcggaaaaactctgtgcgctttaccctcatcttaaagattcttactggctgtcggtcaactacggcatggtggaggaagcacgcaagctcaacctcaacttgcgcgttatggaggcgggtggctacccgaatcaccacaaacagcagcaacaaattgccctgtgcgtacgctggggagctgacgccattttgcttggcaccgtatcacccgagctgtaccaagatgatttagcccactacacccgctccgttcctgtgtttgctacggtgaatcagttgcggttgaatgagcaacagcaagagcacctaaaaggcgaagtcggcgttgattggtattggatgggattttacgcaggggaatatttagcgcgtaaacaccccaaaggcagcggtgaaattaagattgtggtgctacccggccccgcttcgagtggcgggacaaagcccgttttacaagggctggaagaggcgattagtcacagtgatgtgcgtattacggaaatcttgtgggcggacaacgataaagagctgcaacgcaatttgatacagcaagccttagagcaaccagacgtgcgttatttggttggcagtgcggtagcaattgaagcggcgatcagcgaattgcgttcactcaacaaaagtgaccaaatcggccttatcgcaacctatttgagtcatggcgtttatcgcggattactgcgtgggcgcgtagagtttgccccaaccgatcaaatggtcgaacaaggtcggctttccgtacgccaagccgccgcgtttttacgcaacaaaccgtacgcgatacaacaagcacctaagattgaagcgttaaccccccagcacctagagagaaagatcattgcagattcgttatctccgtccgaatacaggcccgtatttcaagtaaaagcggttgaataaactcgaaaatttggttatcaaacctctcatccaaaatcattaggaaatgtacccatgaaaaaaaccacccgcactatggcagcgcacaaacacgttgctcttgtggctcacgataactgcaaaggtgaactgctgcgctgggtaacagagaacaaggaaaaactgcaacgccatttcctgtatgccactggcaccacggggcatatgctcagtaaagaaacgggactggcgatcaaaagtatgatcagcggcccaatgggcggtgatcagcaactgggcgcgttaatttctgaaggcaaaattgatgtgctgattttcttttgggatccacttaatgccgttccgcatgatccggatgtgaaagcgctgctgcgtatcgccagtgtgtggaatattcccgtcgccaccaaccgcgccagtgctaaattcttgttttcttcttctttgatggagcaggaagtgcaaattgaaattccggattaccaagcttatctcgctgaacgcacctaacatttggcctaatcgcaaccatggctatgtcttgagatagccatggttataaagcctgaggtaaagcattaaccggcaagcaactgctgagaagtgatcaactgacaccctgccgtttgcatcgcgtgccacgctgtcgcgcaatcgcccgcattcagttccacacctcgacacgcatcctgaatgacccaagttttaaagtagagggaaactgcatccagcgcggtatatttcacacagtagtcggtcgccaaacctgcaatgtaaacctctgaaattccctgattactcaagtattcggccaatccggtagcatggaaacgttggttatcaaaaaaaccactgtagctgtccacatcaagatgggtgcctttggtgacaatgtgcgtaattcgctgcacatctaacccagctataaattctgcaccatgggtattttgcacgcagtgatcaggccacatcacttgtggaatgccattaaggtcaatgacttcgcccggagttttcccctgcacggacgcaaaactcgcgtgtttggctgggtgccaatctttggtggcaatcacatgttcaaagagcggaagcaattgattaatcacagggacgaccgcatcgccatccggcacaggcagcgcaccgctgggtgaaaaatcattttggacatcaactaacagaagtgctttgctcatcgcctcgtttcctttatcgggagtggggtatgtatatttaatggaccttattggtttttacccaaactacttagcgttgcagctttaagtaggaagggtataggccgccactttacaaaactcattgcagagtgaaaaggaaatcttcccatttctccatacccaaatgacttggcgctgcgacttgagcttgggcacagattagcgatttcatcgctatcttaacgccgattaacactgccgatgtttccgttaagagtatataatcacgcgcttatttccactgactaactgagttctccacatgaaacactctcgtactggcttcagtcgcattatttacgccactggatattcgatgaaaggctttgccgctgcatggaaaaatgaagccgcgtttcgtcaggaagttaccttagcactccctttgatcgcgttgagtttttttctgcccgtaagcacgattgaacaggtgttaatggtgggcagtttagtgttgatcttgattgcggaattactcaactcagcgattgaagctgtggtggatcgcattggtgcagaacgtcacgaattgagcgggcgagctaaagatattggctctgctgcggtttttgtttcgctctgttttgccgcgtttacttggacgtggatcctactgtaaatattccctcatgttgatttaaaggtttgctcaagcaaaccttttttattgcgctacgctgactgagttcaattctgaacctcctctaactattctcttaagtattctcttaagtattcattaagcttgaatcggtaggatgagatcaatgcataacgtaaaggagcgcattatgtcactactcaaaatttctcgtctgttcgctattacttctcttggcttagtttctgcggcagcattcgctgacccgacttgtacaatagaacccgaaagcagttggattccttttgaacaagctcagcaacaagtggaagatatgggctataagattaaagtgttcaaaatcaccaaaaccagttgctatgaattgtatggtcacgaccaagagggtaaacgagtcgaaatctatttcaacccaaccaatatggagaaagtaaaagaggaaaaagatggctaaaccatacacatgggatctttttgttcgagtaacgcattggttggttgccgcccttttcttggctaatttttttgcaattgaagagggcagtgatttacacgaatgggttggctatgtggttatgggagccattatcctgcgtttaggctgggggggaatcactcactcccctgctcggctaacggcttttacgccatccattcccaaagccattgagcacattaaagaagtggtgcgaaccaaacaagataatcacactgggcataaccctgctggtgcgattatgatttgggcaatgtggtttttactgctcgccaccggtttatcgggttggatgagtgagtgggatctgttttggggtgaagactggattaaagaggtgcatgaaaccttagctaatctgaccatggctgccgttgccgtccatgtgtcagcggtcattattatgtctaaatttactgggcatccttatgtgcatggaatgctgatcgggcataaaacatcttcacaaaatagtgaacagtcttaattgaaaaaggcgagcttagctcgccttttctctccatttaaaattattccaaattctatttttgcttaacaaccggatagtcatcattcaacagctcttgaacaaagctggagccgttgccgttataagtcacccacactttctctttggcacgagtcaacgcgacatagaataagcgccgctcttcggcatacgggaaatcatcctcactttgattcaacgcatcatccaaatgcaaagctttcacgcgagcggggaattggccttcatcgaccgccaaaataatcacataatccgcctctttgcctttgctggcatggcaagtcataaaatcgagcttgagagagagatagcgattctgccaatctttcagtaattcaggtttatggtagtgattacgaccaagcagtagcacggttttcagcttattggtggagcgattgatttcatccaatattttttcaaccgaatggttcggtgccagcatgaccgctttttgcttctgggttttaaagctattgagcgttttgggtaactgatgcggattttgctgaataaagcggttggcgaccgcaccaatctgatcattaaaacgataagtagtatcgagatggtgcaccgtcgaatgcgcaaaacgcgacgcaaaaccggtggtcaaatccacatcggaacccgcaaattggtagatggattgccaatcatcaccgaccgcaaacaggttacactggccttggttttgctcacacagcgcttgtagcaagcgtaaacgctgcggcgagatgtcttgatactcatcaaccatgataaatttccacggcgagcggaatttgcctttttcgacatactcggtcgctctagtgatcatgatgttgaaatcaatttggttttgatctttaagcatctgctgccacgcttgatagcacggccagcataaggaaagctcgctgtttaagcgtggatagtcatcgtgatccaccagccgctcttgcagctcttttttactcaatcccatttgtgccaattgatcgagctgcttctcgagccatgcgatcaatttcgggttttcgacgtggctacccagctcatcatcccctgccagatacgcaatcggccatttggcgagatgtttttgccagcgtttaaaattagtcggggtcatccagtggcgctttaaccaatcaatacaccaagcctgcttgagtttgctgtcattcgcgagtggcgacatgatcaccgttttgccttccactcggttgataatgcgcagacccaactgatggaaggtattgatgtgcaaacgctcagcttccaaaccaattttgttttttaagcgctcggccatctcttgtgccgcatcgcgtgcaaaagcgaccaacaaaatttgctctggtttcgccaaatggctctgcaataaataggaaacgcgcgcagtcagtacgctggttttacctgaacctgcgcccgccaacactaagttatgatcgtcattcagcagcacagcgtattgctgcgagacattgagcggcgacgattcacactgggaaaacaagactgtccagttcgcgcgttctatctctagccaagctttattacgctcatacagcgtcgcggaggtatcgagcagccaaggcagtaaggtatcgaaaaccgtgggaagatgtttttgcgcttcatgcagcgtcatgtccatcagttttaaatcggcatacacttgcgcgacccaagcttcaacggaggagtgggatagaaaagacggcaggcgctttagacgagacaactcttgctgccaacgcggaaaatagagacttaattgctcacattggcgattgtgccacgcttgataatgcgccactaattggtgcgcaaaatggcgacactccggccaaggaagaccttgtaccagccaactgcgctgcacgccctcttcgggatgagcaaaaaactgcaacgttccccaaaacacgcctctgcggatctgcacttcaccgttccagacatgaaagggaatacgttcttcgctactgagcgaagttaacaccaaccactctttctcaagctggacttggtaatattcattggcaataaaaaattgtgcagtcttattcgcattcagctgcattggtaaaagcccactaacaaagttgtcggcaatcataccccaaactccggtgccgatgaaaagataatgtcaatattcttaacggttaacgagcatagcgcagaagcaacaaaccgaggttttctttatcttgatcagaatcttattggtgtaatctgctagactttgccctttctacactgatgaatgtgctgcgctgtgccgaaaattaaccaactgcgcctgtattgggcaaataaaactgttaactacagtgtcttgatcttattgactttactgggtgtggtgatccccgcttggtattatcagctcaacacttggatcacccctttgattctcggggtgattgccgcggcactcgccgatcgagatgaccgctttagtggccgtttgaaatccatcattctcactttgatctgctttgcgattgccgctttctcgattgagattctgtttcaaaccccgtggctgtttgcgcttggtctattcacctcaagttttggttttatcatgctcggcgctatgggggcacgctacgccagcatcgcgtttgcttctctactggttgccgtgtacaccatgctcggtgcccatcaaagcacgaatatctggtttcagccgttacttttactcagcggcagcgcttggtactacttgatgtcgatgctgtggcatgccttttggccaatgcagcccgtacaacaaaacctcgctaacgtgtttctgcaactggccaattatttagaggcgaaatccacccttttccacccggtttccaacatgatcccgcagccacaccggatcattgaggccaatcttaacgccgcgacagtcaatgcgttaaaccagtgcaaggcggtgtttctgacccgctccaaacgggggcatgtggacagcgccagcgatcgctttttaaacatctattttctggcgcaagacattcacgaacgagtgagctccagccattaccgttaccaagagctagccgatcactttggccgctcagacattctgttccgctttaaatatttattggagacgcaagcgaaagcgtgccgcgatatcgctcaatcgattcgtcttgggcacagttaccagcacgactctgcttcgattgtcgcgctggatgaactgcagttatcactcagctatcttcgccaacaagagagacgagattggaaaagtcttttgggtcaattaggctatttattcaataacttagcgaccgtagaaaaacagctcaataacgtcagtaacccggatgtggccaaacccgaagaaggggtactggatgacactgaagcgcacaccttaggcagcatgtggcaacgtattcgcgccaatctcaataaagattcgctgttatttcgccatgcgctgcgcttgtccatcacgctcaccttgggctatgcgatcatccaagggttcggcattgagcgcggttactggattttgctcaccaccctgtttgtttgccagccaaactacgccgcaaccaagcaaaaactcaccgcgcgaatcataggcaccttggccggcttgctgattggcgtgccgctactcaccttcttcccatcacaagagagccaattggtgtttattgtcttctccggtgtgatgttttttgcgtttcgcctcaacaactacggctacgcgaccggttttatcaccttattggtgctgttttgtttcaatcagttaggtgaaggctatgcggtggtattaccaagattggcagataccctcattggctgcgccttggcggtagcggccgtggtgctcattctgccagactggcaatcgaaacggctgcataaagtgatggcggaagcgattgatgccaataagcagtacttggcgcagatcattggtcaatatcggattggtaaaaaagacagcttgagttaccggattgcgcggcgtcatgcccacaaccaagatgccgcgctttctgccgcggtcaccaatatgctggcggagccggggcgttatcgtgcggcggccgatgagagctttcgtttcctgacccttaaccacgcgctgctcagttatatctcggcgcttggagcacatcgaacccggctggatgatgaaaccgtgcatcagttggtgctcgattcacatcgcgtgatccatcaacatctcgatttgctgcatcaacagttgtccaaccactgtgaagagtgtgataccagcggtattgatagctcaggactagagaaacgtcttgctgagtggcgtgaagatgatgaaggctcggcgcgcatggtactgcaacagctgcacttgatttatcgcatgctgcctgagctgcacacgctcgccagcaagtttgcggtcaaggtagattctcaatccgactgaacgcgccattcagatcgcagggaacagtaaggtaaaccgtgttccctgccccacttctgaggtcaccgagatcttaccttgatgtttttccacaattccaaacgcgatggataaccccagcccggttccaaccccgaccggtttggtggtgaaaaagggatcaaaaattttggctaagtgttctggtgaaatcccatggccattatccgcaatttgcacctgtacccaagctttgcccttctcattcaaggtatcggtagtaatggttaactcgccgtgctcatcacaagcgtgggaagcattgatgaacatgttcatcagcacttgctgtatttcaggggcaatccctttgatcttgggtagattctcagcgagttgccgatcaaccagcatggtgtatttaaactgattccacacaatgcgcagtgccgattctatgcagtcgttgagattgcattccgcaaaacggccatcactgctgtgcgagacactttgtaggctagtgacaatgtctttaacccgatgcaaaccactggcactttcttcgacaaggctgagaacatcttcgcgcacgaacgccaaatcatgctgctgtttaaagcgcatccaagcttgataaaactcactgccttcaaaacttggcgctgactgctcaacgaaatccgctaactgagcaaacacctcggcataatcacgcaaggtattcaaattactcagacaaaatccaatcggattattgatttcatgggcgaccccagcggccaactgaccgactgacgccattttttctgactgcaatagctgcgcctgagcgccattcaactgctctaacgtggattgcagctccagcactttgtcgtacaaggcgcggcttttctcctcaaggagtttttccgcgaggatccgagctttacgttctcgctcgtaaatgcgttgatattgcgcttcggcactcatgatggcaaaaattccactacaatctcacagtgatcagccccgcaatgcatgcagacgggctgagtaatttttaccggctgattaaattgcttggccgcgcctaaaattaacccttccgccgccgcgcacaattgtcgtttcgagtagtaactcatggtcagcgttttctcttccactcggttttcaaactgaggcaagtaagcatcgggatagagtcgctgcacttctttgtggatcactttatccaccgaaagcaggaaggttttgagatcgcttttatgcgggtagttttccggcaagctattaaataaatgggtaaacaggtattcaccataagcacggactaaatcaggcgcagggatttgggctttctcactcaaataacccaccatggccagtagctcatcgtcgttgtattgctgaccagaggtatacaccccttctgagctgggtttcaaatcttctagcatctggtcccaaaacagcacaccaaacttttcaatcaccatatcggagagaacggtatagataatgccttgcatctggattgcctcacttgcgcttgttttcattcaagtgttgtagagataaggaaaagccgcaagatcgtctcacccaaaaggagtatttttcttattaccaaacgagttgatgctgcacagatacctgttgtaaccaaggcagatatcaccagtttttttgataaccttgacacttttcggacaagaaaccagcagctcagcgctaattttcgcttattgcaatgcggcaacagggagcaacaccatgagcaccgattgtcgaagacgtctcaacaaagacctctatttgttaataccggaacacccaatgaaccctaaacaatttgaacgctggaaatcacaactgagccaattaagcccgcagcagttgcgcgccctgcaaggggaaatcgatcgttcgctgcatcaaaatgagagtgcgttgctcaccgaagaagagcgcgatgcgattgcgcatctgttttcctaacttgagtaactcaggcgatacgactaaactttaaccgtaacgatgaggtaagcgcgatgtccgtatcagcagtttctaatggttcatccatggtcatgcactcttccaaaatgatggaggatgccgcgcgcgagatccaacaggcgagcttacccgttgaatccaccattggaaaaccgatagaccccacgttgcaacctgcgccttccgcacctaaaaaacagtacgccaaccacattgatgcgctcaatagccttaaccaagcctcgcactacagccgaattggaacaaacctaatccagcgtgaccaagatatgctcggcaccatgttggatgtgcgtgtttaagccaaactgtaagcttttttatcctcgcgttgaaattcacctcgttggctttacaatgcccagcaaactcaataccaagaactgttatgcctaagcttgctttgcaacctctttattcgccagatgtggcgacgctagctcccgatagattgatagatcagcttgctccccgatttgatagacccagtgtccgcctaacaccaagccctgctcttaccgagcaacaagtgatgaagcgttggcaaaaactcgctgcgcccgaagcgcaagctctgcttttggatgagcaaaccgagcgcaccatgcaggcttaccaaaaaaacatcgagtatttcatcggcacagtgaaactgcctgtcggtattgcggggccactgcgcgttaacggctctcatgcgcaaggggactatttggttccgctggccaccacagaagcggcgttagtggcgtcataccatcgtggtagccaactcatcacggcagcaggcggcgcaagtgcgctactgctcaatgaaggggtgactcgcacacccgtgtttgcttttctttcgctggcgcaagctgggcaatttgtcggttgggtgaccagccaatttgagcagatgaaagagatagcgcagtccaccaccgcgcacggcaaactgaaagatattcaggtcaatatcgaagggaatcacgtctatctggtgtttgaatacaccaccggcgatgccagcggtcaaaatatggtgacgatcgccactcacgctgtttttgagttcatcatgcgccactcaccggttgcgccagtgcaagcctttctcgatggcaatctctccggtgacaaaaaagccaatagctatacgctgcgcagcgtgcgcggcaaaaaagtcagcgctgaggtgcatctctctgccgagttagtcaaaaagtatctccacaccacgccagagcagatggtgcagtttgggcaaatgacgacagtgggcggcgcactgagcggcgcgattggtgtgaatgctcattacgccaatgcccttgccgcgctttatattgcgtgtgggcaagatgccgcgtgtgtagccgaatccgcaatagggatgacgcgcatggagatccaccctcacggcggtttatacgccagcgtcaccctgcctaatttgatggtcggaaccgttggtggtggcacccatctccctagccaacacgcctgtttatcgctgatgggattggccgggcaaggccacgcgcgagccttagctgaagtggccgcagccctctgtttagctggtgaattatcgatcgtcggggcattttgcgcgggacatttttcccgtgcgcaccataagctcgcgcgctgagcattgagcgtataccgttacctcaatttgtactgcgactgtcccctttctgcttggtgttgtaagtagaaaggggatcaaagaaagaggataaaaaattagttcgttaaaatcacatcacgctgcgccacactcacccctttaatttgggcaaagaccggcataccgacctctagcgcgagttcggcgtgagcccactccgtcaccaccgcccacaagtagcagtgtggcgcgagctccaacttgagcgagacactttttttactcggctgttggtgctcaatcgcgacaatacgagccggtaaaatattgcgaatcgagcttgcggtcggtttatccagcgcaatcgacacatcattcgcgcgcacctgcatacgcacgctgctgcccacgtccgcctccacttgctgcacccaaagccacacatcctccgctaagcgaacttgcgtcaaaccataggtttggtgatgtttggctacggtggcagaaaacagtgtgctttgttcactgaatgattgccaaggccgcatcgctttggatgaccaaacttgctcaatcggccctgcgctcagtaccttgccctgctccaacaccaccagatgatccgcaaggcgcaaaatttcctgcatgctgtgcgagacatagaggatcggcagccgaaaatgctgcgcgaggttttccaaaaacggcatcacctcttttttgcgcggcatatcgagcgaggccaacggctcatccatcagcagtaaatcgggttttgacagtagcgctcgcccaatcgctacgcgctgcttttcgccgccggaaagatcgcgaggataacgcacaaggagcggctctaacgccaataggcgggtcacactggcaaagtattcaggatcagcgtcagtcaccccgtaattcagattgccgcgcaccgtatagtgcggaaacagtcgcgcatcttgaaacacatagccaattttgcgctgctcaatcggcaattgaatgccttgtgatgaactaaagagcgtgcgccctgcgaggtgaatttcgcccacatcgggcgtggttaacccactgataaggttaatcagggacgttttacccgcaccagagcgcccaaagatcgcgcaaatccccacggcgggtaaacgcaaatccacgtcaagttgggtttcgcccaaccgcttttgcagttgcagaatcacttcactcatgatgttaacccactcatgacgttaaacctaagcggcgctgcatacgccgacttaaccattccgagataaataacgagccgagcgcgatggcaatcgagatcgcacacaaacgagccgcttccatttctgaacccggcgtttctaaaaaggtgaacatggcgagcgggatggtttgggtttcaccggggatgttggagacaaaactgatggtggcaccgaactcgccaaggctacgcgcaaacgcgagcatgacgcccgtgagtatccccggcaaggttaatggcagcgtgatggtaaaaaagacccgcattggcgatgcacctaaggtgcgcgccgcttgctcaagtttttgatcgacactttcaaggctgagacgtatcgatcgcaccatcaagggcagcgcaatcaccatgcacgcgagcaccgcaccgcgccaactgaagctaaaactgagcccaaacacctgataaagccactgaccaataaatccctgccgccccatgctgatcagcaataaataaccgatcaccacaggcggtagcaccaagggcaaatgcaccaaactatcaatcagccctttgccgataaaagaggtgcgcgccagcacccacgccagcacaatgcctatcggcagcaaccacaaggtcgcatacccagccacttttaaactcagcgccagcgccgcccattcgtaatcggagagacccatcaattactcactcaccgactcaaaaccaaaacgttgcaagatttgctgcgcggcgtctgagcgtaaatacgccacccattcggcgctcgccgctttatcattcaattgcgccagcggatagcggatcggctggtgagactgagctgaaaatgccgtcacgatcgtcactttatcactgagcagcgcatcggttttgtacacgatgccaagcggcgattcaccacgctcgaccaacgctagcgccaaacgcacgttattggtttgcgcaaggcgtgattccagctcaggccacacccccgcatgttgtagcgcttgcttggcatacatgcccgccggcaccgcatccacttgcgcaaccgccaagcgagaatcggccaaggccgtttgccaagccgcggcatcttgcagctcaaaacttgccaccggctgtgcagtcgggcgaatcagcaccaaactattcgccgccaacgtcaccaccttgttcggtttcactaagcctttctcgactaagtaattcgcccactcttcattggcggaaataaacagatccgcaggtgcgcccgcttcaatttgacgcgccagcgaagaagagccgccgtacaccgtcaccagcttcacatcatgctgctgtgagtagtcggccactaacgcattgacggcattggtcatcgacgaggccgcgtaaatgtgcagtgtctctttcgcgctcgccagcggcgcgttaagcgccacacacagcaggagcagaattcgtgtcaacatgggcatgttccttataagtcaggccacaaaagcgtgagatcgaggtgctgctcaatcgcatccgcaatacggtcaatcgcccgctcttgcgccgctcggtgatcatacgcttcaatctcttttgcgccagcccattggcaaatgcgcaatgccgtttcagggcggtcaaaaataccatgtaaataggtgccaaagccttgattacagtcactgactaacccatccaagctgccatcactgagtataatcgggcttttttgatcggctgcccaacttgagtgccccgcatgaatctcataaccttgcgcggccacggtttggccatctaaggtcaaatgacctttcacgttagtgaggcgcttttcggcggtcagttcggtttgcatcgcaaacagccccagaccttcgctgctgccagcctcaccttcaatgccaagcggatcatgtacccattctccaagcatttgaaaaccgccacaaatgcccatcactttgccgcctaagcgcaagtgacggaggatctctttatcccaaccttgtgagcgtaaataagccagatcagcacgggtggatttgcttccggggaggatgattaaatctgcgcccgacagtgactcgccctgcccgacataacgaaaatcgatattgggattgagccgcagcggatcaaaatcggtgtgattgctgatgcgcgtaaacacgggaaccgccacacgcaattggcgatccgccgacaggttttgctgcgcggcaatcgcatcttctgcttccagatcaaagccatgcagataaggcaacacaccaatcacaggtttaccggttttctgctccagccaatcaagccccgattgcagcaagccaatgtcgccgcgaaagcggttaatcacaaagccttttacccgcgcttgctcagactcagaaagcagcgccaaggtgccgtataaatgggcaaacacgccgccgcgatcaatatccgccacgatgatcaccggtacatcggctttttcggcaaagcccatattggcgatgtcattctcacgtaagttgatttccgcagggctgcccgccccctcaatcatgatggcttcatactcttgttgcaggcgctggaaggaatccatcactgtatccatcgcgacttttttgtagtcgtggtaagcgttggcttccatgttggataaggcgcggccttgcaaaatcacttgcgcgcccgtatctgaattgggtttcaacagcaccggattcatgtgtacgctcggcgcaataccacaagcttgcgcttgtaccgcttgcgcgcggcctatctcgcccccgtcaggcgttaccgcgctgttgagcgccatgttctgcggcttgaaagggcaaacttgaatgccgcggcgcgccaatactcggcacaagccggcaaccaacacgctttttcccgcatctgaggtggtgccttgcaccattaaccattttttcatgcaatcacttaatgatggattggagagcgccagtgtcggccactccgcaaccacgttaaccagaggagcaacctcgcccctcgaaaaccaagaggcgttagcatacctcaatacggtctgcgtctggtactttgctgtttttaatgggaaagcgttttatacaggtttcgttgcccctcccccttctagggggaggatgggtgggggtatttcgcgccagatgtgttaaacgtggaaaatacaaacttcagcgaaaactaaaatacccaccctaaccctcccctaaaaggggagggaactggatttgtgttcacttggagtttattgcagattgttgagggataacgtgtttatagacattttagagttaaagccttaactctaaatcattcgtttcggattaaattttctatgatttagcgcactcaccgcatattgcgagcgcagcgagtaatttatcctaataaagcaacttgttatacgtgaacagagcatcgtatctatgcccagaaccggccattagcggacgtttggcgtatttactccaccccaagcctcacaccctatacgagcttactgaatattcagtgattgcaacacgttaagtggtttgaacaatacgcttaaccgcgtcttgtaggccgtcttctttcaccttacccatatccacgttatagcacttaaaaatcggccctgattctggttgccagtcttcaaactggattactttcattaacttgccttgagggggaagcaaaaagtcaagcatccggttcgtcaaatcttcatggtgactggtcacaatgacctgccttttccagctatcgttagcatcggcgtacgccagcttgcgaagcagtacggcagcaggaattagctggttcatatcaagagaagtagtaaagtcatcaaatccaataaccctatggcctaattgttctgacaaggccaagtttaagtttattgtccaacaaattgctagctgggatttttgaccagttgatagatcgtcgaactgtacaccagacttcgtcttaaaaccccactttggtattttcggagtgccatcgtttttaagctcgataggcagaaaatcatcgggaaaatggaagcttgcaagaagctgattcatgttttttaacaattgatcaagttcagcttgcggtattacctcaacagctgatagcaactgactttttgcactcgattcctgtttacttatagccagagcatcggtgatcattttctctgcgtgctctaaaccatcccaatcaattgcgttggcttcgtcttctaccttctggatctctaaagctgaccagttagtaaacaccctgccaagctgatgaataatatcggtttcagaaacgactgaagcaccctctgcaactggagtttttatcgtttcaagataattactaacatagtcagttaacccctcaacagtaaggttaggttcatttagaagttgtgaaagctgatttgaatgagcatttatatctctcacaaccacctgagagcgctttatctgattgagactagcggtaacaacttgccctctttcgataaccttctctatcttccctctgatttcaacagaacgtgcagtcgtcaatgtcgacaatttttccaattgaacctgtaacccctgtttcaaatcaataacatctgaaatatcaggatgctcgtcccaagcctctaaccagctactaacattgtcagtaaagccatcaatccaagttaagatcgagttttcgtctccttgcagctgcgcttgtagtttattaagcctttggtattcgttggttaactcaatccgttgtttctctagttcatctactttatcagcgtaaatgtcagtatcagagcctacgaacaaagtattctcgagttcagagggggccaagatagtatcttctgacaacttttttatgaccaattctgctggtaaagactgaatagtagataagaattctttggtaaaggcaggtagttcatttcctttctcagaaaaatcgacctgacggcctcgatactccaacaaactatgcccaatatggctcaactggtcaggaagttgtgatcctatcggttcagccaagttactgaagtttccgatggagctagaaaggttgcggatttgagaatcccatttattttgtaggttgccattctttaaggtcaacgtactatcgactaacaactgacgaaacggcagatcgtgagggagcttatcgacaagctcattaactcttccagcgagagtttttctttcttcgtcatagttttttctatacttcagcgtatgtagctggcgctgccagtcttctaactttgcttgtaacgccttcaagctccgcttaatctcttcgcccggcttgttttcaggctctaatagttgaatgatttcgtcacatgcaagcccagcaatattttcttgataaaaaaatgaggctattgtactgagtttcttatggtcagttttagccttaccgttaagctcaaacctcttgccatttatagataccgcacccttgctctccttagtggttataaaaccacctgcaccaacattagactgattaagtacccagtccattgcttctaacaaagaagttttacctaccccgtttttacccgtcaccaaaataaggtcggcagcttgacctgctatcgtaaaatcaagctctttggggcccccatcttctaaagctcggtagcctttgaaattttccagtcctatagactgaatagtatcgatattgttacccaagagaagttacctccaaaactggtttacctaataggtcattgatgtccttaacaagttcatcctgccagctttgagcaacgctatcattttcaccagcatccacagaaacctttaaaatatccgtaaatcgagtaaatagctgcggctcaacgcctctgggaggtttagcgtttttaacagcttcagaaagtacacaagaaaaatcttgggctgttattctcctaggagtatattcacttgaggccagctcccctaaccaacgcttctttgcatcttctactgattttccttcaaatgattttacggcttgaagaacaaaacgtccccggtgccaatcttgatcacccataagctgtaaccaagaatcggatttcttatgcatatcaataagagcaactaaaggcgcaaacttctggtagtcatgcatcaggtctgtgaggcgatccatcaggcgggcaacatatttctttagctcaaccatttcctcttcacttggattcgaatcaacccgccaaactacaagattacaagcggagtggcaatggacagacacaggatagatatctcttcttgctggactacagtctgtaaaactaatctccaataatgattccattcttaagcttctcgtaagtaggttcgccgcttgatactcggctgattggcataaaagtaatttgtgggagagtcaactgcatctaggatcgtttctgcgacagtgtctttattcccatcataaggcttttggtaaaaaatatgttgccaccccaaagtcactattatttttggagtgatagaacctgctgccgtatctttattaacaactctacgcaggcttggccgaatacgcgcaccggcctgccctagagcgagagcgagatggttattacctctcggaacatttacttcatccccggaagagacaaatgagggatctgcatttagataaagaagcttatcgccagtgaatttcgcctcagaatgtttgaatgataacgcaatgccaccttccagctcttgttccgaacttggagaaaggaggccttcaaataaaaacagcaatgttacaagttcagacacaagagctttgttttcatttataggatcatactctttggcttttctaccattgagcttagataaactagcagctaatgcagaatatgcttcctgatcactgataacaccagaaatagagtctagccaggtaggtgtcgcagtgcagtagtcggaatcgtctttgagtgtaccttcgagtgttgatataacttgatgaagaatgacttcagaaaatggtaagacggaagtaaagcttgcattcattgacagaatactagtttttaaggcttcaacaattaatgttcttgctactcgctcataaatacttttccagagttcatctgctgttaagttcggtcctctatcaggatgtcgaataattaacttatcgccgtccaagggagacttcttgtggtgcaaggcgtaggtattgacgatttgctgctggtgaaaagttgggtaagcatcataaactgcaacaattggcgcagaatgtgtttccaatacatcgtgattattgttttcaagttcatctatatactcgtccaaaacagtctgtagtgtgtgatgcacttgtggctcatcgctaccaaagcccacaaacatcaaggatttacttctaagtcgatctctaaaaacatcagcagcccattgcctgttccgccatttctggagctgtcgctcagtgagaagtatcgactcgtatctcttttcaacagtagtatcagtaagtttctcagcacaaccatttaccttaaagacctttagacgattgacattgtcttctccaatctcagcgccttttttacggtaatcgtcaagacaggaaatcacgtctgaattacttccaccgctcaattcaacataggccttttcaaagttgcagtcgtagttagtggttattacttcattaatcagcccctctcgtgacaacttggctatgtagtaatgagcaggcgttgggcatagatctcgatattgatcaattttcagaatatctaccaagctcttataaccaatatcggggctaacaaactcccacagatacagctcagacaggcaacccagctgattagcgctcgcggccttggtaatatcacagaaaaaacacacacctttgcaaatatcaccagtaattttatgaccaagagcttcgagttcatgcgagcaccagcacttgcatatagttccatgagcttcagctttatatctagcgaatcgaagcttaaacaactctttttttagggtagttaccatccatttgacattatgaacccactccccgcttcgaggtttacttgtcatagatatacccgcaccggcaacaggcacacatcgtcgtctcaatattctatcgacagtgtaatcaaacgcattccttgcaatcatttcttacagggctccgaattttggggcagagtaaacattcttgttgtccacttttggtcctaggcggacttggtacgccgtataacaatcataatgcaacggcgcgcttttccgtttccattgtcgaggcttgttttgtgagtaacaaattacgtagaaggagcgcatgattatgggctatttgacttccttgtatctgaactctcggtattccgatgatgtttgttcatcagttgaatctatttagctgtggctgcgtatcagctcgcttcacctacgacgctaactttcaagcttgttttaaagcatcatgcttaatccgtacctatctactgtttatgaagtaactttgtcgcattactaaaatcggatcaatagttttggaaagaagttacccctttgtcacgttactaacttcgaatggggcattttcgttttgtacacccctgccacacctttggacactctcaaccccaacccatcaccctcaacaatgcctcacctgcaactaatacataccacaattacatatgaatacagttgcttttcgcgttttatacacgaccggattgagcgccgcaactattcagtctaaggtttgcggtgaacgacaggttcaacttaacacctttgcttgcacactttcagccgcctttcggggcggctttttcgttctggctttattgggcaggttgtgactatttcttgaggaggacaatacactcttcatagtcaggcgcagtatggatatcccataactgtttggcggcgtagtgagcaaaatcattattggcgggtaagattttttggcgagcgtgtttggtttgtagatatatcgcttgcagttctttctgctgctcgccagtgatatggcgagaattggcgcacatgtcggccaatccttcgtaagcgtaggcattcacttccgccatgttgattttggcaaacgcgaacatgggaaaaagcaatatcacgcctagcagaaccttaaatcgattttgcatctttcccccccacagacaatgacacttctctccatagtataggttgctactgggccggcagtgttgcgtgaatcaaacctcgtaaaatgaaccgaatattaatcgtcgcctcagtattggttcaaatccgatagcgtttaatagccacatcaagacaacaaacagtctccttcgagacacattgatgaaaaaaggaaaaaccatgaaacgtactattatcgctctgacttctgctctgattctggcacccactttggttatcgcggcggataacgcgcaacacattaaatttattggcgacaaccaaactcaagcgggcgttcagttccaaggccctgtagaagtggtgaaggtgcaatcgctactggattcatccaacccatttatggagaagaaagtcgtggtggaaggcaatttggttcgccaactgcgcaaagacacctttatgttctctgatggcagcaacgaaattcaggtagagctggatgatgatattcacctgaacgcgacgctcacgccagaaaccaaagtgcgcctgtttggggagtttgaaaacggccgcacgcctgagattgaagtggatcatatcgagctgctgtaatcgctgcgcaagagactgtaaataattctgtaacacagcgatgttttcggacatcgctgtacttttttctccatggttcacttacccgatttcgctccgctttttatattttggctggtgcgcctttctctccttctctttttttgacgaaaaagccttcaaaaagcaaggtattgaaataaatggcctgtaatttgcttcttgttacggtatctttgccacctatttgattgcttgcggacaacgtcattatgctgaaaaaaacgcacctgagcctgctgctgggccttactcttgccactcctgcccttgccaataactttaactacaattttcttgagttcagaaccgcaatgaaccctgaatctggcggtgtggaatttagcacctactttaccgataactcgcactttattgctcgtattgactctcaattggatagtgattgggatatcgcaggcggcatcggttttaatggcccgattaatcaatttgccgatgtgtatgggcaaatgttggtacacaacattcgtatgcctaaagaattgggcggcgagaaagatactcaactggaattcaaccttggcgctcgtgcgtggctcactaatcaggtggaaggacatttaagacttggccgtttagatgaccattcggtatttatcgctggagtgcgttttcactcaaccgatcaactttcgctaagcgctgaagcgcgtaatgcgggtgtgtggggaccacaagtcggtatgggcgttcgcttccagttttaagctttctgtttgagcccccggcttaacgttcccgtttaagcaaggctataccaacctttagaggtgccgcctgcacctctttatcctatatcgctggtatttttgaagtttgtgaatagccgtggccatgctaggggcggttttcgtcaacttagtgcaagaatctttctatccaagtagtcaataccccgcgttacggtgtataactttgtcaataataaaaacaagttaagagttttttgcatggctgtcggttctgaagatctgaataaactggcgttgcttttaaaaccggggatgaaggtatcgactgaaattcatttcggccctgaggatacttatgcgttccacaccaccctgattggccacaaaattgagcaatatattgtgctggatctgccgctcaaggcgcatcaagccttagtgatgcgtaaactcaagaatgtcgcgatcgtcttacgcggtatgtgcgacactgaattggggcatattttggcgtttcaaagttccattttgcagcccagcactaagcctttctgtgttttgtttattcgcccacccaaacattttgcgaccaaagcgattcgtagccatgaacgttataaagtggcgatcccggctgaagtgagtgaagacaacaaaaactatgcgggcacgttagtcgacttttccatttcaggttgcggggtgtttattcgtggtgaaaatgagctccatatgggctctaaagtgcgaattaatagtgaactcgacccctttcttccgaagcggctcaaaagccatatcgtcaatattcggcgtaaatcgaatgggcatttgatcggcattcagtttgaacaaccgatcactttgacggaaacgctaaaaaaacaggttctcgaacacgcttttctcgctggctcaatttaagccagcgtttttttggccatgatgatgtttgaaatgctccagcgctttatgcaaagtctgctctttcagtggcttcactaacacatattccgcgcccgcatggaaaaatgcttgccgtgtttcttctaagccatccgcagtgcaggcatacaccaccaccggaaggtgcagcacttttttgatggtgcgcgtggtctcaacgccatccaaatagggtaactggttatccatcagcactaagtcgtagtcatgtattttgagctcttcaatcgcctgtagtccatccgttacccagctcacatctaagccatatttacgacagaatgcttgagcaataaaggcattggtgtggttatcctccaccaacagtacacgcagagttttatcaaataacggttgaggatcaggagctggtaacaactgctgcggcgcatccggtttttctaccagctcaatcggtaactgaatttcaaaacgtgtaccaatgccatactcggagctgacgtgcagttgaccactgagcatttccactaaactgtgcacaatcgttaagcctaaaccacttccgccgtactctcgagtggtggtcgattcagcttgcatgaagggttcaaaaatcaccgttaaatcttgttcgcggataccaatccccgtatcgacgacttgaatcaccagctgagctaatggatcaccttcaattaattgcaattcgacacgtatcgaaccttggtgagtaaacttgatcgcgttattgagcaaattgaacaagatttggttaatccggatctgatcgctgcgcacaatcgctgcggtagtgatattggaattcaccaccagttccaagcctttttcattacataaaggtcgataaatgcggtcaatcgcgcacaccaactctttaaggcgaaactcattcttttgaatacggaatttgccctgctctaagcgtgagaaatccaagatgtcattcagcaccgcgagcaaatgttcaccactgctgcataacacagccacgtgttcgcgctgttcatcattgagtggggtccgttttagcagttgggaaacaccgagcacaccattgagcggcgtgcgcaattcgtgactcattttggccaaaaactcggccctgacccgtgccgactcttccgcttcgcgccttgcggcttggctttgcttctccgcttccgcgatggtggtgatatcttgcccttgagtaatgatggaaatgatctgcccttccaccatgatcggtgaaaggttccagcggtacacacgaccatccacttcggttgtgacgtcactcggattattgccctgtgccgcattagtgatggtcggcaacagttggcgttcaagaatctcaaataagaaatggttttgcgcatcttcgcgcaaaaactggatttgcgctgaggggttcatgcggatcagccgaccagaggtattccaaagcatggtcggtgaaagcgcaaagttaaacagatcttcaaactgcttttctttattggcgagacgacggaatgattgttccaacgttcgcccaaaatagtcgaactcataaatttttgaaccgataaactcacttttcgtatccagatccatcaatttatgggtgtaattcatcaaggtttcaatttcacgctgaatgcgtttttgtagccaccagcgtgacgctatggaaacaccgatcatactgatcagcgcaaacgccatccaaaaatagaaattatcccgcagggtgagcacattttggttggtctgaatcgagtagacgcacagataggtcggtacactttccacttctaagaaggtttgcccaacaataaagctgtctcgcatagcatctttggcgctgtgcaccacatagtccagcgaataaggttcattgcctttcaaggtagaaaccagcggcgtagtatccacggcaaggactaggttttctgagttactgccactgcggatattttccaacagcgcaaagttatcattgagtacgatgcctacatacagatacccaacaacctgcccggttcccgcttcaatcagcgatgaacgacgcatcaaaatatggactgattttccctcgctgggcgtttgaaccaagtgccaattgccactaatcgccactctgcggataagcttattcagctcttgctgggcaatgccgtaaaaagaggcgttgccatcatcccacaagatgttgtcgtgactggagataaaacgcagatctggcgcattagagagttcaagttcatcaacactggaaaagaattcatccagccgactcgaatctcggctgacaagtgcgttgattaaactggcgttcttggctgtgctgtcctggtgaattcgcagtgccgcaagacgaaaatcaaacaaactttgaatcaagctggaggtttgaactgaagtgcgttgtccttcttgagccatcaagcggctactgatctggtaactttggaataatacactgacgatcagaacgcccatcaccaccacgacagcatgggtgataaaagaagcgatgcgctgtttatgcttgatttggctaggtcgaatgttcaaacacgtaatcctctggcctaacgatccgaataacggaaagcccgagctttcagttctgcaatacgtgctgctgaatcttgtttggtgaccacttcaaaatcgcctgaatagaccaaaggtacggatttcccttccaaatcccatttaatcgcttcagccatcgccacacccgtatcgtcattcatacgcatcacagtgacatccaattctcctttggcaagcgcttcaagctctgccgaaccgcctccccaaccattgaccagaatatcttgtcgattcagctctttcagtgcctgcgcagctcccaaagcgacgtccgtcgcacaggcgtaaataaagccaatttctggattattcttgacgatgtttagggtcgcttcatagccactttgttcggttgccttggtgtaataggaagaagccaacggaaaatggtgcaccgcgttcatatcttgaatgaaggtgtctccccgcgcttcactgatatacccctcggaaaaataaagtactgagtacggctttttcggagcatgtgcttggtaatattgcgccaataattgcgcaccgtactcatgatcaaaaccgatgtacatcatgggctgcttgccttgccaatctttgactggcgtcgtgatgttttgcaaaatcagtttcgtttcggaggagtgcagcacatgctcaatgaatttgcggtgacgggtggtatctaaggtaaaaatcagatagtcgctcttatttttcagcgcttccatcaaggaaacactctgctggcgagtatcaagattcgggcgagtaaacacctgattgatttgatagcgaatccccaaagcatccattcgcttttcaaacgctttgatgttgcgaacccaatagtcagaaatttgctgtccgggatagaccaccgaaataatgacgggttgttcttgcgccaccgtcaacgcactcggtttatcacgaactgtttgagcaaaaagctcggaaattggccgctgttcagggaactcagcaagaaattcatcataatgccaatagccttttaatgaatcggcttgaccagttgagctgaagagtgctgctatcagaaacagcggagatattagctttcttttcatagcttcctcatgagcttttcttcctaatgttcaatttgaatgacattcgctggcaaacgccgacatctcattgaatcaagaagaactcttttgcccagatcgggaaatcgttgtcactgattattaagcatgattgaggtaattcatagtgcaggtgtgggaaaaatagtttctcacacctgcgactgctcacttattcagcaagtttgacttagaaagtaaaagcaagattcgccgaaagcccgaattggttatcgccggcgtaagaaccagccaaatctaagctaacaacatcccacgggctgacgccaagaccgacagaaaccgagttatccaacgagttttgtaagtccacttcataaccggctctgagctgcgcccaaccccatgcattcccttccaccccgaaacgcataaactgggtatcatcgttgtcaccgttgaatcggcgctgtttggtgagatcaagatccaccgcggcgataaagaaatcactcacataactgcctgacaccgctatttgggtatctagcttgtaagtgttgtttcggttctgggtttgaatatccttcgcaaacagatctttggcgacgataccaacacgatattgatcaataagccacactgcgcccatatctaagttgaaggagttatccttcacttcgcttttatcatagtcatcaaggtcgaaagatttgaccgacgcattatcttgataagttcgcagttgctgcactttcggtgttactcccagcgcaaccgtctgcccaccaagtaccacttgtttacctactgccaagcccacttcggtataaccaaacgcggttaaatcgacatcggaactttcatagcgagttttcacctcattggcactgttgccagatttcgcggccacattggctttcgcaatcacttctgcatagccgcgggtaaaaaagttgagggagactgcatcgagaggtagggcgactgcaataccaatcccagccgtgacggccaagggtttatcatccgccaattgatcgagatagcgattgagctgatctacgttttcctgcgttgccgcgccgactcctgcgcgctcaaactgttcaatggaatcttgcaaatcatctatcgttttgagtgattcatccttgtcttccgctcgcagcccaatgctgggcagcaaaataccgaatgagtcatttttacgatacaccgccgtcagcgctgggttgtagtagggagccagcagataatccgccgtagaaacgcccgtgttacccataccggcaccgcgagcatccatcaacaaattagaagcgaatgccgaagaagagaaggccattgccatgaccactgctaaagtactttttgtttgaatattcattccgttaccaacctcattttgggttatcccatacacaaggttaatacatgaatgattttttcccagaaaatagagtgacatgactcactaattgggcacgttcactgaaaaataatctccagttgatcaattcgcgccatccccgccaccaacgcttctttctgggatttggagagcgctttaattcggtattcgagcttcaatgccgcacttttgccatcagcaacgggcaatgaccacaccagttctagtgggcctttgccacgcagcgctttcgcccccctgcccttttgatgttgggcaaagcggcgctatacatcggtagtgatgccacaatagagtgcgttatttgcacaacgcaccagataaacaaaccaaggtgaaggtaactcagccaagttttccattagccattattttctattagctaaggtgctgttcaatcagtgcgcgcagctcggccacttcttcacgcagggctgccacttcttgttctagttcagcgtattgagaagaggcgttcgcttcattgtctgagctcgtggcaaaagccgccatatccacttcaccgcaaaacagatgatggtagcgggactcacgcttacccggttcgcgcggcaatttcaccaccagcgcacctgagtcacgattcgctaagcgctcaagtaccgcttcagtctctttcacatcggtaaatgtacagagtcgattggttcgcgtgcgcagctctccgggggtttgcgcaccgcgcagcaataagcagcagatgagtccgagttcttgttgattgagtttgagatcgccaaactctgtattacagaagcggtgttggtatttgctggtacggctattaaagctgctttcatcgcttacaaggcgacgagcgattaacccttccaccgtatcttgcacttccgcttcactcaagttgagtaccggttcgcgattgcttttttggttacaggcggtggttaagctattgagtgtcagtggatagtgatcgggcgtggtgacttctttttcaattaaacagccaattacacgggcttcgagtggggagagttgaatattcatcgtgctgtccttctgctggcgggcgaacccgcagtcggtatttaatgctcagttaacagaggtaaccgaatcattttgccattctcatcaatcataatgattctggcgcggtttaattcaatttcggtcaactcaagctgctgacgctctttaatgtaagcctctcgcagtttgattgcgacagcatcaagctcagtttgcagcggcggtgtgggaaccaaaatctcagaattacgcatggttgctcatcatgtcttcatgaatggcgcacatgatatagcgcattatttctgatgtacaattggctcgcgctttgaatggcgatttattggtcaagataagccgcatattgatcttaagtctgttatgaaaagaattgttgtgttttaatcttcgcagttgcattaaaagtaggaaaaggaacctatgaacagcgtatttgaaattgtgagcttggctcgtcgcaaaaataaacttcaacgcgaactcgatgataacgagaaaaaagtgcgtgataaccgtaaacgtgttgaactgctggtaaacctgcttgactacatcaagccaaacatgagccacgaagagattctcggcatcatcaaaaacatgaagtctgactacgaagatcgtgtcgatgaccacatcatcaagagcgcggaaatttctaaagagcgccgtgatatcagccgtcgtatcaaagacttaactgagcacgataagcagatgactcaaggcaaaaaagcctaatgattccagacccaccgcaaggtgggttttatttagcgcgccaatccgtttctctcattcgaattaaggcaaaagcgttaacgtttctatcaatgtctgccttgcaaaaactgaacgtgatcgacattaaacgtttgcgtaatcgctaaccttcaccgaacaaaattccgagcctttcgtcacatattttccattgctatagtgtcattagtgaatcaacagagtgccctgaaaatcgcaggtttgactaaaataacgatagagcggcctcttttcttgatggtttagccatactcaacccatggcaaattcaccaagaaaccattcgaggcatggagcttcctcactactctcacgatgagaagattggcacgacactgacactgtccacactattaacgagggtcaaataatggatatgagtatggttgaaattttaggatacgcggcatcgatcatggtggcggtatcattgacaatgaaagacatcgtcagactgcgtgtactgaattttattggttgtgcactgtttactgcatacggtttgatgattgatgcttggcctgtcgtcgtgactaacggctttattgcctgcgtcaacgtctactttttggtgaaaatgcaacaggaaaaaaagcctgacgcgtcttcgagcgcggcttagttctccctgaaaaaataatgcccggtttaacccgggcattattgttatggagaaagaaaaattttatggagagagaaaaattactcttcttcgttgtgcagtactgcccacgcttgggcacatttcaccgcacgcttccaacctttataacggcgttgacgcttctcttcatcatgatgcggtttaaagctgcgatcgatttccgctttgccttgcagctcttccaaaccatcccagaaaccaacggccagaccggcgaggtaagcggcgcctaacgcggtgacttccgtgactttcggacgatgcacttcggtatccaatacatctgcttggaactgcatcaggaagttgttggcgaccgcaccaccatcgacacgcagcgcagaaagcttgatgccagaatcggcttgcatcgcatccaacacatcacgcgtttggtaagcgatactttccagcgttgcgcgaataatgtggtttgagttcacaccacgggttaagccgacaattgtgccacgcgcatacgcatcccagtacggagcgcctaaacccgtaaaggctggcaccacatacaccccattggaggtatccactttggtggcgaagtactctgagtcgcgagcatcggaaatcagtttcagctcatcacgcagccattgaatggatgcaccgcccataaacaccgccccttccagtgcataagctggttcaccgcgtgggccacacgctagcgtggtcagcaagccgttgtgcgaggtcactttttcctgtcccgtgttcatcagcaagaagcaacccgtaccgtaggtgtttttcgcttgtcccgcttgcacacacatttggccgtacagcgccgcttgttggtcaccggcaatccccgcgattggaatacgcgtaccgcctttaccaccgatgttggtttgaccgtacacttcagacgattttttcacttccggcatcatggagagcgggatattaaattcggcgaggatcttttcatcccactgcaaggtgttgatgttgaacagcatagtacgggatgcgttggtgtaatcggtcacatgcacacggccttgtgtcattttccacactagccatgtatcaaccgtaccaaacagcagttgtcctgcttcagcttgctcgcgtgcgccttctacattgtccagaatccatttaattttggtacctgagaagtaagggtcgagcaccaaaccggtattgtcacgaatgtaactttctaaaccgcgctctttcagctcttcacaaatggcagcagtacggcgacattgccaaacaatcgcattgtagacaggcttacccgtctctttattccacaccaccgtggtttcacgttggttggtaataccgatggccgcaacttcatcactgcgaatgcccgctttacctagcgcttcaaccaatgttgagctttgcgtagcgtagatttccattggatcgtgttccacccacccggcttgtgggtagatttgggtaaactcacgctgagaaacgctcacgatattcgcatcatggtctaacaccacggcgcgagagctggtagtaccttgatcgagagcgacgacgtatttttgctcagtcatgttctattccttatggtttcacgttcttgctttaccccagcatggcgaacttaagccgcatggcgatcacaccgaagtgctggggtagtctctattgttattgaatatacttttttaagtttatacccgctatgcgcgcgcttcttcactctcttctgccgtgtcacattggttcggaatagtgcaacccgtccccgtttttggcagataagccgcgataaactttggatatgcccacgcgccaaaacatgcgcccagaatcggagccacaatcggtacgatgaagtaagggatctcttttgcgccagttagggcataatcccatcccgcgaagtaggcaaacagtttaggaccgaaatcacgcgcagggttcatggcaaagcccgtcaatgggcctaatgagccaccaatcaccgcaatcaaaataccgattagcaaggggttcatcgcattgcgatgcgcgccattgttttcatcacccaacgccaaaatcgcgaacatcagtaccgctgtaatggtgaactcaacggccatggctcccataaaagagagagaagcatgcggataagttgagaagatccccgctgtcgctaaggcttcttggctgctacgtacaaaattgtgggcgatttcgtaatcggtaaaaagattgctgtacaagctgtagaccagtgccgccgcacaaaacgcaccagccacttgtgaaacgatgtaaggtagcactttcgctttatcaaaaccgtggaaagcggccagagcgatagtgacggcagggttaatgtgcgcgccagaaaccccagccgtacaataaatggcaatcgatacgccaaaaccccagacaatgctgatttcccattgtccgaattgagcacctgctaaaacgagtgcggccacgcagccgacgccgaagaaaatcagtaatcctgtaccgataaactcggcgatacactgcccgagcagagtatgttgctttgtttggttcatagttcagagtcctttttgttatcttgctaccagagccgtatcgaacagccatccacacccgttatacttagaaagtcagcataaatatctgcagtctcactatttttcggtttatattgtggtcgccgcctacacccgtcggctctaatcgcatcatgaaatagccgttattggatgaacaatctcactgttcgcggtgaatctggcacaaaaatatcacctcgaaaacaaacgaccgcaattaatgagtgttcgagcacaattttgttattaacaaattcgttttttgttaaacaacgcatcttttttctctctcttctccgatgtctgaaaatggctaatcttttggtttagcaatcactaaatcatgagtacaagccagatttaacgcacgatcgcgctgaaaaatcgacagatattcccttattaagtcacgaacatattcactcaaacgaacattaaatgtgtcatacatgttacgaacagtgttaatcatcaataagtgaatcgcataaaattacgccactgaaagattccatccacttccatccgccatttaatgctcgttcgcgcttttgtgagcaaaacaacgaacatgaaatgaaaataatggcacactaaccgtatgtgttttgattgcataaggttgagctcatgacggcttatcaaagaatggaaaccgacgtggtcatcattggcggcggcgcaacaggaaccggaatcttgcgcgactgcgcattgcgcggattgcgctgtattctggttgaaaaagatgacattgccgcgggcaccacaggtcgcaatcatggtttgctgcactccggcgctcgttacgcggtcactgactctgagtcggcacgcgagtgtatccaagagaacaaaattctgaaatccatcgcgcgccgctgcgttgaagccaccgatggtttgtttatcactctgccagaagatgatttaggctttcaggagtcgtttattcacgcctgcagtgatgcagggattgaaacgcagcgcttaacacctaaagaagccttgttacttgagccgaatgtcaaccctgctttgattggcgcggtgaaagtgcctgacggtacgctcgacccttttcgcctatgtgcggccaatgtgctggatgccaaagagcatggcgcgcgaatgtttaaccgcactattgtgacccagttgatccgtgagggagataccgtgcttggcgtgcgttgccaacatttaggcagtggcgctaagtttgatattttcgcccagcaagtgattaatgcggcaggtatttggggacaaaacatctgcgaatacgcggatctcaacatcaagatgttcccagccaaaggctcgctgctgatcttggattaccgcattaataatctggtgatcaaccgctgccgtaagccatccgacgcggacattttggttcccggcgataccatttcgctgattggtaccacttccgagcacattgattatgaccagatcgataatctgcatgtcactgaacgagaagtggatattttgctcgccgagggcgccaaacttgcccccattatggccaacactcgcgtattgcgcgcttatgcgggcgttcgaccactggtcgcagtggacgatgatggcagtggccgtaatatcagtcgtggcattgttttgctggatcacgagcagcgtgacggcttgaaaggcttcaccaccattaccggtggcaaactgatgacttatcgtttgatggccgagtgggccaccgatctggtcgccaagaaacttggcaatacccaaagctgccaaacgcatctgcgccctttaccaggctctcagcaagcaccaaaagcactcaaaaagactgccagtatcgccaaaccggtttatgaatccgccatttatcgccacggtgaacgtgccgcgaactttttagccgacgatgcgaaaagccaagcggtgatctgcgagtgcgaaatggtcaccgccggtgaaattgagtatgccatcaagcagttggatgtgaataatttggtcgacctacgacgccgtactcgtttgggtatggggccttgtcagggcgagctgtgcagctatcgcgcagccagtctgtttagtgaatacgggcaagtttctggttgccaatcgagccatttgttggtcgattttctggaagagcgctggaaaggcatcaaaccgattttctggggagatgcgctacgcgaagcagagtttagctactggatttacgaaggcttgctcggtgcaagcgatttaccttccttcgactcagccacggagaaacaacaatgatgcattatgatgtggccgtcatcggtggcggaattgccggatacagcgccgccctgcgcgcactgcaagccggaaaaaaagtggtgttaatcaaccaagggcaaagtgcgctgcatttttcttccggctcgattgatgtgcttggccgtttgccggatggcagcgtagtgaatcagccgtttgacgcactttcagctttacaacagcaagcaccagagcatccttacagcaaagtcggacgcaaaaacagcgaaaaaggtttgatgtggttcaaacgtactttagacagtgcgcacgtccctttgcatcacgaacccgatggggccaaccactggcgcattaccccacttggcaccctaaaaaatacttggctgtcgcagccttttgtttacccttatcgtggtaatgccgacttttcacgcatcatgattgttgcgattgacggctatcgcgattttcaacctgcgatgctgcgtgataacctcgctcagcgccctgagcttgctaacacgccgatgctcacggtgaatgtttctatccccggctttgaagggttcagacgtaatcctaacgagctgcgctcgattgatattgcgcgtttgctgcgccaagaatcggcgtggaatgcattgtgcgatcagctgatgcgcgttgcgcgtcctgatgatctggtgatcatgcctgccatcatgggcaacggtgatggtttgcatttgatgagcaaactccaacaggtaacccaactgcgctttcatgaagtgccgactatgcccccatcactgctcgggatccgcattgaagaagcactgcatcgtagtttcatccaaggtggcggcgtgcaactcaagggagacaaagtgattggtggcaattttgcaggctctcgcctcactgctattcatactcaaaatctgcgcgatttcccaatcagtgccgaacactatgtgatggcgaccggcagttacttcagccaaggattacaagcctcacaacatgcgattcaagagccgatctttgcgctggacgtccagcaaaaccctgaccgcgctcagtggcgacatgcccaatttatcgccgcacaatcacacccgtttatgactttcggcgtcactaccgatgccaatttgcatccgtcacgccaaggcaaaaccattgacaatctttggtgttgcggcgcaatgctcagtgggtacgaccccgtgtttgaaggctgtggcggaggcgtagcgattgcaaccgcttatcatgccgtagaacagatccttgcgacttatgcgcaaaccaaacaaccggaggtgctgctatgaaccatgcctttattcactctgcaccgcaaaataccacctttgatcaatgcatcaaatgcacggtgtgcactgtgtattgccccgttgccaaagccaaccccaactatccgggtcctaaacagtgtggcccagatggtgagcgtttacggatcaaaagtgccgaatattatgatgacgcgctcaagctgtgtaccaactgcaaacgctgtgaaaccgcctgcccttcaggcgtcaaaattggcgatatgatcgccgtggcgcgtggcaaatacggcaaaaagccactcaaccctaaattggtgcgtgattttgtactcagccacaccgacttatttggctcgatcgccacgccgtttgcaccactcgtcaacgccgcaacctcgttgccattggtgaaaaagctgatgcacaaaaccattggcgtgcatgaccataaaaccttacccaaatattcgcacggcacgttccgccgttggtttaaacaaaactgcaccagccagccgctctaccaaaggcaagtggcttatttccacggctgctacgtgaactacaaccacccgcaactcggtaaagactttgtgcgagtgatgaacgcgatgaacataggcgtgcgtttgcttgatagcgaaaaatgttgcggtgtgcccctgatcgccaacggttttcacaacaaagcgcgtaaaaacgcgctgcacaacgtcaaacaccttacggctatggtcaatgattaccatgcgccggtgctttccacctcttccacctgctcgtttaccttgcagcaagaatacccgcatgtactaggggtagataacagccaagtggtggatcaaatccattacgtcacgcgttttctgctcaaagagtttatgagcggtaacgcgccgaagatgaaacccgtgcacaaaaaagtggtttaccacacgccttgccatttagagcgcagtggtaatgtgatgtttacgattgagctgctgaaaatggtccccggcttagagctggtggtgctcgacagtgagtgttgtggcctagccggaacctatggttttaaagaagagaactacgaggtatcgaagaaaattggttcgcatctgtttgatgcgattcaaacctctgatgccgattatgcggtgacggattgtgaaacctgtaagtggcaaatcgaagaaaacgcgcatttggaaaccattcatccggtgagtttactggcgatggcgctaatcgatgagcctagtgcttgagcgtgaatagccacttcctactagaagccaaaagctggacggaaatattaaacaatcaccactgctgaaagctgtggtttagggatgacagtaaatagggcaagtaaaacttgccctattgttattccaacattcagaaaatcattctgattgatgacgcttgcagtgctcaatagccttgctcaacagatctaacgcagtgtgatcacaagaaggcaattgcgcatcgcttttacccagaggcgttatccgctcaccccagcgaatatgacccgcaccccacgttagccctgcgccaaaagcggcgaccaacagatcatcatgaggtttgattttaccttgctctaacgcttcgcatagggcaatcggcaccgtagccgcggaggtattaccgtagcgatgaatattgacaaaggctttgtcttgcgcgatgcccgccaaatcacacagggtttgaataatgcggatattggcttgatgcgggatcaccacatcgatttcttcggtcgataaaccgctacgcgccaacacttgctgcgccgcagcccccatgccacgtaccgctcgtttaaagatctctttacccacgaaatcaaacgcccagtaaccattgtctgcatcaaaacgatccatcgcggttccaaacttaggtaccgctaaaatatctcgcccttgggcatcacagccaatttgcgcatcttgcaagcccactttttgttcggtcttgctcaataccacagcacctgcgccatctccaaacagcacagcagtgtcacgcttcgtccagtccagatagaaagagaggcgctcagcaccaatcaccaaagcatgacgataatggctcgcttgcatcaagcgtgtcgcggtttctaagccatagaggaaaccggtacaggcggcgttgagatcaaaggcggcagcagaaggaatgcctaaattttgctgcactcttgaagcaatattgggaattaacgaatccggtgaacaggttgccacaataatcaggtctatctcttcaacgctgacgcccgcacaggcaatggcatgctgagcggcaacggtagcgagatcggaagtattcacgtggctgatccgacgctgttcaatcccagtacgtgattgaatccactcatcggaagtatcaagaaaggtgctcaaatcgtgattggagagcgtcgcaggtggcagacatttaccccacccggtgatttcggcataacattgagtcataaaaattccgtctatgctgcttattgtaatttggcggagcgccccaagatattgagcaacgcccgtcgccattgtcggcaatgggcagaagtatacgccgattttcgaaccatggttaaccattgagcttaaactggtgacgaaagcgcaaaataaagagaggaagtcatgtcaacattcaatacccgctgcccatcttgccacagccttaaccgtgtgccagaagagcggattaccgaaagcccaaattgtggcaaatgccaaagtgcactactcgatggcgcgccaattgaaggtaccgaagccaatttttccgcgctgctgcaaagcgacaaacctgtcgtcgtcgatttttgggcaccatggtgtaacccttgtgtcggcttcgcaccgatttttagtgatgttgccgccgagcgtaaaggccagatccgatgcgtgaaaattgatactgaagcgcagcaaaatcttgctgcacattttcaaattcgcagtattcccaccattatggtgttcaaaaatggccaacgcatcgacatgatcaatggtgcactgccaaaatctcaatttgaccaatggttaaaccaagcgctgactaaataatcgcatcttactatccacaattaagttggcattttcgataaaattatgccaacttaactggcactttccccgcccttctcctcaacaagcaaagtttatcgtcaagaacgttttttttcgttttactctgcgcattattcgtcccatattcgcgccaactgttccttctgctgttcccgaggcctgctgtggaaatccattcttctgcaccaaaccgcattgcggtgcctgttattgcgttaactctgtatgcgattgccgcaggctacttaatgagcctagtgcctttaatgctgccgcattaccaactcgaatctgatttggccagttggctggcaagcgttttttatgccggattattagcgggcgcgctggttgcagagcctttcgttaatcgtttaggccaccgtaaagcctttgtatggtgcttgagcttactgcaactgtcgattgtggttatgccgctattgccctacgccagtgtttggcttttggcacgtttggtcgcaggtatcgccgtggccggtatttttgtggtggtggaatcttggttactgcatggcgatgaacaaggtcgcgcgaagcgtcttggcatttacatggtgtcactctatggcggtacggcactcggacaaatggcaattggccaactgggtgtggcaggtgccgtgccttttattgcgatcaccacactacttttgattgcttccatagtgctgatgtacgtcgattcggatcagccttccacgcagcaagctagctcactttcgttgcgtcagattttcaagctcagtaaagcggcgatgatcggctgcctcgtttcgggcctgacattaggagcaatttacggtttgatgccggtagaacttgccaaccgtggcattagccacaccgatctgggtaacttaatggcactggtgattttaggcggcatggcggttcaacctctggtgccttggctgtctaaatttttaggtcgcactctgcagatggcgctgttctgcttacttggcacggcagccatcacgctgaccgtgtttgatgattcgctgctcgtactgggcgttagcctatttattttaggcatggcgaccttcgccctctacccaatcgcgattaatttaggctgcgacaaattggatgcgagctacattgtttctgcaacccaagtgatgctgctcagctacagcgtaggctcggtggttggtccggtattggccgattgctttatgcaagatcgccacggcttgatggcttacttgtttgccatcctactcgcgacttgtttgtatatgctgatcaaaagcgtcaaaaccaaacgccaatgggtggcgggcgagtaaccttcttttagggcaagtttctatcactcagcgtgagggagagaaacttgcttttccgacccaagcttaatctaagcttcatatttgccccatacagtcatcataaaccgaatcattgatgtcactgtgaaaccactcaaacgctaccaatacgaacgctacgccgttttgtgcaacctcgcttatccgcgcatttttaagcagactcgttacggatttgatcctaacggacagcgtgtgatcaccaatcagtttggcaaaatcatgatccgagtattgtggagccgagcgagcgatgaggtagtcgttgtgattaaaggctcacacagcctcaccgactggctactcaacttcgcggtttggacacgcagttgccgccatttaggactgcaataccgcattcatgctggtttttatcacttactgcatcaagagagccaaccgagccgcaaccaagatacgcttggcatgacagtaattgagaaactggaacagaccctactgccgctgattgaacaaggcaaacgcattgcaatcactgggcattcttccggcggcgcgattggctgcgtgtttgcggactattttgagcgaaaatatccacgcacgatcaagcgagtcgtcacttttggtcaacctgcgatcggggattggcgctttccgaaatactatgggctggctcataaaacctatcgcatttgctgcgatctggacatcgtaaccttcatgccgcccgtgccatttctgtactggcatgccggaaaattactctggctgtataacggcagaatttacgaaaacacaccgacatgggagcgtttagggcgttcgatcatcagttggttaattagaccgttttcttatcacttgatgagtaaatacatccgcaataaagatttttttgatgaacgctagaaagagttttgtatcaacaagagagaaaataatggaggcgcgtcccggagtcgaaccgaggttcacggatttgcaatccgctgcatggccactctgccaacgcgcctaagtgatgtgtctttgaggatgatggtgccccgggccggacttgaaccggcacgactcgaaagtcgagggattttaaatcccttgtgtctaccgatttcaccaccagggcaacgcatactgcgatggaagacaccatctattctaacgagctttgccgtgagaacgaggcgtactttaacggattgagatttctggtcaataagaaatttcagcaatcaagtctgactgcgcaagatttcagccacagggagcaaaatgcactcaagccgatgtttttacaagcagtatcaaggagcttgagttcaccaagctcctcaaaaaatgaattatgcataggctccggcagcataatgcagctcataactatggctataaatttccaaaatattgccaaacggatcttccatataaatcatgcggtacggtttttcaccgggaaagtagaaacgtggcgctggcatacgctttttgccacctgcggcgacgattttctccgcgagcccttcgacatcaggatcttgcacacagaaatggaaaatcccggttttccaatattcaaaattgttctcaggattttgttggtttttaaactcaaacagctctacgccaatgcgatctccggttgagagatgcgcaatacgaaatcgctcccacccttgaccaaacacatcagtacacatttcaccaatcgcggagtcatcttccacaatgtcagtcggcggcataatcagataccagccaaggacttcggtatagaacttcaccgctgcttctaaatccggtactgaaattccaatatgggaaaacgaacgtgggtatgtgctcattatgattctctctttacgattcaaaacaaaagtagatgtacacggcctacttgaagcagcaaaggtgtgggctgtaacttcaagtagctttggtatcgaaagaataaatcggcgttgaacagaataaaaattatcgtttatcattgtttcaataataatttgttatcaaaaatcatgctcaacccaatctggctacagacattcaaaaccttggtcgatactggtcactttactaaaaccgccgaaaagctgtttatgactcagccgggcgtgagtcaacacatccgaaagttagaagaggcgtgtcaacatccgctcattcatcgtatcaacaaaagttttgaactcaccgaccagggacgcatggtgtatgaatacgccacacaacttgcaaaaaacgagcgcaggctcttagaacagatccacgaaactgagccgtttgctggccgttatcgaattgcgtgctctggctcgctctcgctggtgatttaccctccactgttagcgctacaacagctgcatcctaagctgtgcatcgagcttgaagcggcacccaatcacacgattcttaaagccatcaaagagggagatgttgatgtagggattgtgacctcacaacccagccaaggtgtatttgaaagtgaggtgttaggggaagagccgctataccttgttctacctcatgatcacccaacagagcctgaccaactcgcagatcacctacttcagctaggacttattgggcaccctgatatcgatcactatttttcgctctatctcgccaaaagtaccaaccttacattaacggtgctgaatagcgaaagttttcctcgatcgggctatgtgaaccaaattcagcaaattttgttgcctgtcgcgaaaggcttggggtttaccgttttgcccaaatctgccgtggaaaacttcccgttacgcgagcagatcagcgtttttgaaaacccagctccggtaacggaaacgctgtatttggttaagaaaaggcagcgcgatttgccgcagcgttttgccgacgtcagccagcaattaaaagagtgggttgcgcactatacgcaaccctgatgatgtgatgtgaatcaataattaagccagaggcgtgaactggcgagtgagcctaatacgcctcaaacgctaacgcttttttctcgatttggcggaagatcagggtcagaatgccgttcactgcaaggtaaaatgccccggcaatcccaaagactgtcaacgtatcgtaggtttgggcgttgatgcgctgcgcgtagcccatcaaatccataatggtgatcgtgctggccagcgaagtgcctttaaagacaagaatcacttcgttggaataagcaggcacagctctgcgtaatgcataaggcagcagtactcgcagcgtagcgattttattcatgcctaacgcgcggcacgcttgccactgtccgctaggaatggcgttaaatgcgcctttaaacagttgcgtgctgtacgccgcagtgttgagcgccaaagccagcatagcgcaaaaccaaggttggctgagccatacccaaagtacgctttcgcggatccattcaaactgtccagggccgtaatacaccaagaaaatttgcaccagcagcggagtgccggtaaacaaggtgatcaccgcacggctaaaccaatgcacgacgggcgtgcgcatcactaagcttacggtcatcaagagtgacaatatgcaacccaccagcagcgaagctgccgtcagttgcaaactggtgcctaagccttcaagcagttgccataggtgttgctctttcatgcactggctccttggctatggctcatgccttgtatcgaaaacttgttatctatgacttttacgacgcgttgtgtgatcaatgtgatcaccagatacaccaccgccgctgttgcataccacgtaaaggcttcatgggtggccgcggaagtgagctgcgcttgtttcagtagatccgtcaccccaatcaaagaaactaacgccgtatctttaagtaatactagccattggttcattaaaccgggaagtgcgtggcgtaccgcttgcggcagcacaatacgaataaatgcatggctaggcggaatccctaacgcgctggccgcttcacgctgtcctctgcccacggctttgagtgcaccgcgcaacgtctgcgaagcgtacgaagcaaaaatcagcgagagcgcaatcacaccagagataaacgggctgatctcaataaattcaccagtgatgaaaaacagcacttgggtcgagccaaagtagataaacagcaccaccaaaagctcaggcaaaccgcggatcacggtgaccaacaaggtggttggccatttgatcaatttcagttttgccatttcaccgccagcaaacaccagtgccaacagtaaaccgaccagcaagctggccaacgcaatttgtagcgtcatccagcttgcttgtaccagtgataaagagtagcccgttaacaccatcttagtttccgaagtacttattgaagatcgcggcgtattcgccattttctttcacggcttccaacgctgcgttaagttgatcaagcagcgcttggttatctttattcaccgcaataccaaagccattaccgaagtactgtgcattcgtgacacgctcaccgacgtaagcgaggttgttatcccccttaaaccactccgcgacaacggccgtgtcaccgaataccgaatcaatacggccatttttcatatcgatgaacgcatcttggtagcttgagtatggcaccgcgaccacgtccgacagttgctcaagtaggaaactttggtgagtcgagccattttgcacaccaacacgtttgcctttcagcgccgcttgatccgccactttgcccgccagagaaacgaaggcggctgagttgtcgtagtacggattggagaaatttacctgctctaaacgcgcttcggtgatgtccattgccgaaatggcggcatcataacgtttgaatttcagtgctgggatcaagctgtcaaacgcttggttgtggaagctacatttcgcttcaagttgcttacacagcgcattggctaaatccacatcaaaaccttggatttggttgttctcatccatgtattcgaacggcgcgtaagtcgcttccatcacaaacttgatctcttgttgcgcagctgcgctagcagaaaccaaaccaatcaaagacgcgagtaggatctttttcattgcaatactccatgtgttctgcgaaatctggcgcatcactggccagaatctgtgggctaatatcagtaacttcttaatgttttaagtaatcggcaaactgctgagtctgcggatgggtaaaggaggcgtgcgtgccgtgttcaacaatgcgccctttttcgaggtagagcacatggctggcgattttcttggcaaagtcgacttcatgagtcaccaccacttgcgtgatccctgtgccacttaactctttgataattttcacaacttgattggtgatctcaggatccagagccgctgtcggctcatcaaacagcagtacatccggcttcatcatcagtgcacgcgcaatcgccactcgctgctgctggccacccgagagttgtagcggccacgcatcggctttatctgccagttgcaacgttttcaggatctcgatggcttgctgtttggcttgcgatttcgccatacctgcgactttcacgggggcttccaccagattttccagcacggtcatatgcggccataaatggtattgctgaaacaccatgcccactttgcgacgtagcgctaagccttgctgttcagtcggatgcgttgagaaatcaaacgattgattggcgatatgcagttgaccgttatcggcagtttcaagaagattgagcacacgcagcagtgagcttttacccgcgccactagggccaagtaacaccaaagtttcaccactcgcacattcaaagtggatgtcgtgcagcacctgagtggtgccataagacttgttaattcctttaactcgaatactcatgcggacatactgcattaattatcatctggcgttcatactactacgaacgtatttttatgcaataaaaatgtataaaaaccaaaaccacagactatttgtataaaaaaacgtcataagaatagcaaaaacgactggttaaaccacaaccaaatgcataaagcgtgataagtaaaccggaaatactcagtagggagcgatgagatataaatagaatatagagtggggactcgattgaagaaacgcagacacaaaaaaaccagcacttggctggcttaagcgatgacttcaaaagaaatggaggcgcgtcccggagtcgaaccgaggttcacggatttgcaatccgctgcatggccactctgccaacgcgcctctgaagtcaaacgaaggatttgcttcgttgcttacgctgcgtactttacggattatgcgaactgagtcaaacaaaaaaatgaaatgccggatcgtttgctgagatttagcgcaatctgctcaactgaccgccgcaagcaaaccaacctattctcttctgatttgaagcagcagtggcgttgacgacctgctacttcccgtcgttgggtatgaagcattcaagttaccacttcttcattagccgcccaaccaagctcggatgatagctccagcagtgatcaaacatactcatcaactgcgggttgccgtattttgataggcttatggcatgaaaacggtttttgcgcgttttaagttccgccacttgcgccagcagttcgtcactttgtttgggtgcaatgaaatcggacatcacaaccaaatcgccattgcgatacttatcactgctcatgagttcaatcgatttgaggatcacgggctcaaaatctgtaccgccatgaaacgaataacttaagaaatcactcgcttcgcgcagcccatcttggcgagtcaattcgtaggtaatgaactcggaagaaaacagcatcacataacaatcacgatcttctgccaacgcaatttgcatcagcgcgtaagccatggctttggcacactgctcgggaaaaccactcatggatcctgaggcatcaatacagagaatgaacggccctttttcgatatcaacctgtttgttgtcaggacgatgggcacgcaccttacgcagagtgcgtgatttcccctgcatgcgatagttcattaaccgtttatcgaccaagtgcttataaaacaccacttccagctctggataagctaaaaacatggtttcgttgggcagtagcttattcaaatcgtcactttcgtggatacccacaatgtcatcggtcgcttcatctgaacgctcttcgaccatttgcatctcttcagcgggcgcacgatttaggtccggatcgtcaacctgtccagccattcgcccgagctgctcggcgatttcctgcatgcctttgtgttttttgagaaactccgcgtaacgcttcatgaccgtgaggtcattgcggctcaatttcgccgccgccatatcccaaagtcggccgacgatcgcttcatcccccgcttcagtgaccttatccatattacgcatggtttccatacgctgatagagatcagccaacatacgctctttgttggctttaagttcgatcacctgcgcttggcgaatcgcatcagacagtgatttataccactgatcacaaaagaaatgagggaacatggggttatgatgcagcttctctttttcgagcaagcggcgcgcttctaaatagaatgcggagtcccattccagtttcttcaccacgtctggaacttgcgtaaaaaacgtctcttcatcccagtgaatcacttcttggtagagggctaactcacgttggaaacgttcagtttcacacactttggtcattcgacgacgaacgctggtgcgccacttgatcagatgatttttcactgacgtgcccacaccacggttttccgccatcatcatcacttgggagcgcgcaaccaagtcattgacggcggtatcaatcaagccagattctgctatggcaacaaccagattaaacgcatccgcccctaacataatgacacctaagcaaaaaattggttgaggttacgaatgcgcatcacgttacgctcgcattcaacttgagtggcatccaactgctgctgcagctcatgcaaggtcgcttgcattgccgttggcaattcaggatcgatgaaactgtgcggcagcgcatcgtgaaatttgaggcgcactttacgtaaatggtgctccgcatgagtgagctgcgccatggcttgatccgctttcgtcaaccaattctgatacagcgactcatctaaaccttgtttggtgaccatcgccagaagtacggagcggttggcaatatctttaatcaccaagttgttgctggcatcaaggtcaaaacgtaagcgacatagattggtgttttggttcacatagccataggcttcgccgtgcccttctttaatcacgcgctctaattcacttttctgtacgtaaatccaacggctatcgcctttctcaccttcagaaacagacatattgctctgcaataacactagcttaatcaaatcaggcgtcatgcccactttgtaaattttggcatcagacaggtcatattgatgatgaacttgttttttgattaagccattggtggtttccagtgacagtaccatggcaaactcagactctagctcttcttgaatttgggcaagttcaagtcggcatacatcgagctgttgctccacttctgcttggtcaaaggcgtaacgcagcgcaaattcgcggatcacctcatgcaccacatcatgtgattctggggtattccacaaacagttttgcagcagcagtagatctaatgggttaatctcgtctcggccattaaaaaatgcactggctttcaaaagtttggccgcttttttccaacggcggtcagacacatacatctctaaatctgaacccgcgctctcttttgagcgctcttcaaccatggttttcaactggtagagcttttcgaaaacgtcatcactgagttcaagcttatccagttgctgctgccattggtgatactcttcatcggtgatcgccagccctgctggaatttgcgcttcttgcgctgtaccaacggtaagcatggatttgaaattttgtttgttttggattcgatttacaaaaattcgtaccagcatacggtcatagagtgcttcgaggccgctgtcttcgtctgggagttcattggaggccgtcaccaagagacgcatcggtacgcgctcaatatcgctgccatttttgaaggttttctcgttgacaaccgttagtaaggtgttgaggatggcaggtcccgccttccagatttcatccaagaacacgacctgtgcggtaggcaaataaccttgggtgaggcgcacataacgaccattgtctttcaattcttgaatactcagcggcccaaacacctcttcgggggttgaaaagcgggtcatcaggtattcaaaataactgctgttatcaaatgcttgaatcaaacgcttagcgatgaggcttttggcgatccccggagggccgagcaaaaacacactttcaccagccaaggcggtcaataaacagagcttgatggtattttcacgctcatacacgccatcagagagcgccttggccagcttattgattcgctctgaaagcagcgctttgcgcgcatgtgagctgtgggtgggttgcagcatctcttgattcctcagacaaagcccaaattgggtaacacgttttcaataagcactgtttctataaacaatagctctataaacaatcgctctataaacaatagtttcaataaacaatcgctttatacaattgttgtcgatttgttacaaagtctattttttgttttgcgcatccttataacagatctcatttccttgaaacaattggtaatcattgattgcacatttagcggctcaacttctcgccatttccacagacacgacgcaaaaagtacaatttattcttggggatgccactgaacctaaggtaaggtgactccctcatcaccgctttattttgacaagacacactccatgagcaaaatcatccatcaatggaaaagcatcgcactggtcgaggaggacgttttgcttccgaatggccactcggtcacacataccacgatttcacaccccggtgcggcagtgattttgccactgactgaccaaggcgagattgtcgtgatacgccaatttcgcccttcgctcaaaaaatggttactcgaacttcctgctggcactatagaagagggggaaccgcctctttcctgtgcgcagcgcgaattggaggaagaaaccggctttagcgctcagcaatttatcgaactcggtcaagtcacgccgctcgcgggtttctgcgatgaaattcaacatctgtttgtcgcaaaaaacctaagcaaaacggcgcgctattcttgcgatgaggacgaagtgattgaagtcctctttcttaccccacaagaattagaacgtaaaattgttttcggcgacatcaccgattccaaaaccattgcttgtttaagtaaagccaaactttgcggatatttgtaggagaaaatatggactttcgatcggataccgttacccaaccgaccgacgcgatgcgtcaagcgatggcacaagcccctgtgggtgacgatgtgtatggcgatgaccccaccgtcaacgagttagaacagtgggcggcagagcgccatggctttgaagccgcgctgtttaccacctcaggcactcaagccaatttgttaggtttactcgcccattgcgaacgcggcgacgaatatttgtgtggccagcaagcccataactatcgttatgaagctggcggtgctgccgtacttggctctatccagccacaaccgattgacaatgaaccggatggcacactcgatttcgccaaactcaaagccgcgatcaaaccggatgatgcacattttgcccgcaccaaactgctcagcttggaaaacaccatcaatggtaaagtgcttccactcagttatttggcgaaggcgcgcgagtttgttgatcaacatggtttgcaactgcaccttgatggggctcgggtctacaacgcggcggtcgcactggatgtggatgtcaaagagatcgcgcaatattttgattcgatcaccgtgtgtctatccaaaggcttagccgcgccagtcggttcgttactgctcggttccaaggactttattgccaaagcgagacgctggcgaaaaatggtcggtggcggtatgcgccaagcgggcattttagccgcagcggggaaattggcgctcaccgagcaagtcatgcagctcaagaccgatcatgataatgctcgtcatctggctttggggctgaatgctttaccggggttttcggttaataccgaatgggtacagaccaatattgtgtttgctaaattggactcgacagtcgatatccagtccatcgcccagcaacttcgccaagcaggcattatcatcaccgcgggtaatccagtgcgcttcgtgacacataaagacattacacgtcaggatattgataccctactcgccaaactgcgcaccttactggcttgagtgaagttgagaatgccaacaggctcctaaactctctttattctcgctcgcgacctcttgagcttccccttaggggaagctttatactccacgccactgatttacaccctcttgtttggagtttattgatgcgcgttgtgtgctctctgctttgtttaacccttgtttcgactccgcttttcgccagtggcgacccggtactcggtaaacaaaaagcgccaagttgtgtgttttgccacggcaccgacggcaaagctactcaggtcagctatcctaaccttgatgggcaaagcgcagaatatctgtatagcgcgatgaaggcttatcaactaggtgagcgcacaggcccaatggcggagatgatgagagctcagttgcaacgtttaaatgatcaagatttgcgcgacattgctgctttttatgcctcatcccaatgagtttttcccaaaaattccacttttaagcacaagagtcatgaaaaatcggcgcagatctggtaaaaatcgggacgtctcagtgaccgttatacattaggttgacatgattgaaaaaaaacaggggcgtcgtagtgcgcaagatgcccaaaaaacgcgttatcacattatcaccattgcggcagagctgttctgtgagctcggttattcacgcgtttctctgcgccatatcagtgaaaaggctggcgtctcacatagcttgattcgtcatcatttcggcagtaaagaaaagatctggcacagcatcagcgatggcctgcatgattatatgattcgctacatgcagacggtgctccaagccatgccagcagaaactcccgtcaatgtaaagctgtacactttcctcatgcgcatgttggcacatggcttaatcattaaacagccaatccaattgattgcggatgccgtacgccaagaagataaattattcgattatttcctcgatacttctggagagattgaacgcttggttgaatccttggcggacgactacaaccgtcagtacccccaatctccgatccatttgtgggaaatcaaatggcagctgattatgtacactcacagcgccgccagtttgacgccttttatgcgtgcaacttgggccccggaaattgaagacgtttccgcctgtttactcaaacattggcagttgtttaacgctttgatggttgagaagtttcatgtcgccaagccttacattatgcagcccaactcggtggatgagctggtgtataccctcagttgcgactggcgagatgtctataaagagacggaagagtaataggcgatgtgagctatccccttccgatgcactatttgcgatgtgctgtgattggggatagcaaacgggatatcgatgggtgctacttattgaccctacttaacgcgcttttttaccgcgctgcgcatggattttcagttgtgcttttagtttgcgtttttctgacgaacggccagccgagcgacgcggtgaattttcctcatgcaccacagggctaggctcaaaacctttcaaccattcttgaggaagacgtgtattgagtaaacgctcaatcgcttcgagttgtggctgttcatcatgcgacagcaaagagaccgccaatcccgctaaacctgcgcgtcccgtacgcccaatacgatgcacatagtcttccgctttaaatggcatatcgtagttcaccacttgctcaagctgggcaatatctaacccacgtgcggcgacatcggtcgcaatcaaagcacgcactttgcctgctttaaaatcatccaaagccttttggcgtgcaccttggcttttatcgccattaatcgacaccgcttttataccatccaacttgagttcttccgcaagtgcatcactgccttgacgggttttggtaaacaccaacacttgctgccaatttttcgagccaatcagataagagagcagttcgcgtttgcgctttttatccaccggatacaccatctgctgcacggtttctgccgtggaattggatggcgtcacctgcacttcgataggatcacgcatgatgcgatacgccaccgctttgattttgctatcaaacgttgcagagaaaaacagcgtttgacgcagtggcgataaacggcgcagcacgcgctgcaaatctggcataaagcccatatccagcatgcgatccgcttcatcgagtaccaacacttcaactttgcccaaaaacagcgatttcacatgggcgtgatcgagcaaacgccccggcgtcgcaatcaaaatatccacaccaccacgcaaatgattgagctgtaccttcatgctcgtgccgccataaacggctacgatcttaagctccgttcctttcgcgtaggcttgtaggctatccaatacttgctgagctaactcacgcgttggcaccagcactaacgcccggatctctttgctgtttgcttcacgctgccaaggctgctcaataaagcgttggatcaaaggtaagccaaatgccgccgttttaccggttccggtttgcgcccctgccagtacatcttttccttgcaatacatgaggaatagcttgctgttggattggcgtgggattggcgatcccaagctcgctcaatgtattcagcagacgagaatccaagcctaattgcgaaaaagtgatggagagttctgacatgtcgcgtacctaataacttttggggcgcggattgtatcaaagtgaacggcgtttggctttctctaaaacatccggatacagcaccgcaaacagtgcttgtaactcggtgtagttgtcctctaatccctgcgcgctataagccaaaggctgcatgcgagggctgcgctgcgccatcttgctcaacgcatagcgaatattagccaactccgcataggaggctaaccattctccttgccacatagcgcgattcactcgcacaaaacgctcaggcagcgccgatgtactttcttcggctatcccttgttgtgcatgagtcagaaactgccccaagggctcggcatgccaattcgaccaagtattgactaaacagtgatcccaaaacaggtcgagggcaatcggcgcaaagcgttgttgttgggaaggaaacagagatttcgccgctttcatcactgggtggctatcggtgtaagcatcaacccagcgatgtaaacggattccttgcactaaagattgcgggtactgctctgtcggatcacctttgacaaaatctcccagtaaattaccgagtaagctactttggcagtgatgagcaatatgcaaatgggcaaggaaattcatgggataagagattcggtgttacaccgagatgggagattatgacgcagagacgtcggtttgctctgattcaaccgcttggtaatcgctgagcgtaaaaccaatctccatcgcatcaagcagctctagacattcatcattgtgattgtggtcactcattgttgacctccttaattcatacttatttcatccttttataccctttcgacttgaaggttcagcttcacgttgaatggggataacggtttctggtgagacgttcatcgtaagcgcttccagaaacgccaataaggtttaccacagcttgtagtaagtaccaaggtttctttgtggtaaaaacctcagccacataaagtgtaaattattaattacagtttcggatttaaatttttacaaacagattgacgcaaatcgaaagcttctacagaatagccaaaaattagcgaaatgagattattagtcggtcaaatttcgcacaaatcactaagcacaacatctaataatgtataaaagagtttacacatgacgcaatcgaagcttttaggcagtactttgattatcgcgggcaccacgattggtgcaggaatgctagctctgcctctagcttccgccggtattggcttctcaacctcattgatgattatgctcggcttgtggatgctgatggcatttactgcattgctgatggtagaaatccaccagtacgcggataaagaggcaactttgcatactctcgccaaacagattttaggcgataaaggcaaatgggttgcgacgttcgctatgttatttttgttttactcgctgtgtgcggcctacattgctggcggcggcgcacaatttacccaacgaattaccgatttcactggcgtgaacgttgaaagttcgagcggtactttgctgtttaccttgattgtcgctttggtcgtcaccgttggaacaggcacagtggatcgcgtcaaccgcgtattatttgccggaaagatgatcgctatggtagcggtactgtttttcctcgcgcccaatgtttcgcagtcttacctactgagtatgccgattcagcagggcttgattgtcgcggccattcccgtcatttttacttcctttggtttccacggcagtattcctgcgattgtgaattacttggatggtgatacccctgcgctgcgcaaagcgattttgatcggctctgcgattccgctagtgatttacattttctggcagttggtcactcttggagtagtaagtcaatctgccctactcgacaatatggggctcacagcgctcatcggtgtactctcgaccacggttcaccaatcaaatcttggcaacatcatcggcgtattcgctgaccttgctctactcacctcgtttttgggtgttagtctaggtttgtttgaatttatgggtgattctctacgtaaccaacaaggtaaaatgaaccgcccattagcgtctgtcgtcaccttcttaccaccgctgatttttgctctgttctacccgcaaggcttcattatggcgctgggctatgccgcgattgcgctcgccattctggccatctttttacctctggtgatggtgatcaaagtgcgccaacaagccactgagcaacactatcaagtcacagggggcaatggggctctgcttgtgacaggtttggtcgggctgctcatcatcggcgcacagctattgattacgttaggcatacttcccgctctcggttaaccctaacgctccccttatgacttaagtagcgtttaaagataaaagcagattttaagggcgaattggcttctattcgccctatttttatgcaactcgacttcttgatgtgaatctcattattgaaataatcctctcttattctttcatttttattgaacatgaatctcacttttgtcacttgaatatgattaacttgtgccagctatttttgctatgcaggagccatcatgagagaagttcaattcaggacgattgaccgagtgttcattcgcatgtcgattaacgacaaaatgtgggtgatctttttactgtttttaagcgcaatcaccacaattgcaggtatgcgctattggcacacccttgccagcattgagcagcagtctcaattggcagtggaatacaaattacaagggctactcaaccatcccgaccctagccaactttcagtactgaaagtgcaaaatcgcgtaagcgacacgatctattcacaaggtgtcgtcacagctagtgccaccagcgcaaacggtcaggcctatgcctatacggagtcaatgaaacagtatgagcagccggctcgcgagcaagccctgcgcagctttttactcacatatttgtgggccattccttttgccattttcacttactgggtcgcgacctttattggtggtgccttgtgggtgctttacaccaccacccagaaaatcgctgaaggcgatcttacttcacgactcggtttccatcccggacgtgatgagttcgggacgattggttgtgcgctcgataaagccatggatacacttgcagagctgattgtggccgtaaaacaaaacagcgccacactgcgtgacaccgcaatgacttttgctcacgaagtgaaagaatcggaagtacagattcagaatcaatacagttcgctcgattcggtggccaccgcgatggaagagatgacggcttcagcagccgaagtttcgacgacctcacagcgtgccaccgaacaaacggaacaagacaccaagcaggttgaacgcagccagcagcgagtgagaaaagcgattcaagatattgaacagctctcacgttacatcgcccaagcgtcatcctcagtcgaaaccctcaacaccaatgcaacgcagattaatgcggtgatcaccaccatcaatgccatttcagagcaaaccaatcttttggcactcaatgccgccattgaagcagctcgcgccggtgaacaaggtcgaggttttgcggtggttgccgatgaagtccgcactttggccagtcgcactcaatcggccacggtggaaattcaagccatgattgaaaagctacaggtggaaagccaaaacatcgccaagcttaccgagcagacggtgagccaagcacacaccagcagccaattggtaagtgaagtgggtaacgatgtgcaagccatcgcgcattcggcgcagcttatcaatgatctcagtgtgcaaatttccacttcagccagcgaacagagctcggttgcccacgatatttcatccgaactaagtgatattcgcagccagtccaacacgctgcgccgtgttgcagagcagacgtcgcaaggtgtcagtgaaattactcaagcgacacgcaatttaggggaaatcctcgcgcgctaccgcacctaatttaggtttcaactcagcgatgcgcataagcaaacgcccatcaatcatgatgggcgtttgtatagcaacagtcactaatgactgtttaagcttctgggtaaccttgcggattattcgactgccagcaccaagcatcctgagccattgtgtgtagattacgcgtcgctttccagccaagatcctgcgcggctttcgtaggatctgcccaatattcagcgatatctcctggacggcgatccaccagtttataagggacagtacgacccgaggcggtttcaaacgctttcacaacatccaagacactataccccttacccgtacctaggttgtagatatgcagacccgcacaagtgccgacttttttcaatgcagcaatatgaccatccgccagatccatcacatggatgtagtcacgcacccctgtaccatctttggtcggataatcgctaccaaacacggaaagatactcgcggcgccctaccgcaacctgagtaacaaacggcatcaagttattagggatgccttgtggatcttcacccaactcgccagagggatgagagccaaccgggttaaagtagcgcagtagcgtaatactccagtctggattggctttttgaaaatcggtcaaacactcttccaccatcaatttactgcgcccatatggatttgcagccttggtagggaaagattcagtaataggtaccgaggtaggttcaccatatacggttgcagatgagctgaacaccagcgatttcacgcccgcttcacgcatcgccgccaccaaaactaaggtgccattcacgttgttatcgtaatattcgagcggtttttgtacggactcacccaccgctttgaggcccgcaaaatgcacaaccgcctcgatgttatgctgttgcatgagatcaaccagcaaagctttatcacgaatgtccccttgcacaaactgagggcgaacaccaatcactttttcaatacgatcaaggaccgttactttactgttgtataaattatcgaggatcacaggggtcatacccgcttggatcatctgaatacaggtgtgactgccaatgtaacccatgccacctgtaaccaatactttcatgcctagcctccttcatgttttcggcgattgtaacggcttttcagcgatcgccaaaacattgatgcctctggatttaaaaacaggctctactatacctgaagcaaatggatcaaatctgcgatccagatttaagctcttaaatatccccttgtggcgaaaagaaggcgagaggcggacaatccggaacatttgtggcatcgcacttaattcagaatgctccaaaacacgcaaaatttattgaccaaaccctaatttcggctgacgaaatcactctttttcgctactttagcgggcagagtttacagaaggatgtacatcagtgagcaaacggacaatccaactcaattgcgatatgggcgaaagcttcggcgtctggaccatgggggccgatgaagaagtgatgccttggattgatatggccaatatcgcttgtggctttcacgcgtccgatcctcatgttatgagccgtacgatagatttagcgcttgagcatgaagtgatgataggtgcccatcctagctacccagatttgcaaggatttggtcgccgctcgttggcgatgaatgagcaagaagtgagtgaaatcattctttaccaagtcggcgcactgaaggcgctgtgtgaaagtaaaaatggccaattgagctatgtgaaacctcatggcgcgctgtataacgacatgatgagcgacccgagcatctttcgtgcggtggtcgatgccgtttcctgttttaacctgcctttgatggtgctcgcttctgccaacaatcaagactatctcgatattgcggaccgttttgatgtaccactgctgtttgaagcttttgccgaccgtacctatctcgccaatggcaagctgacaccgcgctcacaacccaatgcggtactcagtagcgaagaagccattctcaaccaagtgcgacaaatcgcccgttacggcaaagtcaccagttctgatgggttcgtcatcccgattgaagcggatactttatgtgtgcacggcgataacccaaacgccgtgtcgctcattgccagaattcgtgctgcgttggatgagtaggccatgtccatcacgtttgaaattgagccgattgcggaaggcagcatactggtgcgctttcagcatccggctgatgcaaccttagcgatgcatattggccaatgtgcgcatgacatcatgcagagtttggcctatggactgatgaacgtcactccttcttacaccaccttgctgattgattatttaccctaccgtctaacacaaaaggagttggtggcgcagttgactttactgcttaatcaaccgcgacagtccaaccacgcgaacgctaatctcattgagcttcccgtgtactaccatccggatgtgggacttgacctcattcgctatcaggaacaagggcttgcattagcagaggtgattcagttgcatacctctgtgacttacacggtggcggcgattggctttgctcccgggtttgcctttatgactcaagtcgccgagccgctgcgccgccccagacgcactaccccgcgcctaatgctccccaaaggcagcgtagggattgccgagcaacaaacggccatttatcccaacgcctctccgggcggctggaacattatcggtaactgtccgcaaaccttgtttgacccgagacaagagccgatgtcaccttggcagattggcactcaagtgcgatttcgctcgattgaacgtgatgagtttattcagttgggcggtgtgattgagccgtactcaatccacagagcttaagatggccaacacccagagctgcctcagataacagcagcctcaggtaacagttacctagggtaacagaggaataggaataagaagggaatattttccataaggaaggaacatgctaggtaagctgcacgtgatcaaagcgggaccactcacgctacttcacgacttgggtcgctatgggttcagtcatttcgggatcaccccttccggccctctcgatgaatacgcctacagctgggctaaccatttactcgccaatcccgtcaattgcgccaccttagaaatcacgctcggtccagcggaatttcttttacgcagcgacgcgcaattggcgattgccggtggcgatctcaatgccacgctagacggtcgccccatcgccaattggagccgattttatgccaagcaaggacaaacgctgcgctttggtttaccacgcaacgggctacgcgcctatcttgcagttcaaggtgggtttacggtctctccacaactgggctctgtatctacccatgttcggcaaggcttagggggactaacgtcgcaagggctggcgctgcaaacgggtgatgacttagtattttccgcgcagcagattgcccagaaaccggtgcagatgacgtttcgctttcgacctgattacaacttacctctgcgactgcgcgtgattgagagttaccaatatcaagcgttttcaccatccgcgatggaaagcttctaccgcagcgagtttatcgtgaccccaaacagcgatcgcatgggctatcgcttgcaaggtgaaaccatatcgccaccagatcaagccattctctctgaggggattgccttgggggcgattcaagttccgccgaatggtcagccaatcattttgctcaatgatcggcagaccattggcggttatcccaagctaggttgtgtggcgagaatcgatctgccccgtttagcgcaagccaagccgggacattccgtacggtttgtcgctggcgatctcgctgggcttcaagcggtgtggtgtcagtgggcgcgatttttcggttactgatcctttccgttttttgaaacttccgtttttaaaacttccgttattgagactttaaagcccatacaccttggctaacgcggcaggataaccacgcgcgtggcataagcgtatcgcctgctgctccacctgctgcgcagtgaaggccatactgcatggatgctcagtctcaatcgatagctcaccagcatctggcttaagttgccaaaccgcaaccaattggcgagcggctctcagcgccgatgagcctttgaccacttcgagtctcgcgtactgattggcttcaaaactgacgtccgccgcacgcagtgtcacatcgtcaccggggatctgctgcgcaccaaatagcggtttgcccgcaaactccgcattatcaaaactgggcacaaagcggctcatatgctgtatcgcacgcacagtgcgctcttgctgcgccgacatcggccagccacgctcaatcttgtgttgcagatacaaaggcagctgtggctgcgcggatgtcggagtcgaggcgaccaaaccatccgcaaacaaggtgatggattccgtcatgccatgcagttggaacgtgccatcggcataaggggtaagctgtgccatgccatcttcgctaccacgtgggccatggaaaatcacttctggccaccactgatgacatgcaggccagtgagtgacatacgccgctttaaactccaccaaacgttgtctgtggtggcgagccatatcgtccactcgtcctgtctcaaaaccacaagcattgaccagataatccacagtttgagtatggcgctccccttgcgcatcaagataagtcaatcgccactggttgtcttgaaacgtggcatccaccagttcagtgcgcaacatcacttggcaattgggtaaggcttcgagagtcagatcgacgctggccgctaagcgaaacacactccaaccgtattcttgaaccaacacgacagggtatttgagctgtgcaagatcggcatgctgagcaaacggaatcacccactcatcatcgctttgcggtggattggcttgttgctgctgcgccaaacgctctaactcttcacgctgatacaagcgatagtaattatcgactgcgccaagcacttgattggccgcatcttgctccaccaacttacgatacgcgttttgaatggtcactaagcgcggcagaatttcttcgggttgacccggatcggattgcgggatagcaatcaaggttgggcgaacatttaaagtgtgtggataaaggcgtaccgtttcaattgactgctccaataggtcgatacactgctgctcggaaatttctcgatagagattgcccccggcatgcagatgacaaatcggtggcccactgactaaaccagcacttttttccatcaggacaacattgagtcccagctcacccaaatggacggccgccgtcgcaccagcaataccgccacctatgatagcaattcggggatcttgagatcgcaatgtcatattttacctactgttacatcaaggctaagaaatgtggtcgccattctaaagggtatgaaacgttaataaaatcacattttttacgcggacttatcctcggccgatcactcaatcctgaccaaacaggtcacgggtgtagattttttccgcgacatcctccagctcagccacccggcgattggtcactatcacctcggccatcgctttaaactgggcaagatcgcgaatcacaggtgagccgtaaaaggtcgattcattgagcacaggttcgtaaatcaccacttcaaccccctgtgccttgattcgtttcatgatgcctaagatggatgaagctcgaaaattgtcagagcccgacttcatgattaagcggtaaataccaaccactttcgggttgcggttcaagatggaaaacgcaatatggtctttgcgcgtggtattggcatcgacaatcgcacggatcaggttattaggtacatcctcaaaattgcgcagtaactggcgagtgtctttcggcaagcagtaaccaccataaccaaaagaaggattgttgtaatgattaccgatgcgaggatctaacccaacgccttcgatgatctgtttggtgtctaacccatgggtttccgcgtacgtatccaactcattaaaaaacgatacacgcattgcaagataagtgttcgagaaaagcttgaccgcttcagcttcggtcgagtgagtcaacaaaatcggaatatccattttctttgccccctgagccaacaaggttgcaaacgcttggccgcgctccgacttttccccaacaatgatccgagatgggtataagttgtcatacaaggcacgcccttcgcgtaaaaactctggcgaaaagatcaggttgttacagcagagccgttgtttgatgcgtttggtgtaacccacaggcacagtggatttaatcaccatgatggcctgtggattgatcgccaacacatcatcaatcaccgcttccacggttcgtgtatcaaaatgattggtttgtgggtcatagtcggtaggcgtggcgatcacgacaaactgtgcgtcttggtaggcgtctcgtttatcgcaagtcgctcgaaaattaaggggttgatgctgtagaaaagattcaatctcgggatcggcgatcggtgaaatcttatcattgagctgctctactcggctgaccacgatatccaatgcgaccacttcattgtgttgagcaagcagtattccattcgataatcctacataccccgttcctgcaatggcaattttcatggcggatccctttcacttgatgccctttctcccgacccaagcggttatcgggagagattcaagttttaccatgccatagaaaattgacgatttagtgactgcaaagggcttgcctaatttgaccttaagtaacaaaaacaacctgtaacataaggttttttgatcaaacgcactcatggctcacaaagcggatttttagccgaaaaaagtcaaaaaaacgcttgactgagatttgccatttttcccttttcaccactttgtgaataaccgatcctcgcaaacctcggccactacggggctgacaacccaacccccttcatccgctactttacttatcccaaaagttatccactgattttgtggataactaaagcatttaccccaatgctcaatcgctgaaggctttattgacgggggctaacaggcgtttcaacaaactgctcacaaccgcagcaagtgtgcaaaaagtcaacgcagggagcacaaaccacagcgccatatgcagactcggagtcaggctaaatccccatttcatgaccgcagcgacgactgcatcagcactcacgctggccactaaccctccgactaacgccatcactccatactcagcccaaatggtgtgcataactcggcggcgactcgcccctagcgtgcggtacaggcggatctcctgctgacgctgactgaggcttaagcgcagcaaagtaaaaatcagcaatacccctgctagcacacccaatgccgccaacaccgtcacagaccaaacaatttgggtcaacaaggcttggattttggctcccatggtgcgaatgtccatcaagctcaccgtcgggtgttgccgtgagagctgaccgagcaacgcatcatgttcgggctgaatgcggaaactgatcaaataactgactggcaagttttgcaccacgtccggactaaaaatgaagtaaaaattgggcttcatttcacgccactcgacctgacgaatggtgttcacttgcgcgctcaccgtttggctattgatcataaacgtcagcgtatccccaagtttaagcccgaggtcgctcgccacttcctgctcaaccgatacgccattttggctttgccactctccttgcaaaatggggttgtaatcgggtaactgctctgcccaggttaaattcagctcacggcgcagtgcatctgaactctcttcaccattttgcgcgtattgtttcgcctcttgaccgttaatatgcgttaaacgcccacgcatgatgggataagcagcagagcgctcaatgcttgctgtatctaatgccgcaaggtaactggctttttcggattcactgatgttgagtgcaaacgcattcggcgcattttccggcaaggtgcgctgccaatctgagagcaaatcggtacgcactaaccagatgatggcgagcaacatcaaagagagagctaacgcgccaaactgcaaaccacttgctgcaccagagcggttaattcggctcagagccaatgccatagcaggattgagcggtagcttagccagcagacgagtcaccagaacactgaccaccgctaacatcgcaaacagcaccacaataccgatcagcacaatccagatcagttggttttgccaatacaccagcagtagcggcacaatcggtaccatgatcagcagtagattgcgctgccaacgagtttgcgccgtcactggctgcatgaccgcaaccgcactcacgctcaatagacgtcccagcgggatccccagagccggcaccgcaatcaagaagctgctggcaagtgcaatccacagcggacgcaaaccgtaactggggagcgggtcgggcaacaaatcttttagtggcaaacgcagcagcgactccagcccaacaccaatgacgctgcccaacaccaccgcaaataccagtaacaatccgacttgcaacgctaaccaacggcgtaaccagcggcgacttgctccgagactttttaacatcgcaatcgtatgcgtgcgggtggaaacgtaatgctgacaggtcagcactaaggtggtcgcggccatcaagatcacaattgctacagtcagcgataagtactgttgagtgcgttcaaacacctcattagtacggctgccactttcttgatcacgccagcgatcgctcgccgttaagctcacttgttgttttatcgattcgatcgcagagtcatcaccagtcataaataggctaaattgcacccgactccccggctgaatcgcgccagttttatccacatcagaagcatggatgtaaaccgatggcatttgctggaatggattaaagctcagtcctggctcttccaacacttcaccgctgaccacaaaatccgcatcaccaatcgtgacattgtcaccgatatccactcctaactgatcttttactcgcggttcaagccaaagttggttgctcgccacatgattaaaggtttgctgaccatcacttaaacgcatctcgccacgcagtggataagcactatctaccgctttgacagtgactaactgcatgccttgatcgctaaaggccatggtcgcaaaacgggtcatttgtgaagtttgactagcttgctgcgcggtcagggtcaataaggactcaggaagtgggttgcccgaaacaaataccgtatcagcggttaacgcatcacgcccttgtttcacaatcacttgttccatacgctgcgcgagcgcggttaatgcaaaaatcgaggcaatgattaaggttagcgcaacagtcaccggccataactgcccgtgacgaatttcacttaagctccaacgcagtaagcggcgattgagcgatgcgggaggcaaggccttcatacgcgctcctccagctcacccgcttgcataaaaaatcgtcgctgacaacgctgcgcgagtttagggtcatgcgtcaccagcactagtgtagtgccgtgttcacggttcagttcaaacagtaaatcaatcacttttgcagctgtttcttgatccaaattgcccgttggttcatcagcaaaaagcacttgggggcttatcataaatgcgcgagcaatcgctacgcgttgctgctcaccacctgacaattgtgcgggcgaatggtgcattcgatgctccaaaccgaccgctttgagcagcttctgggcacgttcgcgatcctccgcttcgccttttaacaaacaaggcagagtgacattttccagcgccgacaggctaggaataagcagaaaactttggaacacaaacccaacggattcactgcgcagtgcggcgcgggcttcatcatccagttgtgaaagcggtttccccaacagatacacttccccttcacttggcgtatctaaccccgccagtagcgtcatcagcgtcgattttcccgcgcctgatgcgccgacaatcgccacactttctcccgcttgaatcgagagattcacctgtttaaggattgttaaatgctcctgattagtggagactaatttggatagtgattgcgctgaaatgatggatgtttgcatgactcgactactttcctttttgtttgttgttctcttttctgctgcagccagcagtaaaacgttattggtactcggcgacagtttaagcgcagggtacgaaatgcctatcgaacaagcttggccaagtttactggccgaagagctagtggaacagggtcaaaccgttaccgtagttaacggaagcatttctggtgataccacaggcaacgggctcgcccgcctgccctctcttctgagccaacatcagcccgataccgtactgatagaattaggagccaacgacggtttacgcggttttccaccgcaaacggtcactcataacctcaccaccatgattgaacagatccaagctaaaaacgcaaaagtcatcttaatgcagatccgtatcccacctaactatggcaaacggtacagcgatgcgttttaccagatctatcctagcctagctgagcagttttctatcccgcttatcccgttctttcttgagcaagtgatcctcaaaccagaatggatgatggcagatggtttacaccccaaacctgaagcgcagccttggatagccaagtttgtggccgaacaccttgccgcacatttgtaacaccatccaccgatttactggtttagctcaataaaatttactcagctttacgttatttttgagcccttaactagagaataggtgaccctatgcacatcaagccaatcattcagggcgttgtggcgcgcagcgcccatccttatggctgcgaacaagccgtcctacaacagatccagtacgtaaaacaggcgaatccgatcaagtcaggtccaaaacgcgttctgatcctcggagcatcgtcgggatttgggctcgcggcaaggattgcgctgacctttggtggcgcgcaagccgatacgattggggtctcctttgaacgtgctccgagtgaaacacaaaccggcagtgcaggttactacaacaatctcttttttaaacagcatgccgagcaagcaggtcgcatcgcggtcaatctcgaaggcgatgttttttctgtcgacatgcgtgagcaagtgattgaagcgatagaaacctattttgaaggggaagtggatctcatcatttacagcattgccagtggcatgcgccgcaagcccagaagcgaaaaggctgaccctgaattttggcgatccgcgattaagccgattggtgaagcggtctctggtgcaaccctcttgcttgaaaatgacacgtggattgaaaccaccttgcaaccggccagcgaagaggaaattgaagggacattacgcgtcatgggcggcgatgattgggaaaactggattgataccttgatcaatgccgaatcactcgccgaagggtgcaaaacgatcgcgttttcttacatgggccctgacgttactcaccctatctatctggatggtactttaggccgcgctaaaatcgatttacaccaaacgagtcatgctttgaatctgaaactcgccaactttgatggcggtgcgtatgccgttgtttgtaaggcgttagtgacaaaagccagcgtatttattcccggtttgagtccttacttactcgcgctgtaccaagtaatgaaaaataaaggcacccatgaaggttgcattgaacagatgcagcgcctgtttagcgacaagctgtatggccattcacgaattccactcgatagcgaacgtttgatccgtatggatgattgggagatgaaccccgatacgcaagtacaagttcgtgaacgtttacaacaaatgaatgccagcaattttcagcagttaggcgattatgcgggttttaaacgtgagtttatgcagcttaacgggtttgaatttgaccagatcgattatagccaatctgttgatatgcataattttattaataaaaagtgacacgccccgttgttttagatttgagaattcacacaagctaactcaattcgctctgccattctgatcggcatttgttagagtgactgaccactgaagtaaaggtgtgacttcagacaggcagtcgctctagtcacaccccaaatccatgccgcaatcaaggacctcttaatggcaccgatcctttcacactcgatcccgatcccttctagcatgcaggcaaattggcagcagatgctcaacctgctggccgaagtgctgaaagtctcagccaccctgatcatgcgtttacgccatcacgatcttgatgtgttttgtaccagtgtcggcagtgacaatccataccaagtcggcatgaccgaacgattaggcacaggcttgtattgtgaaactgtggtcaatactcgccagatattgttagtcagtaacgccgacctcgacccattgtggaaggataacccagatctggaattgggcatgcgcgcttactgtggcgtaccattgcaatggccaaacggtgagctttttggatctttgtgtgtcaccgatcgtcaagctcgccagtttcttagtaccgatcagcaattgataaaaacctttgctgaatcgattgaagctcagcttaaaaccctttaccaacgcgaaacgttgttgcaaatgaaccaagatttgcacttcaaagttcgtcataaaatgcaaagcatcgcctcgctgaaccaatctctccatcaagagatcgataaacgccgtgccgcagaacagcagattgagtatcagcgcagtcacgaccttgggactggctttctgaatcgcacggcattggagcagcagctcgcgatgcagctggctcaattggcggaacacgaagagctcgctgtgattcatatcggttttgccaatgcccgccaattacaggcgcggctgggttaccacctttgggatgatgtgctaaagcagttacgtgagcgacttggtccggtgacggagggggaattactgaccgctcgccctaactcgaccaatttgacgctgatcttaaaagcccatccgctcgacacccaattaaatcagctttgccatcgtttaattcacgctgggcaagcgcaatttgtgacggaggggctgcccgttcacctcaacccttatattggtgtggcccttagccgtgaaacacgcgatccgcagcagctactgcgccatgccgtcagcagcatgttggcgtgtaaggactcgggatacaaagtgttttttcactctcccgcattagccgataaccatgcacggcaaaatcaattggaaaactatttactgcaagcggtgcgcaacaacgatctgctgctctacttccaacctaaagtcagcatgaaaacccagcgctgggtcggtgctgaggcattgttgcgttggaagcatccggtgttgggtgaattttccaatgaaaccttgattcatatggcagagcaaaatggtcttatctttgaagtggggcattttgttttgcaccaagctttaaaagccgccagtgattggttagcggtgtgcccaaccttttgtatcgcgatcaatgtctcttccgtacagctcaaaaacagtggctttgtcgagcagattcgagatctgctggcgctgtattgcttccctgcgcatcagttggaactggaaatcaccgaaagtggcctgatcgtcgatgagccgaccgcgagtgatattctcaaccgactacacacattaggcgtgacattatcactcgatgattttggtacgggttacgcttcgtttcagtatctaaaaaaattcccatttgatggcatcaagattgataaaagttttatggagcagatcgaacacagcgaaagcgatcaagaaatcgtgcgttctatgctgcatgtagcgaaaaaactgaacttaaacgtggtggtggaaggtattgagtcgacgcagcaagagcagttcattctggaacagggttgcgatgtcggccaaggctttttatatggcaaacctatgcccagtgaagtgtttaccctcaagctcgaaagccacgctctggcgtaatcgaaggtatctcctgctctgtggttgtcgagcataaagagattggcttatcattcctttactcttccgtgggcgctacctataatcgcgctcctctttttctttccctatgagcgataatcgagatggatcgactaattgcaacactcaagaaactcgaaaagcagaactatcgtgcttatcagcagatcaaaggtcagtacgactttggcgactttactctgttcatcgatcacattcagtctgatccatacgcttcagcctctcgcctgcgtgctacgcgcgcttggtcgttgacgggtttagattggctgaaagagaaatcccctgcttatcaaatggctgcgcgtgattttatcgctcgtgcttttgcagagttcgccaaacaagacaacagcttatcgatcgcgattagcggtcaaacggttctcgatagtacctctgttctgtttaacgaacacggcatcgaactgcgttttcgcatgagtatgccagcggaaggacgcgatattctggcgaaaaaagcgctgaatatcttaacctttcacctgccgaaatacattcgccgtgccacgcttgaacgcgagttagataaagccgcgctactgcatcattgtgaaatcgtagaagatcaggaagcgatgcgcgctcaactggacgatctcggtcttgtcgctttcatcgctaacggcagtgtattgccacgattagccggtaactgcgatctgccaatgaaagaggctgttcctttcatcgccccaaaatctctcgaagtcaccctctcaacgcctaaccaaggtgaactggtgggtatgggtattccacaagggattaccttgatcgtgggcggtgggttccatggtaaatcaaccttgctgaccgcgcttgagcgttcggtctacaaccatattccgggtgatggtcgtgagcgcatggtcactgatgttaaagcgatgaagatccgcgcggaagaaggccgttgtgtacacaatctcaatctatcgaactacatcaatcatttacctatgggtaaagacacgaccgatttcagcacgcaagatgcttctggctctacctcgcagtcggcttggttacaagagtcgattgaagcgggtgtcacaactctgctgattgatgaagacacttctgctaccaactttatgatccgtgatgagcgcatgcaggcactggtcagcaaaggtgaagagccgatcacaccgttggtggatcgtatcggtcagttacgtgatgatctcggcatctcgacactggtggtgatggggggctctggtgactatctggatgtagccgataccgtcattcagatgcacgactaccaacccgtcgacgtaacagaaaaagcgcgtgaagtgattgcccagcacccaacgctgcgtcgtaatgagtgtgaaaccccactcgcgacctttacaccacgagctctcaactgtgccactttgcaaaaactgctgctggatggcaaattccgtgtgtcggctaaaggcttggatgctctgcgttttggtaaagagttcacggacatttccgcactggagcagttgcaaagttcaagtgaagtgaatgccattggttggctgtggttccaactggcacaactgccaggttggacagacaacccagccaaagccatgactaaaatgcttgaaggtgactggtatcaagccatgccaaaccacggtgatttagctaagccgcgaattttagatgcaatggcagccctaaaccggatgcgaaaagcacaatttaaagcctaattcccacgcaggggcaaaaccacttgctgcagcagcttcaagttggaagaaatccctagaaaacaggtttcaaaggtcatgcaactgacaaagggctgcatgaccttttcgttattcgtttttctcgttttttcacttttaacttaaagagtcttttttaaactaaagagtcttgtctgagcacattccacgcttcacataagatccgaaaacgttcggcattgccattttctcgatcgggatgccaacgcaaagccagcttacgccacgttttacggatctcaacggcgctcgcctcttcggttaattcaaacagacgcagagcttgtcctcgggttaaatccttaccattatggctgcccactgagtgtcgatatcgcgtccagaattcattgagcaaacgcttcacttccccctcattcgcttcatagttcatccactgagtgtagtaatctcgcaaaggatcattgacatcaatgtcgtggaattcactacgcatcatcggagttaaaatgatgttcatcgcttccacttgcagccatttttctgggtgcaaggtttcttggagctgatagagcgcattcatgatcaggaaatttcgcttgaacagatctttttccggctgagggtctaagaccggcatgatgcctaactcactcaagtgagcggctaaggtatgcactttccatcctgaaggctggcgtttcagaacctcaaaaatcggccacaacagcggattttccatataagtctgaaacgttgcagcaagctggtgactgtctgacataaggcttccattcccatgaaatactctaattcaagatcaatctaacccatttgtcacggcggcgaaatggcaaatcttgattgtgtgaagctcaatgcgcataaggcttgcaggctgtttttctgacactgtaaaagccagatttctgacgcaaccttagctctgaatatttggaaattgaacaatgttcataatgatggcaggatagtgcccattccattgacggagattcactatgcccttgtcgcgacctctcatcggattgacccttttttatagcttaatttttgttttttcagccatagcacctacttcacgtgcggtttggtttgccgaaatcatccccgccattctggttctggccacaatttggtgggtctcattgcgctggtcaatgagcacgaccgcctatgtcttgatgtttgtttggctctgcttgcataccataggcgcaaaatacaccttcgctgaagtcccttttgactggttcaataccttgatcggctctacacgcaatcaattcgatcgcgtcgcccacttttccatcggtctttatgcttaccctattgcggaatggctgttacgtaagcaacaaacgaaaccttggctagcttacagctttgcactatttagcttgatgagtcttgcagcggcttacgaaattatcgagtggtggtacgccgcgctcgctggcggcgaagaagggatcgcatttttgggctcacaaggggatatttgggatgctcagaaagatatgctgtgcgataccttaggtgccatcaccgcactttgcctacttgcgtggcagcgagccagaggctaaggccgcatattgttcctagttgtttcttttattgcgcaatcgcatgcacaggttctgacagaactcgataagagtatgatcgatgacaatttgtgcatgtattttctatgaattgcatctcttttctaagacccaacaaggtaattctttcataaacaaagagttaccgtaagatgacacatcaagaaaacctctcaaatcctcaagaagtcaacaaaaaggtcactaaaagaagtcactacgactctttgtctctatctgtattttcaagtaatccaattaaccctgactgtaggaacggaataaacccacacattagggatacccaaaagatttacttcacgacactaaagaagcacaacacgttctatctacgagtctcacagcgagcgaagcaagcacaacgagcaaagcaagcacaccgagaacatttaaagaatgaaagtgttactgtgtcactaagaacagaaagcagacgagaggcaaagatgagaagtgattacctaaaggatagacttttagagcaagcaggaagctttattgactttaaccatatgcgagaaacctcaaaggctgagctattgagacgtcccaaagttgattggttttaccgtggtaatatcatcgttgcacaagaagccctccaagaagctcaaacagtcgaacaggtgagattcatacaatcctattcggacatcatgaagaagggcttacagagcgatacagaaggtttattgtcgattattgatagcgttgatagcgaacaaagtaagcacagcgaaccccaagaccacaaagaacacaaagaacacaaagagtcactaaccatagatgaacttattgataactacattgctgataagataagtagcggtgaatggatggagtcaaccaaggagaagaaaggagcaaagctacagcatcttaaaaccatctttgaggcttgttctcttaaagataaaccgattgataagcttactcgaaatgacctgttagaagtgcgtacagcgctaatcaacagaggattaaagacactaaccgtaaatggttatatgcaagatattagagcaatctttaacaatgctgaggcgttaggtctaatcggtaagtctcctgccgttaagttgaacatcaaggacagggacattaaggaacctaaagctttaacagagtctgaggtaatagctttgattgactatttcaaacatggttatttcacagaagcaagaagaagcaaaaagacacttgaagggatgaagtatcttaaatgggttcctcagatagcagccgttacaggtgcacgacttaatgaaatcttacagctacgtaaaggtgatattcgtcaatctgcaaatggtctttgttggtacatagacattaacgatagaggcgataatgtagttaaaaacaaatcaagtaatcgtatagtccctctcgtagatggggcttatggattcgacttagagctattcttgagtgaaattgtgaatacctgtaacgaggactcagacaatatattcagacttgtagtggtcaactaaaattggccacggttttagagttttcccaatataatcgttctgattcattgggagttagaccaccgttatactgatgtggcctgagttggcagtaatatccgataatgtagcgggtgatctcttgttgagcctcagcgaagctacgataacccacagttggcacccattccgtcttcagacttctaaagaagcgctctatcggcgcattatcccaacagtttcctcggcgagataaactctgttttatttgaaagcgccacagtaattgacggtatttacggctagtataatgactgccttgatcgctatggaacatgacaccttttggctttccgcgagattcataggccatagacagcgctttacctgtcaaccgactatcaggcgacaaagacattgaccaaccgatcactttgcgggcaaaaagatcgataacgaccgctaaatacatccaccgattaccagtccaaatatacgtaacatcgccagcccagacttcatttggagccgtaacagcaaattgacgacttaagtgatttggaacgtcaatatgttcttgtgaagcctttctgtaacgatgctttggttcttggcagcttactaaaccaagagttctcattagctttgttgctcggtatcggctcagctttacaccctgatttgtgactatatctgcaatggttctcgctcccgcagagccattgcttgcggcgtgagcctcgctaatcaagctgcgcagttttattgtttccgcattaattaacgctgggcgtttaagccaatagtgataactacttcgatgaacattgaagacttcgcataatatttttacgctgtggctctgcttgagtttcttgattatcaagaattgttcagtgagtccgacatcaagagagccgtggctttttttagtatttcattatgctcttcaaggcgagccagcttctttttcaattcccgaatttctatttgctcaggggtcataggtgaagctttaggtgttttcccttggcgttcttctctaagctggcgaacccatttatccatcgtggacttgcccacattcatggcttgggctgcttccgtcactgagtaattttggtctaagactagctgcgctgcttctaacttaaattctgcgctaaatagtcgtcttgtacgttttgtcataatgtcacctgttaacttatgaggtgatgatatcacctctaactaagtgaccaaattcactatgccactacagtcaaggacggccaacataagaggagtgtgataatcaattatgaacaagaaagaaatccaagcctatcaatcagccttcgagaagtttaacccgttctatggtgtagacttcccgattacttccgttaagctctgtgagctaatcaataagatgcgtaatgaccacaacgagaaagtagtcgagttacgtcatgaccacttgatgaataaaatccgagagtttagtgagcaggttaacgccccgaattttcgggtggttgaaagttcatacaaagacactaaaggtgaagaccgcaaatgttatctcttaggtaaaactgaatgtcgagctatagctgctacggaaagtaaatccgtgtgttacatgataatggtctaccttgaccaactggaacaaatctttgagaaagccaaagaggcaaaagctaccgagttcgaccgtaagctatcaaagcaaggtgttacatggagagaagcctgtcgaactgtagggattgaacatcctgatttagccttgaagtaaatgattaagcgtggtttcttcaagagagactttgacggtggcttagttgttaaaccgagtttacttgctgataagtcatttaagaaggctgataaccttggtatcaataaagaaggattcagagtcttaacgaacggctttaagaagcttcaagaagccgccgagcgtattaaatggcagtgtcttcagttctccgatagacccaagttacaagcgatgtataaagctaaacttgaggaacacatgaagaatcaacccaaagtctacgatgagcaaggttttgaggtggagtaactaattacatcttatcttgtcctgtcttgtctttccttgatgaaaatctaccagaaaaatctgagcgaccatctaactaattaagcacagggattacccccgtatggtgtccctatgtgctgtcactgtatctacttcatccactgtgttcactgtgttcaaaaacaggcgtttaggacatcaccctaaagatgttcttaaatagcattctaaagtgttcataaatactattgataataaagaacacatcattcattatgaacacatcttaaagagcacacacacagtaaacgaagtaaacacagtaagcgaagtagacgccatgaaatactcattaatcaagctatcagcgatgaacagctacagtgactgtcaacaagcaatagaagacattgaagcagacccagagaactacacaacggaaaccagagcagcagcacgtatcggtggacactgtgaactactcaaaggtgctaaagagaaaatcaaggcattagaaaagaaagcagatagttttataccctcagatgattctgaagaagtaaacacagtaagcgaaacctctcaacgtacttatgggtatggtcgagtatctaccgatgagcagaccacaagccaacaacttacagctattcgtgaagcaggtcataaagtaagtgataaccgctttattgtggatgaaggtgttagcggtggtgtctgtgcaatggagagaccagcatttagaaaccttgtagaaaataagcttgaaaaaggtgatacgttagttatcgctaaattagatagattaggcagagacaatattgacgttcaacaagtagtccagatgttaaccgataagggcatcaagctattcatccttgatttaccagtagctgatttaagtagtcctgaaggtaagttaatgcttcagatgttcgctacctttgctgagtttgaaaagaatcgcatatcagagcgaatcagggacaaactgaaacagctaaaacaagaaggcaaggcattgggtagaccaacaaagaatgtttatgacgatgtacaagagctgaaagcccaaggcattagccagagaaccattgccgataaactgaacgtgtcattatcaaccgttagaagaaactgggtagacactaaaaggtcactggaagtggtcactgaaagcggtcaataagacgcatcttgatgttagtaaacactatcgctacaatacctatattacatgtatatcagcagccttgttgcgtgtcttaatatgaattgcatctcaattttggaacaaagacagaaaagctcaccaacaaacttttagaaagtgtttatgctaaaggcaaatataaaatgaaatcacaagcctagcgtcgcctacagcgctgagcaacactccttttttgctgctgagaataaaactatgaataaccgacttgtcgaagaaaccattgcagaagaaaccatcgactgctgccctctctgccaacacgatgaattctttatttctgccgacaaagagaaattttactgcgcgaaatgtggctttcacaccaacactctgaccagcattcagcccatgctggcggctaaagcgaatctcacacatcgctttgtccacaccggaatcaaaactcgtcaataatggaagctcgttcgttatcgaaaccgcattatttctctgtcaaaagatggaaaatgcggtcgtaaccgccgtgatggtagcaatgtgagtgaacaaggtgcgtcaagcctccactaatttcagcacaactcccagcgccaaaagaaacggaaaaaacgaaagcaactgacgaaagtgagtcgagaaaggatcggcttacgcggattggcgcatcacgctaccactcaaatactccgcaagttgaagtagattgctcagcacaatcacttgctgagaatggctgcgatgttggggattcagtgggctcaattgaaaggtcagcacttctgcatttaatcctgcttcaacgcccttcggtgtgtcgtcaacataaatgcactcatccaatgtaaaacccatgttcattgcacaataacggatgagatccggctcaggtttccagctgttcgcatcaaaagcagaaaaaatccgcccttcaaaatagtgctcaagaccggcgagagtcagggtcatcgcgattttttctcgtggcgcgtttgacgccacacaaaattcaatctggttacgcttcaagtaattgagtaatgccctcgcgccccccatcggagaaagtttgcgccgaaacgttgccgcgacaatcgagcggtaacgctgctcaagcaaatcaatatccgctgttatcttcgccagttggcaagccgcatggagaatgtcggcgattttgccacccgagaaatgctcagcgacctgctggtagcttaaggccaccccaagttcgccaaacacttgtaccagagcttcacagcacaaacgttcgctgtctactaaggttccttcgcagtcaaaaatgacacactttactctggattcagtcattacttattcctccatccccattagcagtgtatatctcactgtggcactaaaaaggatggagttaacagaatggcagaaaaccatgcacaaacgtgcataacttctaccgaagtcactcttttacgaacagaaagtggctcaaagttcgatgtaaggggtagcatcactcgcggtgatggcttgccatttcgcatacagcgcttgagcaaatgcttcgcgagtgtcaaatagagggttgggtttcacaaccagatcggaaagcagaaccatgtgctcatgctccgtcaccatacctgccgcaacgggttcgccaagatgaaatccgaggaatagttggcatggcggtgagtaaataatttgggtaaaaaactcaaccaaacgttcttgctcatgctgggttgagctacgcgttgcctgcaagagagcaaaccagacagttaaacgatgaaaatccaccaaataaatctcttgcagtaatggcgcatcacaggcctgcggttgaaacaacgaaacttcagtgtgtcggcttaacgcatggtaaatatcgcgcccctctaaactttgagcagtcgggaattcgacatccacttgactcgataaccactgatttttggccgcaaccacaggtgagggagagtaaatcataggggacttcttcttggttggtgaagcaacacctaatcaataagcgtcgcagtaaacgcagcatactcatcaagcccacacggaacaagctttaatcccttttgatgagcaattgcgtatcttggtcttagccatgaggctgcactatcttcagaaaatcagtatgatgtaaacccaaataacctgatgttgccgcgataagcatcccaatatcaggtaggaaggtgatatcccaatacagcttgaagctaaacgatgctcacgcgcgctgccgttgcaagttggcagggtaaacacaattaacgtaaacggaacctgattatgctcaattctattcgcactgctttgcttctttccttcgctttcgttttgagtggttgtgatcgctcagaagtcggtgatgtcagtctcggcatgtttaccttgaaagatattaaaatcaacaacttgaccgatcctgttgtaacgggcgtgacttgccatgtagccagtattgaagccgatttaagcttggccgatccatcagactcctcgatttcttgtcgccaaacgggtgaaattacgccagaaatgatcgcgcaaattgataaatcctcttcaggcgaagtggtctttcaaaaatccaaaagtattttcttcaaatcgatgaaaattcgccgtatttttgatgcgaaaaaccaaaccctgatgtatctctcctactcgactaaagaaacatccggcagctttaaacacagcctgtctaccgtgccgctgtggggcactcaagcctacaacgccttccctgaaacacagaacaaatagcttcatccatcgcagcctgaggtgtgctttacatcacttcaggctgcaataaaaatgaaagtaatctgtcacacctgtgatatgatgcgcgaaaattttttcaattaacactttcaaaatgaagtttcccggtcagcgcaaatctaagcactattttccaactcacgcccgcgatccactcgtcaaccagattcaacaaacaccaaagctccatcgtccgacgattgtcggcgtcggccaaaccatcgtcgatattgaagctcgcgttgatgatgaatttcttacccgctacgatctcagtaaaggccattcactggtactggaagagagtaaagcggatgctctctatcatgaattggtcgagcgtggattgatcactcaccagtatccgggagatacgattggcaacacattgcacaactattcggttttagcggacagcaaatcggtattgctaggtgtgatgtcgaaaaatatcgaggtgggttcatacgcttatcgctacctttgtcgtacttcagcgcgaatgaatctaaaccacttgcaaacagtggatggccctatcggtcgctgctacaccctgatttctgaagatggtgaacgtacgtttgcgatcaatgaagggcacatgaacaagctgcgccctgacagcattccagaagaagtgtttgataaagcttcggccttggttgtgtcatcgtatttgatgcgtggtaagccagaagaccctatgccacaagcggtgcaacgtgccattgaaatcgcaaaagcacgcagcattcctgtggttctcaccttaggcacaaaatatgtgatcgaagggaatgccgagtggtggcaaaactacatgaaagagcatgttaccgttgtcgccatgaatgaagaagaaggcgcagcgctgacgggcgaacgcgatcctctacttgctgcagataaagcgctgcaatgggttgatttagtgctgtgtacggcaggccctgtgggtttgtatatggcaggctatattgacgaatcagccaagcgcgaaacagagctaccactactaccgggtaatattcctgagtttaataagtacgaattcagccgtgcaatgcgtaaagaagattgccgcataccgctgaaagtttactctcacattggtccatacttaggcggcccgctggagattaagaacactaatggtgctggcgatggcgcactttctgcgttactgcacgacatggcggcaaacgcgtatcaccaacgtaatgtgccgaattcagccaaacatgatcagccatacctgacctattcctcgctctctcaagtgtgtaagtacgccaaccgcgtcagctatgaagtgttgactcaacattcgccacgtctgtcacgggctttacctgagcgtgaagatagcttggaagaagcgtactgggatcgttaattgattatcgtggacaaaactctcactctttaataaagaaggcgaccattggtcgccttctttattttccagttaatgaaatggcttatttttccaattcataacttttttgtgcggtgtagaaattctctttgaatgccagactcccccacatcgcattagcatgcgcgcgagtcacgatcgattcgtcaagctgaagtggtgtcatcttatgtgtcactgagtcatattgataggtcgtgatatcttgtcctggctgcaatacaaccacttgattatccggtgttaaccaaccaaagtttttgtcacgttgcatcatagcgcgttgcttttcaaccggaacgtcttgggttaaatcaaagccaatcattgggttttgactactaataccggctaaggagagtagcgtcggagctaaatccaactggctgagtaagcggtcatctttacgcgcttcaatgccaccaccaaaaataaccgctggaatatgaaagtattccacagggattggattggtaccttgtgtacgcgcgtcatggtctgcgacaacaacaaacacggtgttatcccaataaggagattttttcgccttttcaacaaattgccccaacgcgtagtcagcgtatttcactgcattttctaccgtctgtttcggttcattgtattgagtaatcacaccatctgggtattcaaacgggctatggttagacgaggtaaacaccaaactaaagaaaggtttaccttcttttgccatttgcgtgaactgctcatctgctttattgaacagatcttcatccgacgctccccacgaaccgacaaacttcggatttgagaaggtaggtagatcttgcatatccacaaaaccgttgccgaggaagaagctcttcatattgtcaaaatggctctcgccaccataaataaattgcgtgtggtactgctgagtcttcagcaagcctgcaattgagaagaagttattctggcttttacctaacttcaccacagagcgagcaggcgttggagagaatcctgtggttactgcttcaataccacgtacagagcgagtacccgtagcgtacatgcgagtgaatgcccagccttcgttaatcagtttgtccatgtttggagaaacatcgattcccccaaggctttttacataacgcgccccgtggctttccatcaacaaaatgacgatgtttttaggtgcaccttggtaagtcgcaacatgattggccaaagacggtttgtcatcactaataaaatcttccggggctacagtcatcgaagcacgaacttgatcgatcacgagttgtttatccattttaggataaaattcaaatgcgttggcctctgagcccatttgcttggctgcgaaaatcactgaatacgcggagttgagcgcaagatcgttcatcaaaggatcgctagagaaagagaccattgcagggttcattgggcgatgccctaaagaagaacgagctcctaataccccaacagtgaccacaagcacagcaatcactggacgccaataccacttggggtaatgcaagttggaaacgagtgttttactccatcgccagccgagtacaaccgttaatacactcacgactaggccgataaatagctccagtttgtaacccgaccacagcataccgaagacttctttcggatagataaggtattccacaaataagcgattagggcgcagatcgtactcaataataaagggaggagtagccacttccatgtacacaacgatccacaagcctgcggtgatccagagtcgcagaatccaattccaaatgcggcctaaccaatgctcaccagaaattaagctagtcaaaagtgcaggtaaaataaacaaatagcagattgacgcaaagtccacccttaagccactagtgaaaatgcgtatccagccgtcagcattcgttacgcgatcaaaatgccacatagcaagacctaaacgtgatagcgcaaaaatgactaataaggcgaatacagcgcaaacgataggataaagaggtccaaagaataatttgagtttattcaaagtcgtcacctaggtgtgtatatattgagaaagtgaataccgataatctcagattaacatctcaaatcaaacacaccttgatcataaagttcaaattttcagattgttacgtcgaataatcatcaacatgcctaaaaagaaagcaataagcaaagagacacctcctccagatgagctctcactcacgctaaccgttgtagtccctcctgcaaccaactgccgtactccattactttctgtaacgtaatacttgggcgtctctaatccattcatgacacgtaatatccaactgtaataatcggatacttccgtgaataccgaggtaacgggcagcgctggattgccacaggttgatggtccaaaactggtgatcccaatttgcacatatccagagccactatcccaatagacaggacctccggaatccccagagcaggtggagttgcgatacgaaccgatttgtggccctgtaaagcagacatgcccagggcctaaattagcaccgtaataagccgagcaggtcgcaaacggaacaaaggttaaggtggtctctaataaacgggttcctccggcgacattaccattcacatagccgtgaccaatcgctttataggtcccattctcgtcatagctgttattgattgagctattgagtaccccaacgaaattactcacgttaaggtcgctttctaacttgatgatcgcaatatcatttggccaatacactgccgaagaatcgacatagttatcgggataataaaattccgcggcacgagcaagttgaacattgccattggggaactggctttcatcttccaactgaggaaccacaacggtgtacaacatggtatagctattgccataaatacaatgtgctgccgtcaagatataacgtgaattcagaaccgtcgcaccacagtaggttcctgagctgtattgataaggagagatataaatcgccaagctggcaaacgaagggtagtttgcgacattcgcattggtaccattgacgatgtacggcgaaatctcaaccgcagaaactcgcgttgtcagcagtaacaggagccatagccatttgcgcatgcgtcacctcattggttgaattgattgttctgcttatttatcacccgcttaaagtgtagcaatgaaatgaaactatgcgatgcagataacaaaaaacccgcagttttacctgcgggtttatcaattcaaatcacatgtgtgaattatgcttcttcgcgacgacggctatggccacgctcaccacggtagctaccactgctctcaccactacggttgcgctcaaaacgacgctcaccttcacggaaaggacggccttcgccaccacggccacgaccaccttcgcggccgccttcacgaccaccacggaaaccgccttcacggttgccttctggacgacgaccaccttcgcgacgtggaccaccttcacgacgagcaccaccacgagattcgcggaagtcatcgaagtcacacactacagcacccacttctttctggcgaatacgcagcttacgtagcttgctagaaacgtcatttgacatggcttttggtagctgaacaaacgtatggccttgagccagtttgatcgcaccgatagaacctttagtcagacccagttcgtttgcgagagcaccaacgatgtctttcacttgaacgccttggtcacggccaacttgcagttggtaagtatcccaatcgtggttttcttgatcgcggccaccgaattcacgacgagcaggacgatcaccatcgcggcggtcatcacgacgctcacgacgacgtgatttttcacgctccatcgcttcgatcattggatcagcgccgacataaaacagtggacgcttgccttgctgacgtttcagcaggattgcagccagagtcgttgcatcgatttccagtgacgcttgcagtttttcaaccaaatcagcgaaacgttccagcgagctgaactctttatctgctgccagttcttgacccagcttagtcagacgagattcagccactttatcgcggtgcggtagttggatctcttccattgaagaacgagtgacacgctcgatagtgcgtagcatgcggatttggttagtacgaaccagcaggatcgccttacctttacgtccagcacgaccagtacggccgatacggtggatgtaagattccacatcaaatggaatatcgtagttgtatacgtgagtgatacgaggaacgtccagaccacgtgcaacaacgtcggtcgcaaccagaatatcaatcacaccttgtttgatatgatcaacagtacgctcacgcagagactgagggatatcaccgtgcagagccgctgctttgaagccacgcgcgcacagccaatccgctagacgctcagtatcctgacgagtacgtacgaatacgatagaagcatcggtttcttcggtttcaagcagacgagccatcgcttcatctttctctacaccttttactacccagtattgttgctcaactttcgcgaccgtttggttagaaccggctacgtcaacacactctggattacgtagaaaacgctcaacgatttctttaaccattggcggcatagtggcagagaacagtacgcgttgtgctgattctggagcttgctccatgatccaagtcacgtcatcaacgaagcccattttgagcatttcgtctgcttcatccaagatgaaagtatgacattcgtctaggtgtagacgatcacgcgtgatcagatcttttacgcggcctggagtacccacaacaatgtgagcgccagatttcagagcgcgcatttgatcaagaattgaagcaccaccgtagatctcaagaaccttgaggcctttgatattttggcctaggtttttgatctcggctgctacctgaatcgccagctcacgtgttggcgccataacgatagcttgtggcttgtactgagatagattaagtttgttgagcagaggcaaagagaatgccgctgttttacctgtacctgtttgcgctttacccagtgcatcacggccttcaagcagaacaggaatcgctgctgcttggataggagttggtgatacgaagcccatttcggttagggcagaaaggatggcgctgttcagtgctaaatcactgaattgaattgcagtatcttgcatggggatcccactaaatgaagaaataaccaaggtcccacgtgctttaccatttccaaccaatccaatgaattgctgagtccgttcagatgcggataagtattaaaacgcatcaagccgctagggacatataagggacgcggattattccctaaaagcataaaaaaagctaggaaaaattgaatttcatcacaaaaatttcttagcaaaggaaaaatgacgtctcattgaccggaaaaccccgttaaaacaccaaaattgctgacaatttcagcgaataaataaacagccaacggcgctcaatctcacgttttcggtagtaatccagcccctcaatgattatagtgtgcccaacttaaacggttagataaaaaagatgttccaagacaatccgctcctcgcgcagcttaagcaaaaaatccaagaaactctgcctaaaaaagaaggcaccatcaaagccagtgacaaaggttttggcttcctcgaagtcgatagcaaaaccagctactttgttccgcctccttatatgaagaagtgtatgcatggcgacaaagtcgtggctttcatccgcaccgaaaatgaacgcgaagtggctgagccttctgaactcatcgagcaatcgctgactcgcttcattggtcgcgtaaagctatttaaaggcaaactcaacgtcgcgcccgatcatccacaactgaaaaagctgtcgctgaaggcaaaaaccaagaaaggcctcaacgaagctgacttccaagagggtgactgggtggtcgctcatcttgtgcgccacccgctgaaaggtgacgatggtttctttgtgcagatttcacacaaaatcaccgatgctaatgacaaaattgccccttggtgggtgacattagcggaaaacgatctgcccaacagcgagccagcgggcattgacgattggcaactgaaagatgatgcagacttggttcgtgaagatctgaccgcgctgccttttgtgactatcgatggtgaatcgaccaaagatatggacgacgcgctttacgcacagcaactgccaaacggtgattttgcgctgactatcgcgattgccgatccaaccgcttacatcaccccagaagatgagatggacaaagttgctcgcgagcgtggctttaccatttatttgccgggtcgcaacattcccatgttgccacgcgatctggctgatgagctttgctctctgatggaaaaccaagttcgtccagcgctatgctgctcagtcactatccgtaaagatggcgtgattggcgatgatattcgtttcttcgcagccaacatcaaatctcatgcacgcctagtttacgaccatgtttctgactggttggagactggcagctcggaacaatggcaaccaagcgaagaaatcgcccaagtagtgcgcgacctctacgctttctcacaagcacgtgcgaactggcgtgagacccatgccgtagtgttcccagatcgtccagactaccgcttcgaactgagtgccgataacgatgtggtggcgatccatgcggacatgcgccgtacggcaaaccgcttggttgaagaatcgatgatcactgcgaacatctgtgcgggtaaaacgctgcaaactacatttggttttggtgtattcaatacccacgcgggttttaaagctgaaaaaatggccgatgtagtagagctcatggcggtcaacggcgcacccaatgcggatgcagaaacgctggcaaccgtggaaggctttgccgctctgcgccgctggctagccacgcaagaaaccagctacctcgataatcgtattcgtaaataccaaagctacagtgagattggtaaccagcctctcccccacttcgcgatgggccttgatgtgtacgcaacatggacttcgccgattcgtaaatacggcgacatgattaaccaccgtctgctgaaagcgcacattctcggcaaagccccggtgcaaacgccggatgagacagttggtgaagaactggctctgcaccgtaaacaccacaaaattgctgaacgtaatgtggcagattggctctatgcgcgcacgctggctgatgagcctgcgaaagaaacccgcttccaagctgagatctttgatatcaaccgtccgggcatgcgtgttcgcttactcgaaaatggcgcaatggcctttattccgggagctctgatcctcgataacaaagagcgtatcgagtgtaatggtgaagacggcacggtactgatcgataaagaagtggtgtacaaacttggtgatgtgctggaaatcgtcctgacagaagtcaatcaagaaaaccgcagcttagtgggtaaaccaacgcaagtgtttgctgatctggtttcagagacgcaaaccagtgcggagcaacctgctgagggcgcagaaaataacgagccacaagtttaattcgcttggtttgagtctccatcattcaaaaggcattcttcggaatgccttttgtttttctcgtctggtgcataaccccataagcgtgccaagcctatacccaaaaatacgctttcggatctttctccacttcgcggatgatggcagttaaatcctcgctacgtgccaaaaatggataagggatccaagcttcactctgcgctttttgttgatcataggcgtagagcgcccactgtttagacgcttcttcccagacgatttttgcaaccaaactttcgtagtcacaacgggttgagtcgagtttgtagtggcacagaataaactgcaccccgtgctcgatgggctcaaagctcgacttgcccagctcagcaggtaagctctggttgcggctcatgcaaagcaattctgcacggcgttcaagctgtctctggagaagattgacaatcatttttaacctcatcggtgtctgagtctgctcagtatggctatctgagcgatgcaattccatgatctccacatcatttgagtataagcaatgggtgcaagctcggtgaatttcaccaatcaactcactaacctagagctgccttcacatttttgtcatacgtttcaggcatactgcgtaagatttttttgacaatatgggagctaatttatgatcaggatggcacttgccgccgtttgcgcacttcttttttccatcacaacgatgacaccctttgtgcaagcaagtgaaataaccatttcaggttccacctcagtggccagaattatggacgtactggctgaaaaatataaccaacaacaccccgagacttatgtcgcagttcaaggtgtgggttctaccgctgggatttctcttttgaaaaaaggcgtcgcggatatcgctatgacctcacgctatctcacggaaagtgaagcgcaaaacaccctacacacttttacgctggcttttgatggtttagcgattgtggtcaaccaagccaatccagtcaccaatcttacgcgagagcagctatacggcatttacaaaggccaaatcaccaactggaaacaggtgggcggtaacgatcaaaaaatcgcggtcgtgactcgcgaagcctcatcgggtactcgctacagctttgaaagcttgatgggattaaccaaaaccgtcaaagatcgtgaggtttccgatgttgcgccgaccgcgcttgtcgtcaatagcaacagcatgatgaaaacgttagtcaaccacaatactcaagcggttggctttatctctattggctcggtcgataaatccgtcaaagcgattcagtttgaaaaagcggatcccacttctgacaacatagctaagcacacttaccaattatcacgcccgttcttaattttgcactactcagataacgcagacgaacagaccaaagagttcatcgccttcttaaagtctgaaagcgctaaaaaattgattgtggaatacggctacattatgccaagtgatgtggaataaaccataagagcattactcttactacatgagtttctgcatggttgcaccatagttcttcatggtttaccacacacagtgtgcttcagaaacgaacaaggagagcaaataggctctccttgttgatttatactgatgacacaatgggctagaagtgcagttggatcactgacactacaacacaacccggacgacgaacgccctcgatctcaaccttgatttcacgctcaatctcaagtcccttcttaatcggggtcactttcgacaaagtactcacggcacgaactcgattacccgcttttactggataagggaaacgtaccgagttcaagccaatattgaccaccattttagcggttggaaacaaggttttctcttcatcaacgctgtcggttaactttggcaacaatgccagcgttaaaaatccatgcgcaatcgtcgttttgaatggcgattccaacgccgcacgatccggattggtatgaatccactgcatatcttcagtgactgcaccgaattgattgattcgctcttgatcaaccagtaaccaatctcccgtatggatcacttcacccacctgggtttgcaactcgtcatacagtgcttgagcctcgggtttgagttcaatcggctcagggatcggcgtatcttcattggcaggcagatgcagatcttttacccacccaaacagtggacggctttgggtcttgtttaaaatatcatcccagtactcgcgcacagacggagacatccactgcttaaattcagtgtgcttaaccaagttttcagctcgatgcttcagaagctcagcgactctcatcaaaacctcattcttaaccaagaagaaatggaaacgacctaattttgaagtacttcacagtaagctgcaatcactttcgggcgtacatgcgtaacctgtaaccaacaaaaatgtttaaaaacaaagcattatcaataaaacattattttattagcttttgaacaattagagcaaacacaccatttatttccatccttttgcgctacgttagccaagcaaactcgtcagcaacttgcgaaggattgtagaatgccaagcaaatattgcaccgaatcggtactttctaaccctcatttataaactttcaatctggctcagatacgcatcagccgtgctcaggatcgcttgctgagaatcgctcgtcatcttgtcccacgttttgtatagcattccgatgcgaggattgttggcgagtcgatcacgatgtttaagcataaaccgccagtaaagcgaatttagcgggcacgctttctctccggatttgagtttcacttgataagcacaagaggcgcagtagtcactcattttattgatgtaggaaccactggctgaatagggtttggtggcgatcaatccgccatccgcaaacagagccatacctcgcgtattaggaagttcgacccattcaatcgcatcgatatagatacctaaataccaggcatcgacttgatcagggtcacactcggtcagcaaggcaaaattccctgtcaccatcaagcgttgaatatgatgcgcgtagccaaaatccagtgactgagtgatcgcctgctgcaaacaacgcatcttggtttgtccattccagaaatagcttggtaacggccgctgcgctcctaaatgattgcgtgtttggtaatgaggcatattgctccaatacatgccgcgcacatattcacgccaaccgagaatttgtcgcacaaatccttccacttgagctaacgagatctgcccttgagctgcgcgataagcactaatagtagcttcaatcacttcgcgaggtgaaagtagcttactattgagcgcaaatgaaagtcggctgtgatacaggctccagcgatggggatgctgcgccgtcatcgcatcttgaaagcgaccaaaattaggcaagcaaatttggcaaaaatgcgccaataaggaaagcgcttgcgcacgattgataggccacagcagtgactctccgacttgtccgatagacggaatccgatgacgttctattcgcgccttgatggacgcaacgggattatcaaaacagagtggcgtcggcaactgaagaagatctggcgatttcagtttattacgattgtcggcatcaaaattccactgtccaccttcaggtttgccatcagccgtcatcaaataaccaaaacgcttacgcattcgtcgataaaagtgttccatcagcacggctttgcttgcgggaaattgctctgggatctccgcaaacggtagcaagaagtgctcagtatcaacgcaccctattgtgatgccggataggcgcaaattggccatttgctcaagcagtcgatactcgtcaggtctttggtattggaaagcatcggcctgaacttgctggcaaatctgcgcgatcagatcgggtaaatcgttatattgcgcgctggcatccagatccagatgccatacgtgatgcccttctgcacttaaataatcagcaaaagcttgcatggccgcaaaaaatgcacactgcttttgaatgtgatggcgaacgtactcctgctcctgatgcagctctgcaatcaggtataaaacatcatccctatgctcagaaaaccaagaatgagcatggttgagttggtcacccaatatcaatcgcacaacggaatagcgcatggtgctccttaatcaataccgcgacagaagaatgcattatcttccattcatgctttgggtatacgtttaaaaccgctctccgatcagtggttaacctgtattgacacggtagaaaccgagtaaagcatcaacctttcatattgaataaacatcatatatttcatgaagatattagttatttaactctaaaaaataagcgtgagagcttgattccacatattgagtaatgacttcgctttctctcttggtcttaagtaaatttgctctcggtcacactttggcaaaccctttgaaaaaatgggacgcaaagcttccggtctgtcggtcaagaaagctcataaagccctattacacctaggatagcggggttaccaattcggtttataccgttttgtcttatgcgttgctgaaggtgctgaagttcagattcactctgaactgcgtctggcgctttgtcagacaaactatgtcagctaacaaagaagagtctgtgatgaaaaaacaacctaaaatgaccgctattgccctgatcctctctggtatcagtggattagcgtatggacacggctacgtttccgcagtggaaaacggtgtcgccgaaggacgtgtcaccttgtgtaaatttgccgctaacggcactggagagaaaaacactcactgtggcgcgattcaatacgaaccacaaagtgtcgaaggcccagatggcttcccggtcactggccctcgtgatggcaaaattgccagtgcggaatcggcactggcggcagcgctggatgagcaaaccgccgaccgttgggtaaagcgcccaattcaagctggcccacaaaccttcgagtggacgttcaccgccaaccacgtcacaaaggattggaaatactacattaccaaaccaaactggaacccaaaccagccattgtcgcgtgatgcatttgacctcaatccgttctgtgtcgttgaaggaaatatggtgcagccaccaaaacgtgtcagccacgaatgtatcgtgcctgagcgcgaagggtatcaggtcatcctcgccgtatgggatgttggcgataccgcagcttccttctacaacgtgatcgacgtgaaatttgacggtaacggcccagtgttacccgattggaacccagcaggtcaaatcattccaagtatggatctcagcattggcgataccgtgtacactcgcgtgtttgataacgatggggaaaaccctgcttatcgcactgagctaaaaattgactctgagacgctaaccaaagccaatcaatggtcttacgctctggcgactaaaattaaccaaacgcaaaaacagcaacgtgctggtcagcttaatggcgatcaatttgttcccgtttacggcaccaacccgatttatctgaaagaaggcagtggcttgaagagtgttgaaattggctaccaaattgaagcgccacagcctgagtattcactgacggtttctggtctagcgaaagagtatgagattggcgaacaaccgattcagcttgacctgactttagaagcgcaaggtgaaatgagcgcagagctgaccgtgtataaccaccaccaaaaaccgctggcaagttggtcacaagcgatgacggatggcgagctgaaatccatcacgctagagctgagcgaagctaaagcgggacatcatatgttggtttctcgcatcaaagatcgcgatggcaatctgcaagatcaacaaactctcgatttcatgctggttgaaccgcaaacaccaccaacaccgggtgactacgactttgtgttcccgaatggcctgaaagagtacgtggctggcaccaaagtgctcgctagtgatggcgcaatctaccaatgtaagccatggccatactctggctactgccagcaatggacaagtaacgctactcaataccaaccgggtactggcagtcattgggaaatggcgtgggataaacgttaagttatcctccctcttacacccatcatccctcagctcacgctgggggattttttattctccagtggctacctctccactctttcttcgtgctttacccttcctacttgaagcagctgcactgtgggctagatccatactaatttgcctcttatttaccacctacatacaactccagcgtcgttgagaaacctctgagagaatcgagtctgcggcactttatttatagttttatgttcaaatttatttacttatcgaattaatctaatttgttgcatatcggttaattgcatttactttttattaacaaccattctttcagaaggaatcatgatgaaaagtaaaatagtgaccgccacactggctttatgttgtctatccccatcgttcagttacgctcagagcaccgctccaaccattgccgatgaggtgatctttactctctcctccgaaaccttaacctcccctcgcgccgtcgtagaacatcccaaggccgattttattaaattacattttaaatcgctgaatttaccccaaggcagtgccatcagactgacctctcgagatggcactgaagtggtgcaatatacagaaagtcagcagtcatggtttgctcaatcgctctttggtgaccaagtgttgattgagttgatccccaatgccaagggtgaaatcggacaatttgaaatcgactattatatggccggaaatgagagccttgccgagtcagagctgttgtccacttgtgggatcaatgaacgcaaagatgtcgcctgttggcaggactcccatccagagaaagtctcttggtcgagcccagtagcacggttattgattaatggacgcagcctttgtacagcttggcgtgtaggccctgataaccgactgttcaccaataatcattgtgtcagcacagcctctgaactcaagcaaacggaagtgtggttcaattatcagagaacaacatgtaatgggtcacttgccacgaccgtgaaagtgatgggtaatgaattattgagcaccgattacaccttggactataccctcttcacggtcgatgatttcaataagatcgcctcttttggttacttaggcttagacaatacagagcctgtttttggcaatgggatatacattccccaacatggggctggcaatcctaaagaactcgccatcgagagcgataagaatggatctggcttatgtcagattgatatcgcatcaaccaatggtcgaggcactcacacggacactggctacttctgcgacaccattggcggctcttcgggctcccccgtcctcaacacctctgataacaaagccattgcgttacatcatttcggcgggtgtgaaaatcaaggggtaaaaatcagtaagatctggactaaagtggcgacgttttttaatcataccttacccaatggctccgttagccaaacgccacctcaagtgagagagctcattccaaaccaaccgctcaataatctcgccctatcccaaggtgaagagatgttgctgatggtaaaagcttcaaaccgaaagaccaacttaaccatttcgataagttcagggagcggtgacgcagacctctacgtaaaaacgggccagccaccaacccaaagcctctacgattgcagaccttatcaatcgacaaataacgaaacctgtgttgcgcccttagtgaatgaagatctctacatcatgctgcgtgcgtatcgcagttttgctggggtctcactcactgcgactgaaaaacaataacgattcttcacacccacggagaagggaaaatcttatgaacaaactattcgtcatggctttgatgtcggcagcgttgagcgccaatgctgaagacaaagtctggatctcgatgggcgcagatgccgtcggaagtttaaatcctgcgctgagcgaatccttattacctcattcattcgccagtggctctcaggtatggataggcgaagtcgctatcgacgagcttgccgagctttcacatacgatgcatgagcaacataatcgctgcggtggctacatggtacacacctcagcacaaggtgcgatggctgcgctgatgatgccggaaagcatcgccaatttcacgatccccgcaccttcacagcaagatctggtcaatgcttggctgccacaagtgagtgcagaccaaatcaccaatacgatccgtgcgttatccagttttaataaccgcttttataccaccgcctcgggggcacaagcctctgattggctggccaatgagtggcgctctctcatctcgtcattaccggggagccggattgagcagatcaagcactctggttataaccaaaaatcggtcgttttgacgattcaaggcagcgaaaaaccggatgaatgggtcattgtcggcggtcacttagattcaactttaggctcacacaccaatgaacaatcgattgctcccggtgcggatgatgatgcctccggtattgccagtttgagtgagatcattcgtgtcttacgtgataacaatttcaggccaaaacgctccgttgcattgatggcctatgcggcggaagaggtcggtttgcgaggctcacaggaccttgctaatcaatacaaagcacaaggcaaaaaagtcgtatcggtcctgcaacttgatatgaccaactatcgaggttcagcggaggatatagtctttattaccgattataccgacagcaatttaacccagttcctcacaacgctgattgatgaatacctccctgagctaacttatggctacgatcgctgcggctatgcatgctcagaccatgcctcttggcataaagccggcttctcagcggccatgccttttgaatctaaattcaaagactacaaccccaagatccacacttcgcaagatactctagcgaattctgatcccacgggtaaccatgcggttaaattcaccaaactcgggctcgcttatgtcattgagatggccaatgcaggctcatctcaagttcccgatgattctgtcttgcaagatggtacggcgaaaatcaatctcagcggtgcacgaggcactcagaagcgctttacttttgagctctcccaaagcaaaccgctcaccattcaaacttatggtggttcaggcgatgttgatctgtacgtaaaatatggctccgctccctcaaaatcgaactgggactgtcgcccttaccaaaatggtaaccgagaaacgtgctcattcaacaacgcacaacccggtatttaccatgtgatgctggacggttacaccaactacaatgatgtggcgttaaaagcctcaactcagtagcttgggaaaagcgatatcaccaaacaacttggagttgctggtcgaaggcaagtgagtgaatccctatgagcatagatagactatgtgattggggtgaacgaacatagccaacaccgctgcagcttcaagtcggacgggtatagaaaaaaggcctgatctctcaggcctttacattgcttaactcagattactcttcatctttcttgttggatgcccaaacgtagagcagttccagagcgatcgtcgcacccgccagtgaagtcaggtcgctttgatcgtaaggaggtgacacttctaccacatccataccgatcaggttgatgcctttcagcgcgcggatgattttcaggatcttgtctgagctcaaaccgccacaaactggcgtacccgtacccggtgcgaaagcaggatccagacagtcaatgtcgaaagtcaggtaaaccggcttgtcacccacgatgtggcgaatttgcgccacaatctcttcgacagacatgtcgttggcttgcatcgcgttaatcacgttgaagccgtggccttcttgtttgtattccgtacgaatacccacttgcaccgaatgcttagccgagatcagaccttcttttggcgcatggtagaacatggtgccgtggtcatacgcactgccgttcgcgtaagtgtccgtgtgtgcatcaaagtggatcagcgccatttcaccgaagtgcttagcgtaagcacgcaggattggcagagtgatgaagtgatcgccacccagtgccagcatggttttgccacttttcaggatttcgctggtcgcggcttctaggcggtaagtgaaatcttcagcatcaccgcaatcaaaaaccaaatcgcccgcatcaatcacgttgatctttttaaacaggttgaaatcccaagggaatttcttaccttcccaagcgaggttaaccgaagcacgacgaatcgcgtcaggccccatacgagcccccggacgaccggacgtcgccatatccaaaggcacgccaagtaccacgacatcagcattagtatctactgggttacgcacatagggacgacggacaaacgtcatcgcgtttgagtagagtgaataatcagttttagtaaacaaatcattcatttagaaatcctctaagtaagtatagccgctcaggcctaattcaagttccgccaaaacggtctcttgttcttctttggcaacacgttgagaaaccagttgacgatagttggtgcgaattttatctacatcgatgtgaacgtagcgcatcatatcttcaaccgtgtcaccttcattgataaaggcaatttcagactcgccattatcattaatattcacaaccgcgctgtgtgtgtcaccaaacaggttgtgcatatcgcccaagatttcttggtatgcaccgaccaggaaaaagcccattaggtatggcttgtcactcgtccatgctggcacaggcagtgtactttcaataccttggccttcaacgtactgttcaaccgcaccgtctgagtcacaggtgatgtcgagcattactgcgcgacgatcgttcatctcttccaaaccagaaagcggcagcactgggaacacttgatcgataccccaagcatccggcagcgactggaacagtgagaagttcacgaagaacttgtctgctaaacgctcttgcagctcatccagaatcgggcgatggaagcggtttttgttgctcatcttctgacgcagttcatggtagatacgcagtgacaactgctctgcccatgcacggtgctcaaggtttaatacacccgttgcaaactggctatgcgcttcagaaagatcgctctgtgtgtcgttgtaaatttcaatcagtgcgcggtcatcggtaccgtgttgcacttcttcaaacccacgccacatgtttttcagtagcattggcgcatccgcacccggtgctgggatctcttctggcgagtaggcttccgtaccgataacgttggtgatcaataccgcatggtgcgccgtgatcgaacgacccgattcagaaatgatcaccggacgaggctgaccgtacaggttacacacatcgctcactgtgctcacgatgttacgcgcatattcgtgcagaccgtagttcatcgagtttgatgactggctacgagtaccatcgtaatccacggccaagccgccacccacgtcgaagaaatcgatgtgcgcacccagctcacgcagttcacagtagaaacgcaccgcttcgttcacaccattacgcacgtcacgaatgttcgccatttgtgaaccaaggtggaaatgcaccagttgcagtgcttccagttgattttccgctttcaagcggttaatcacggtgagcacttgtgatgcagctaggccgaacttcgatttttcaccgccgctcgattgccatttgcctgcaccctgagaagcaagacgaatacgcagacccagacgtggtttcacgccaaggcttttcgcttctttcaggaccagatccagctctgacagtttttccagaacgatgaaaactttgtgacccagtttttcaccgatcagtgccagacgaatgtactctctgtctttgtaaccattacatacaatcactgaactggcttgctgagccatagccaacaccgccagaagttcaggcttactgcccgcttctaagccgagttgtttgtgttctaattcggcctgactggccagaatttcatctactacctctttttgttggttcactttgatgggataaaccagcaggtatttatttgggtagtcgtactcttcaatcgcctgattgaaagcgtcacaaatgttgtgcacgcgttgatgcaggatctgcgggaagcgtacaagcacaggcaaatttaaatcgcgcgcttcgagctgtttaacaattgagcttaattgcgtttgatgagctttgtcttttctcggcgacacatacacttcgccttgatcgtcaatgccaaaaaagccttggctccagtaatgcacattgtagtcagcgcgaacgcggtctaatttggatggttgttccacatcgtatctcacaaaaacagagaggattacaatgatttcatcggttgaaatcacacctgacaccctagatgtcacgcgctttatcggtgaaaagctagggtgtgtctaatgataataatttatcgttaggacaactgttagttatcacacataaacttgcataaatgtcttcatttcattcatatttttctgtacgcccttgatgccacaaggcatagccgcaaagcggtcatcgattctttgcaataaaaatgtcattgaatagggagatttatagactgaaacaaacaaatagaacgcatcaattcattctctgtatagtgctgtttatgacaatgggcacaattcaaccaactcgtctagttaactcgggttttcacttggttgttctttgtaattacatacaattccgttaaggtgatttgagcataacggtgagatacacgatggaatacctagctttattacaaacccactataaatggttgatgacaatactcatcatcgtcttatatccgcatatttcacggataaccttacgcctgttcgaaagtatgcttaccggacgggtggacattcaccgtttgaaacgcgcgcgttggctgatccgcaccttactctttctcgtgatgctgtttacgaccttgattttgtggggcattgagttacggggtctactggtggtcggctcatccctatttgccttgctcggggtgggtttgtttgccggttggtcactgctgagtaatgtcaccgcattcttaattctgtttgtgcaaaaccagtgccggatcggctgctgggttcgcatcgtcgatggcgcaaactttattgaaggcaagatcattgacatggcgctgctgaatgttgaattggaaacccttgaaggcaaccgcgtgctctaccctaacaacttatttattgttcgccctgtgattgtcttacaaaaggcacccgagaaagcggtcaaaaaaccagaaagaaaacagctacccaagggattgtaattttgagcgaataccaagacttatctcaacaaattgaattgattgccaccgccgaagaatccgagcaaacccatctactcggtgagatggtggaaaatggcttagatgaaggctcgatcgctctgattttagaagcgtttcctgtggaacaacgggtacgtttatggcgcagtttgccactggagatgcacatagatgtgctaaccgagatgcgcgccgaggtgcggatttcggtcattaacgcgctgtcggaaattgaactcaaactgacgctggctaagctcgataacctgtcactgatcgagtgggaagactcgctacccgatgacatcatcagtgaagcattaagccttattaaccgtgatgaacttgagctatacgaccaagccaacgagtttgcagatgacgaaattggccactgggcggatcgaaaagtttataccttaccttttagcatcagtgttcgccgcgccaaagtcttgttggataaatatcactacgactcccctcaatatatttacctcatcaacaaagccaaaaagttccgtggcttagtaagctttagtgatgtattgcaagccgaagaaacaactcagctcaagaacttacgtatggaagaactggtgacgctcaatgctaagcaaaccttatcagacgcggtggatgccctcgaacacaccactttgccaattgtgccagtgctgagtgacgatgaaaccttgattggtgaaattgactggcattttgcgctcagcgtgcaacgtgaaatgtatgaagcacgcctgatggccggtaccggtatggatgaaggtgatgatctgttcgcgcccgtcatcaaaagctcgaaaaaacgcggtttgtggctcggcattaaccttctgaccgccattcttgcctccatcaccattggcttatttgagaatgtcatttcgcaagttgtcgctttagcggtgctgatgccaattgtcgcttcgatgggtggcattgcgggaagccaaaccttgactttgatggtacgcgcgatggcgcttaatcagatcaccgtgggtaaccgttttgccttactgaaaaatgaactcggcattggctcaatcaacggcctagtctgggcgctgatcatcggtggtatggcggcactttggttccaagagccagtgatcggcgcaaccattgcgctggcaattgtggtcaacattattaccgcagcattatttggggtgttgatcccgataattttggacaaattcaagctcgatcccgcgctggcaggttcggttattctcaccaccgtgaccgatgtggtcggcttttttgccttcctcggcaccgccagtttggtgatgttgtagccgccatcaaaccctagaaaaaatttttattccccctcttgaacttcgattttcttaccctatttatatcggcgagtggcagtgatgccccgccgagactggattgattgcttctagcttcgcgtgaaactgagctcattttgcaaacaatcctaccggccttttatcttgatagtgacatttaagtaggaggcattcccgatgaatattcgtcctttacatgacaagttgattgttgaaagactggaagtcgaaaacaagtctgagggcggaatcgtactcacttctcaatccgtcaaaaaatcaaaccgtggcaaagttgttgcggtggggttaggtcgtccgctgaagaatggcgatcgcgcacgcatggaagtgaaaaccggcgaccagatcattttcaacgatggttacggtgtgaaaacggagaaagtggacggtaaagagtatctgatcctctccgagtctgatgtgttagcgattgtagaataatttgttgcagcaaaaggaggataacgaaatggcagcaaaacacgttctgttttcaaccgacgccagacagaaaatgcttagtggcgtaaatttactggccaacgccgtcaaagttacgctcgggcccaaaggtcgccatgttgtgctcaataaatcttatggtgcgccaaccatcactaaagatggcgtctctgtcgccaaagagattgagctcgccgataaattcgaaaacatgggcgcacaaatgctcaaacaagtggcgtccaaagccaacgacgaagcgggcgatggcactaccacagcaaccgtgttggcccaagcgctgatcaatgaagggatgaaggcggtcgccgctggcatgaaccccatggatcttaagcgcggtatcgacaaagcagtctccgcagcggtcgagaaattgcaccaactggccaaaccttgcagtgacacccaatcgatcactcaagtcggtgccatttccgctaatagcgatcacgcgatcggtgaaatcatcgcgcaagcgatggagaaagttggccgcaatggtgtgatcacggttgaagagggacaagctctacaaaacgagctttcggtggttgaaggtatgcaatttgatcgcggttacctttccccttacttcatcaaccaacccaaagcgggctgtgttgagttggagaatccctacgtcttgctagtagacaagaaaatcagccacattcgtgaactgctaccgattttagaatccgtggctaaagcttcccgttcgctgctgatcattgctgaagatgtggatggcgatgcgcttgcgacattagtggttaacagcatgcgtggcatcattaaagtggcagcggtgaaagcgccaggctttggtgaacagcgcaaagcaatgctcgaggacatcgcggccctcactgctggccgagtgattagcgaggaaataggtcttgagcttgaaaaagtgacgctggacgatctgggtagcgcgaaaaaagtcaccatcaataaagacaataccacgattgtcgatggcgctgccgagccaagtgccctccaagatcgcatcgcgcagatccaacatcaattggaacacaccacatcgcaatacgatcgggacaaattgcagcaacgcattgccaaactctctggtggggttgctgtgatcaagattggtgcggcaacagaagtggagatgaaagagaaaaaagatcgcgtggatgatgcattgcacgccactcgcgccgcagtggaagaagggattgtggccggcggtggtgtcgctctgctgaaaattgccaacgagctcagcaatttacaaggtgataatgacgatcaaaatgtcggcattcgcattgcgctaagagcgatggaagaaccactgcgtcaaatcgccatcaacgcaggggatgaagcttcagtgatcgcaaatcaagtcaaaacgggcgatgagcattacggctacaacgctgccaccggccaatttggcaatatgttagagatgggcattttggatcctgcgaaggtgacacgctcagcgctacagtttgccgcaagcattgctggcttgatgatcaccaccgaagccatggtcagcgaagtagacaaagagtctgcggcgtaatcgagtaaggtgaacagggcaaggagggcgaaatgacgaaactgcctcatttacagttgagtgttgttgaagcgcagccaaagactcatccggccaatgcttggcctatgagtatgagctttccgcagcgctgccaagacagggtgctgatgccaccttatcgtagcgttttccctgctgtggtattggtggtttacatcaatcaggctcagcagcaacctagcccgaccttgcactgatgattgctgaacttggtctaagaggcagatttttctgcctcttttttattgctcgaatttctattcaacaagtacggagtttacgccacttttctcgctgacgatggctgtgcaaagggcattaacgcttggtgcagcacgcacaccccgttcgcgtaatccgcatcatccaccacaaactgtacattcacattacgcatcgacgagtgtgcggccatgggttgcaactggtgttccagtaacgcttgcaatccttgggcgagcactttgttggtttccatgtgcgcaccgatcgctgagatcagcgcaaccattcgccctgagactttcgcttgcggataacgcttctccgcttgatagcgaatgtgattgagtggctcgctgctgccactcagataataagtgactgagttggcgttcatctctttaccgatcaactgcactttcgctgcgtggatccattcaatcaattcatggctgactttatccatcatcccgaccatgctttggtcaaacagatgcaacgcaaacactttatctcgtcctgcaatgatctccactctatcttgctgcggctgatgtgaggctgtaattaacgtgccagaatggtcaggttcaaaggtatttttgatccgcaaatcgatattactttgtcttaaccctgctgccgcgttggggtggatcgcctccataccgagattagccaattgatccgccacatcgaaattggttaagccaatcgggcgcactttttctgcgccgaccaggcgcggatcggccgagctcaagtgatactctttgtggatgatggcttgctgagcgcccgtaaccaccgcaattcgactaaatgtcatttcgctgtaaccgcgatcataggtgcgcatcaacccttcttggcaagaagcgtagccagtgacgatcggcaactcactcgtcacatcaatatcgcgaaacgcttcttcaatcacctgatcgaggttgccttgcatcgcttcgcaccaaccagacaaatcgacaaagcgggcgttaacacctagtgtgttgagcttgagtgctgtgttataagcgctgtgcgattcaccaagcgaggcaagaaactcacgaatttgcggtaagtattggcgcagcgaaaactgtccatattggcaggtttgcaaaatgttttggatgcaagctatggcttcggctaaacgagcgcgaataaatttatccgcgcgtaaacgcgtcattgcatctgcaaacatattttcgttaatcagcagcatacgctgttctagggcgtaaaccgcatcacgccaactctcatcatgcttggctattttttggtaaatcccaggcgcaccagtgcgtttgcattccagtaaggcatcggtcatgcccgaataagccgagaccacaaatactcgaccatagagctgctcgggcctgagtaaaatattttccaataccgcatcaaaagcggtcatcgaagtaccaccgattttctctacggtgtaagacatcatttctccttatgacattgtgatatcaattcacttttatccagcggatagacaccttccgcatcatgaatttcgtgtccagtgagtggcggattaaagacgcacgccatcaccatctcgctagaaaaagcgcgcaagtagtgttcatcatgttgatctaggatgtacaaggttcctggttggatcggatacgttttaccacccacaacctcaatttcgccttcacccgacatgcagtacaccgattcgaggtggttgcggtagtgaatatgcgtctgagtgttggcgtagatggtcgtgatatgaaaagagaaccccatatggtcatctttcaataacatacgcacactttcccagttttctgccaccactcgacgttcactttggcggcactcttctagcgttctaacaatcatgttttctccttatttttatgcttgtttcggatgagtcaggaggcttgctgcaatccacgcggtgctattcgagcagcactgcgctcaataatggtcaatccgtgcgcgagatccgcttcggttatggtgagggggcaaaacactttcagcacctcatcttctgcacccgcagtttcaataatcaaccctttttgaaaacagagcgcggcaatatcgcgggcaatgtccccattatggcaagccagaccttgcattaagccgcgtccttttaagccagaaaataacgtcggataacgactcaaacactgcagcaatgcctgagtcacttgctcactgcgtgcggcgatatgggtttgaaaatcctgattcgcccagtaggcttctagcgcgcgagtggcggtgacaaaagcatggttattgccacgaaaagtcccgttgtgctctcctggtttccattgatcccactcgggcttaaacagcactaatgccatgggtagtccgtaaccgctgagcgatttcgataaggtcaccatatccggctcgatgccgcttggctcgaaactaaagaacgtccccgtacggccacaacccgcttgaatatcatccacaatcaacaaaatttgctgagcacggcaaatcgcctgtacacgttgtaaccaagcgtccgaagcaacgttcaaacctccctcgccttgtactgtttccagtaataccgcggcaggcttatctaaaccggacgagttatcttgcagcatggtttcaaacaaagtgagtccatcaacgcctgcgtagccatcataaggcacacgataaacgcctgagagtgctaaacccgcgccttgacgatgatgctgattgcccgtcgcggcaagtgccccgagtgaacaaccgtggaaaccattcgtaaatgtcacgacgttatgacggcccgtcactttgcgcgccaactttaacgctgcttcgaccgcattggttccggttgggccagtaaactgcagtttgtagttcaatccacgcggctcaagaatgtgcgtttgcagcgcctgaataaaatgcgctttggcttcagaatgcatatccaatccgtgagttaagccatcacgttcgatgtactcaaggagagcttgtttgaggacagcattattgtggccataattcagcgcgcccgcgccggagagaaaatccagataagcgtcgccttgctggctgtaaagccaactgcctttggcggtgccaaatagcactggaaaatgattcgcataagactgcacttgagattcgtggtgtttaaaaatatccataaccagatttgttatcctttaggtcagttcgatgattgaagaggtatgcgatagagatattccgtgtcgtgttctccttcaaaatggcaggtttcatccaaaaaagtggatacactgccttgctctccctgctctctatctagcttttgaaacagccgccaagacgcttgattggagcgcgtaatggtggtttcaagaaccgtgatgtcggctaaatcctcgcgcgccagcagatgtttgagcatctgataggctaaacctttaccgcgtgcactggggtgcaccgccacttgccaaataaacaactcgttctgctgctccggcttgcgatacgcagaaacaaatccgaccaacaactcttgctgttcagccatcaaacatgttgtttgaaaatgactggactgcagaaagttgcaataagctgaattctgatcgagcggcgcacactgcgcgatgagctcatgaatcgacaaaccatcttcctgtgttggccgacgaaatacccacggcagcgcaggtttgtgcatgatttgcggataaatcatccaaggcgtagcggtaaacatcacaacaatttcctttgtgttcaaattaaatatccatttttaccctagcagaacaagcagacatttcaagcttaaatcgcaataaatacctatcaaaagctaaaaaatccctttgcaaggaataaaaatactttgaactgaaacataaaatgaattttaaaataccgatgaaattgataggcagccagtgctaactcgcggattaacacccaagcgacttgacgttgcaggtaggggtaaatgacgaagagctcagatacacggtgtgattggtgtgaacgaatacggccagcacggctaccgcttcacgtaacaaatggctattttcgatctttcggcccatacggggatggatttagcagaggtttgaagcggattgcgagccgttgcattttgcaattgcacaatgcaaccaaatgaacagcaactccgcaagaaatgcacaaaaaccacacaaatacgtgcctgttaaacttggcacagatagtgcatttataggaatgacccttaattaagccgagggtcacctagccaactgacgttgttagtgaatgaaattgttcacatttgttttatcagccaatcacccttttgtgattggcttttttctttttaatccctgaacaactaaaaaccatttagcctgcaacattcaaggtgtgaaggcgttttccaacgattatgttaaggcgtcacacttcgcagcacagataaaatcatttttgtgtagacctttgatggaatgactccaccaagtcacggtcacgttgccccattctaataaaatggccggattatgaaattcttgttctgccaattcagcaatttgattagagaatgcccacgcttgtttaaagtttttgaagcgataccgcttttcaagttgggcaataccgtctcggtgaattaatgcccaaccatccagttcactgagcagctgttgctgctcttctgatgtcaaaccgatagcgcctgcactgcacgcttcacaacgtaattcatccagcatgttgttgttcctttggttgaaaaagaggcgggagtaacccgtcttgcatagcttgccacaccaacgccattacatcgcgttgactgagttgatacagttgactgagatccggcaacacataataaatcggctgcatgatatcaatgcggtaaggagtgcgtagcacttgcataatatcgaacggctcacgttttgggattgtgctttctgaagcgtaaagcgtttcacccggtgacgacaaaatgcccccgccataaattttggtttgtccctgttcttgaactaaaccgaactcaaccgtaaaccagtacagacgcgctaagtagctacgctctttgggggtggctttagcacctagctggccataaacatgagtaaaagcggcaaaatcagggtgcgtgagcatagcgcagtgaccatacacttcatggaagaaatccggctcttggagataatcaaactcctctctacgccgcaaaaacgtggccactggaaacttcttatcggcgagtaaggcaaagaagcgatcaaaactgatcaatgccggaacaggctcaacttgccaaccggtttctctttgcaatactcggtttatttccggcaattgtggcaggcgatctgtcggcaaattaagcatattcaaaccatctaaataagcttggcaggctctggttttcaccacttcttgctggcgagtgatcagctcatgccaaacagcatgctcatcctgatcccaatcaatatgaccatgctcactaacgggtttagagtgatactgagtcatcgccctactccttaacaaattcgttacattaagcctacctagcccaatccgaactgccaatgggatcttgctcaatcaagccaacattgatgtaacaataattttacaatggtgcactttttagttatttttcataggcctgatcctgaccagtcaagttgactttcgaacttgcgaggacaaaacttgttcacagtgatcacgtcagaattgatttttagacagggaatattatgtcatcgactacaccattgtggacgccaagccacgagcgcatttccgcttctaacctgcaacagttcatcgcacatgtgaacatgcaaggtgaagcgatcgacagttattcttcgttacatcagtggtctgttgctgaaacacgacaattctggcttgaggtgtggcaattttgcgatgtgatcggctatcgcggaaactgcattattggtgaaggactacctcgttttggtaaaaccatggttcccgctcgtgattcgatctggtttccacaagctcagctcaactacgcagaaaacctactctcatacgcattccaaaatcccgatgggatcgccctctggtttaaaaatgaaaatggccataccaagaaattcagttggcagcagttgtgtgatcatgtttccgtcgttcaacagtggttggcacaaaatggcgttggagagggtgatgtcgtggctggctatcttccccacttacccgaaaccgtgattgccatgttagccgccaccagtttaggggcaatctggacttcgacgtcaccggattttggcgtggaaagtgtgattgaacgctttggtcaagttcaaccgaaaattctgttttgttgtaatggctacacgtttaacggtaaatcgtttcccatgcaagagcgtaatgctcagatagcgagcgccctgccaagcctagtcaacacctgtcaaatcgaatatctgcaagatcgcaacttcacaccggatttcaatgatagcttttctgactggcaatcgattttcgccagttatcaaccgcgaggagtcgaataccgccggattggttttaacgatccgctgtttgttctgtattcctctggaacaacgggcaaaccgaaatgtatcacgcactccgttggcggtacgctactcaatcatttgaaagagcatcagttacactgtgatatccagccacaagatcgcgtgttctattacaccacaacaggttggatgatgtggaactggcatgtctctgcactcgccagtggcgcaaccttagtgatttatgatgggcatccactctacccacaagcgggagcgttatgggctctggttgacgaagccaaagtcagtttgtttggcacctctgccaagtacctagaaacactgcaaaaaaatcagttttctccatgcgatttttactcattaagccacttaaagaccctgtgttcgaccggttcggtgctctatcctgagcaatttgactatgtgtatgagcatgtcaaatccgatctgcatctggcttctatttctggtggcacggatatttgcggctgctttgtgcttggtaaccctatttctccggtttatcagggcgaatgccaaagtgcgggcttaggtttggatgtcgtggcttacaatcagcatggagaggccatcgtcgctgagcgtggagagctggtatgccgaaacagtttccccaatcaaccgattggattttggcatgatgatggcagccgttatcaccaagcttattgggataaatacccgggagtttggcatcatggcgatgaaatcgaaatcaccgacaagggaggtgtattattcttcggtcgcagcgacaccgttctgaacccgggtggagttcggattggcacggctgaaatctatcagcaagtcaatgcattacctgagatccacgattcgattgccattggccgccatattgaccgcgatgaacaggtgattctattcgttcaactcgcgcaaaacgtcccctttaatgacgagctgcagcagaaaatccgcagcttactgcgcgaacgctgctctccacgccatgttcctgctcacatttatgccatcagcgaaatcccgcgcacgaaatcgggcaagctggtcgaactggccgtcaaacaagtgtgtcatggtgacgaagtgaaaaacctaggggctatcgccaatccgcaagtgttagcggaaatagaaagattacttacggcataagtcatgactcggaaaatacgataacaaactgactacacggcataatccgagttatcttggcacatttatcggtttgattttcgtgccacagtggtattcttggctcagctgttctctgcatagactttttatggattatattcacctctcccgatttagcttaaaacacctgacagccctgcatgtcatgctcaacacgcgcagtgttacccaaaccgccgctcgactgtgtgtaagtccatccagtatcagtaaaatcctcgctcaattgcgtgaactgcttaatgacgaccttttttaccgggatggaaatcagttaatcccgaccccttatgtacagcaaatggggccaacagtgcatcatgttctgtccagtatgaatggcttattgcactgcaccgaattcgatcctcaggcataccaaggccactatcgtttagcgatgcgtgaaagtacatttgagctatttgcgcccaaagtcactgcgattctcgccgcctgctcatccgagctctccatgacgatacactccaaagaacattatggatttgaggctttgcagagtggcttgattgattgcattcttttgccacatgacatcagccagcccccaacctttgcccaagacttagtttggcaggtaatcgaatcggatgagctggtctgtttgatgagtgctgatcatcctcttgctcacgctgaactcagtgtcgacgcctaccttgcttataagcacatcggcattctcgataatgagctcaatgagccatattttgagaagtacctgactcagcaacacgaaactcgacgcattgctgttgccactcctgactttggtgcagcggccatcttgtgtcggcagacacatttgctgctcacttgttcaaagaggtgggcggatcacgcaatgcaagctcaaggcttggtgcaaaaaaccctaccctttgaatatggcaaggtggcttatagcttagtctggaacaaacccagcatgaatgaccgagctattcggtggctatgccagcaactgaacagccagttaacttgagatgaaaatgggtgaaaaaggaaagggtcagcaaacgctgaccctttcctttgttgctctgtttttgatttttgttaataaccctagccatgagttgtcagtcaataaacagaaactgagacgtgtactcggggaactgagcctcgtctttgattattcaatcattagtttaggtgcaaggttgaatttttgttagtgaaaagaagtaaatggtcaatttacgatttggaaaagatatgcaaatcacattgttaacgaaattgatatgcaataacccaatgaatgaaacagtgtcggtaagatttatccccaaacaacttggcgttacaggtaggcggcaagtgagagagtccccatgagcatagatagacgatgtgattggggtgaacgaacgtagccaacacagctgcagcttcaagtaggaagggggatagcaaaaagcgaaaaaataaagccgctgtacaagtagcggctataacgaactctatgaatcgatgaattacttacgagcaattccaaccacaacaggttgcgtgccttgtgcggtagtgacatcaaacgcgacccgagtctccacggcagagaaccccgcattacgcagcacagattcaatctccgtcgtgctcaagcctatttccgatttgccatcggctaaccaatcaaaatgcacaaaatacccgccttcatccactagcgtgaaaataatatcggtcacatcttgaagattcggtaagaaagcgcataccgatgaggcaacgaccaaatcaaactgcttacgaaaggctggatgttgagcaaccaaaccgcgggttaagcaatccaccacaggctcaacgttgcgtagttccttgcgatccagctcctcaatcatggcttctgatgagtccagcgcaacaatatcacgagcaaacggcgacatccgctgacttagcaagcctgtaccacagccaaaatccaaaatatgctttccctgcaaagagaggatttttgtcagatgttcaaatacgctttgcgcaaaagcatgggtcgctgggtctttttcccaatttgctgcgtactcatcccagtcgtgtgccatcatggcctccgtattacttcttgtattcgggcaatgctgccaagagtaaaccaaaatgaagtcaagttcatagagttacaacgcattctttgttaagaaaatccatttcgacctcatttgtcgagaatttatgccgataggcagcacattgaattttgtttattatcccaaaagttttaaccacttgggtctgctatgaacctgtcacaaatcgaagctttttgcactatcgccaatacaggctccgtctctgaagccgcgcgtcaactcgattgcaatcgtactaaattaagcatggcgatcaaagcgctggaaaaagaactcaatgtggcgctgtttgtgagagcgggtaactacttaaccctttccgaagcgggcaaagccgtttacaaagattgcgagagtttactcatcacggcatcacgtattcgccagacttgcgctcaagcgtgcagtgaatttgccgccgagatgtggatcgcgcgtgatgattcactcccagaccatttttggcaagatatcgccagccaattgcacaaactctttcccaacacctcttttaatatggttttggcctccagtggcgatttagccaacttggtcgcgacacaacaagtcaactgcgctttcggggtcgattatgagcgcttagacgatccgcgcatcacttaccaacctttgggtaaaatccgcctcatgtcggtgtgtaatagccagcatcctttggttaaacaaaaacgagttagcgatgaggaactgcgtaaatttatgcaagccgtcatggtctatcttaatgaaaaagataatccgaacctgcagcctttctcccgtcgctatatcggcttctcaagctttgaatacatgctcaatacaattttgagtgagaatgcttggggcgtattgcctgagccattgattcgtcactatttacgcgagcagcaactgaccgtgattaaacatacgtacggtctcacgcaagaagacttctgcttattccaacctatcggaatgcatgataaccctgccattctctggctcagtgataaggtgagtgattatctgtttgatttctagacatcctcctcctttctagacatgcccgcactcagcgtcaaaaatactgacacaggaaaaattaattaagcatatgttttaattatatttattttaaaatggaaatttaccttcctcttctcgtcgtaaatcgacattgcgattcccccatgaatcgccagaatgtgcggcgaaacctacgaggaaattaacgatgtgttctcaatccaattttaatgaaaagcgtgttttaacgctttctgcccttatcgcatcaggctttgctggcagtggtttgctagtcggtctactcgtcggctctatggtcattgtctttgatggtgtctattcgctggtgagtttactgttaacattattgtcgctggcggtatcacgttttattcaaaaaccgtctgacgctcgtttcccttttgggcgcgcagtgttagaacccctggttatcgcgataaaaggtttagtgatcttgctgattgtcagctattcactctactcctcgctctccgctctcctcagtggcggacgcgaagtggatccttctatcgccaccttatttggtgtatttagcgtcacaggctgtgctttagcttggtggaaaatggcaggcttaagccgacgtcacccttccgggctgattgcggcagaagtcaaacagtggcagatggataccttactgagtttagtggtcatggttggctttattgccgcttggttaatcaacctaaccccttgggcgcattattcggtctacgccgatccgatgatgatgctgttgatgtcgttttactttataaaacttccacttgggatgctgaaatccgctctgcgtgaaatattgttgatggctccaagccacgatatccagcaagccgtatcacacagtgttcaagccacgcaagagcacgccgaacaaccacttgagctttacggtgtggctaaagtcggacgtgaactgtgggtcgaagtggcgttaaaaacggccgaggatgattcggttgaggtagaagatattcagcgtatcgaaaaccacttgcagcaaagcttggcggcattaccttaccaattgcagctcacggtgagcgttgctcgctaactcatctcagcccgctgtcgcgggctgaatgttaactttgttctttaagcggcggaggcgtttcaggcacctcccctgttgatgaactcgactcgcgagtcacccaccagcagatcagcgaaccgaatgtcaccatgatcactccctgccagaaacttaacccgaggaccacccctaaaatcagcgatgaaaataaggttgagataaccggcgtaaagtaagaaagcgttgccagcagcaacatgttcccccgcaaaatggccacattccacagtgcataaccacttcccatcacaatgcccgttaataacagcgtccccatgctcgacccagtaaaagagagtgccggctcattactcaaagcgtattggagccagagtgtggcagcggtcgcggcaaaaaacagtacgatggcattctgccctcgtgctaaacgttgggttacattgcagtaaatcgcccagataaaagcgcccgttaatgccatagcataaaccgctggattggtagcgatgcgagcggaaaaatcggcgagcgaaatgccttgttcggcgacaatagtccacgcgacaccagcgaaagccaaaccaacgctcgggtaaacccaaaagctaaccgcacgctgactgagcaacaccgcgatcaatacggttaaggctggccaaaggtagttaatcaccgacatctctatcgcttgtaagcgatcgctcgccataccgagtgctaaggcaaggcaaatttcgtaactgacaaacagcgcaccgccaatcagaatatagcggctcgatcccgctttgagtcgaggcatccccatcgcaaacagcaaaaacagcgtactcactgtgtagatgagcgccgcgccgccaatcggtgaaaactcctcagcaacacgacgcgttaatgccatcaggcttccccaaagcaaaatggccgcgacaccatacaaggtgtgtttatgagtgatgaattgctgtttcacagtaaacctcaaagtggtaaccccttccctacctatcacgtcaagcagttgagggataaaacgccaagccgtgcgatcattctgccattgattcggcaggatcttttagtgagcgcaaaatacgcgcaggagtgccaccgactaacgtatccggtggaacatcctgattgaccacggaattcgccgctacgacagaacgagcaccaatcgtgaccccttgattaatgacgacatttccaccaatccagacatcatcttcaatcacaatcggtttgcagatggtttcccacgcttggcgacgacgataatctaaagagtgcgatgcggtgtaaaattgagtactcgggccgattaatacgtgatccccaatcgtgatgggtgcaccatccaacatcaccacgttcatgttgatgaaggtgtgatcgccaatacgaatggttttgccaaactcacagtgaaaaggaggctgtacgcaacttttatgaccgagatgaccaaacagctcacgttgcagtgcatagcgctccgcttcatcaagactttggttgatctcgagcttgagccttcccgcttggctgcgcagtgcctcaatttccgcggatgcgccgtcaaagtgttcacctttgagcattttttctaattcgctcatcttcattcccccgtgatttatgaacgtccattactcagctatcccccaaccagttggcgatgctgcctccagtcgtaaggggatcacatggttaatcacctatcagtaaatgaaaagtgcaaataagagcaaatcggtttcctctattcttctttgacgataggttcgagaggttcaacgcgactcaccagaagctgatcgactttgtaattatcgatgtccaccacttcaaatttatagccggcatagaccactgaatccgtacgacgcgggatcttacgcagcatatacatcataaatcctgcgatcgtttcgtagttttgttgctgaggaaactcttcaatcgcaaaggagcgcatcacgtcggtgatcggtgtcaccccgtctactagccatgagttgccatcacgcgcgacgatttgctcttccccttcggcaagcacccaagtgcccatgactgcgctttgtaagtcgttgaacgtcacaacgcctacgacaagcgcgtattcgttcatcaccaccgcaaaatcaacgcggttaattttgaagtactccaacgcttccgaaaggcttaacgtatcgggaataatcggacaaccaatgaccacattgctctctttgagattcattccttggccattaattactcgaattaacaaggccttcgagtcaacgtaacctttaatctgatccaactgcccatcacagaccaagaatttgttgtgcggatgctgagaaattttctgcttgatcacttcctcactgtcgctgaggttaagaaacaccaaactttcgcgcgccgtcatggccgatgtcactggaatgctctgcatttcaaacacgctctccatcatctgttgctcacctttatccagcacgcccgcttctgcgccagcatccatcacggcataaatgtcgtcagaggtgatctcatcattacgctcggtcggtacactgagggcgcgaaacagcaagttcgccagtccattgaagaaccaaacaaacggttttaacaaagtaatgcaaatcagcatgcctcccaccaaactggtggcaattcgctctggcatcgccatagcaatccgcttaggcatcaaatccgcaatcaaaataaacatactggttacgagcataaaggagagcacaaaactggcttgtgataggagattggctggaatcaatccttccagcagcgctctgatgtaaggagtaaacgccgattcccccacaataccgcccataatggcaaccgcattgaggccaatttgcaccacagtgaaaaaattgcctggccgagcttgcagctctaacacccgctcggcacgttcatcgccttcatcggccatctgccgcaaacgaattttgcgcgccgcagccaaagaaatttctgacatagaaaagaaacaactggcagcaatcagcgccatgatgatcgagatgttttcgaaaaaactcataggtgtacacccaaaatcaataaaaccaaacggcttaaaacacgagtaacagagaagataagcgagagataaacacctctttatccgcctcgttcagcatagacgaacacgagacggatagagaggcacactgcaacgtcaagcaggaaaaggattactcggtgcggatttcccacgaatgagtcatctcaacacctttcccgagcattaaacatactgagcagtatttctctagagaatcagcggtgacgcgcgctacgatctcttgatccagatcttcaccactgacgacaaaatggatattgacttgagtgaacagtttcggcgcggtatcacgacgctcagcagacaattgcgcggtgcaaccatggattttttgtcccgcttttttcatgccatccacaacatcgacagagctgcatccacctgcggccatcaacaccatttccattggacttggagcactcgctccaccgttcccatccattacaatcgaatgaccggagttagataacccaataaaacgaaaatcttcaacccatttgacttgcgcttgcataacggaaccccactaaagtaaatgaccgccagtatgttagcacagtggcatacggaaagatgccaagagacaaaagcgaagctaaaaaagaaaaccccactaagcctaagcttagtggggttcagttctcactcgcagcaatcccgctactaataggtgctccctgcatctattccttgatagtctgctgtgtccttcagcacaatccgtttcatcgccttcctagcggtgtcccttcctctgccatcctgacagaactcgcttagtccattaagttgtccattaactctccgtttataaccatcctagttattaagcgtccagctaacgtcctttgctctccttgccgaccattcatcctgaacaatcgaaatcttcgtcctgaagatgaccaatccttgggtctttcctgttccgtgtccgcttcctgctgacgaattgactttacgatatgagcgtatttcagcaaccgctgttgagcatttttattactggccgataggcaatttcaaacataagacaaaataaatcaataacataaaaacaaaacaaatttaaagtctgcaatcaaaagctaaaatctcttacatcagacgtaagagatctcgcacaagataaatcctaaaataagaaggttctgctttttcgcccttcgcacactctgtgatgccgctcgcaagagttttcccactcattcaaaccaagaaaagcaccgtgttcacaacagagagatctccaaacgactttgcctagccaagaccacaaatgcttcaagtagagaaaggctatagactcttatcacaaaaatcaggatagtatcagcgagagtaatgtattgggcttacgtactcgatggcttgaccaatgtcgcgaatgaatgaggaacaacgacatgatttcaaaatgggcgcaacgttttttccaaatggctgaattagttggctcgtggagtaaagatccttccacgcaggtaggcgctgtgatcaccaaacaaaaccggattgtctccgttggcttcaatggctacccacacggtatctctgacagtgccagcaccgatgaccgtgatatgaagtatttgaaaacgctgcacgcggaagagaatgcgattttgtttgccaagcgtgatttggatggctgtgagatttacgtcacccacttcccttgccctaattgcgcggccaaaattatccaaactgggatctctgccgtacattgtcctgagcaatccgaagattttctgtcacgctggggcgataaaatcaaagtcagccaagacatgttcttacaagctggggttaaagtgcattggctacctttggttgaactgaagcacatcaatacgattgagctgccttcagaatcgagcaatccataaacagaagcgatatacccaaacaacttggagttacagccaacaccactgcagcttcaagtagtaaggggataaccagcaaccatcgtacttataaatgggacaccgctgtcccatttttgatttttgtagcagcgcaccgcttccactttatccgctgttttttctctcttatgcgcagatgacaaagatcgccttctagcactttattctgccaattttcgcgaagcactgcacattgaattgcaaaacgcaaatctactcactgaaaaaactttgaacttagtcattatcggaacgaaataagtcgccaactctgccaatgtcaaccctgactaaaccttggtaaatagaccaaacactcatcaaaatcactactattacgtgatatatcaatgcattatttttcctagcagaaaaacgatcacaactttacaatcgcgccacataaaaataacaaccatccgcttgggtatgccgaaatcggatatcccaaaccacttggcgttgcagataagcagcaggtgagttcatcactatggggatagataaacgggtatagataaacgctatgctcagggtcaatgaatctagcccatgctgctgcagcttcgagtagaaagcattataggatggtgcacactccccctacttaagtgtgtataaaaataatctgtatcaacactctcccaaaactgtggcgatgcccagcgagggaattaactctaacgtgaaaggtcccaagtcaaccatgagtccagagaactactttctagactggcaaaaaagccaaacccttgcagaaaccctgtctcccttaattggtcaactctatcgccagaaaggggttgaagccgtgttgtgcggtaaaaccctgattaatgcgaccacgatcgacatcattaagactcaccgtgtcgctcggcgctatttaagtgagcctttggcactcgataagaccttacccttagtgcagcagttatcgacgcttgagttagccccctgccgaattgatattggccaacttgccagccagtattggcagcaacatgacgatgagcatggtttgaatgattttctgcacaccgcattagacgccgcactacaacccgctcaggctattgagcccaaagatgtggtgctgtatggatttggccgaattggccgtctactcgctcgcttactgattgaaaagagcggcgcaggttatccgctgcgtctacgggcgattgttgtgcgtggtggaaaagagggcgatcttgaaaaacgtgccagtctactccgtcgagactcggttcatggtcaattcaacggcagtattactatagataaagagcgtaaggcactgatcgcaaacgggaacttcatccacgtcatttatgcgaattccccacaagatgtcgattataccgcttacggcattcataacgctttggtggtggataacacgggcgtatggcgcgacagcgaaggcttaagccagcaccttgcctctccgggagcgagtaaggttctgcttactgcgccgggtaaaggcgatattaaaaacgtggtgtttggggtcaatgaatcggtgattcagccggaagacaccattatttcagcggcaagttgcaccacaaacgcgattactccggtgttaaaagcggtgaatgaccgtttcggcattacttctggacacatcgaaaccgttcactcttttaccaatgatcaaaacctgatcgataacttccacaaaggtgagcgtcgtggtcgagccgcatcactcaatatggtgcttactgagacaggcgcggctaaagccgttgctaaagcgcttcctgagttaactggcaaactgacgggtaattcgattcgcgtcccaactccgaatgtgtcgatggcgatagccaatctcaatttagctcatgccacgactaagcaggagctgaatgcttacttgcgagaaatggctacccattctccactctcaggacaaattgattacaccgagtcgactgaaattgtttccagcgatctggtgggttcacgttatgcgggcgtggtcgatgccacagcaacgattgcacaagatagccgttgtgttctgtatgtttggtatgacaatgaatttggctatagctgccaagtggtacattgcatggaacagatgatgggtgtgcgttatccgacctatcccgctcaataaatcaccgtctccacaacagacccaaactacgtgcagcgaagctcgatagtctcgtggcaggtggaatgggtcaaacaataacaaccataagtcgtgctgcgctgatcgcttcgcgatgagcaacatcgacctctccctcaagcttgccgcctcactgatgtgggcggcttttttgtaccgactcacccgctttaggtcagaaatacgtcaagtttgtcctgttatggtgaaaatgaacattgttcattttcgattaatctagttcagggtaaggtggctttgttacttggaggaaccattatgaaccgattcctgatcaccttactgtcactgattactggtgtgttcgctttgatctttagtctgctgctcgcgattccattgactatcgcagcgttaattacgggcaaacgtttagaaaaacagctcaaagcacgcgcgtttcaattcaaatcttccgcgacttatcagcctcatgccaatgtgattgaaggggaatgtgaagagatctcgccacgccgttaacaagatgacgagagggtttgaggtcagctcaaaccctaatgaaatgagttacaccgtccacaacactcggatcgctaacgcaatcagcaccaggccagacagcctgtcgatgagcacggcgcgggcgcgcaatttatcgagtaaacgaggcgaagataaaatcagagtaatgaagctataccaaagaccatcaaccactaagggagtgatgacaatcgcagccttactggtcaaatccgagcctaccgcgacgtattgactaaacaacgcgataaaaaacagcgcaatcttaggactgagcagagaaatcagtagcccttctctagctgattgccatacgctgaccgactcgcccgactctaacttagccgcgaccccaccttttgaacgcaaagcgttccagcccaagtaggcaagataggcggcacccgcatagctaatggttttaaacagtacaggagattgatgcagtacgacggccaatccgatcagggtaataaaggcatacaccccaatcccgaacgcatgagcccaagcagccgcaaagccgttcttacgtccccctgccaaactgtgtttagccaccattgccaaactcggtcccggcgacatcgcccctaaaatacaaatcgtaaatagcgataaccacactgtcagtgtcatgcaagctcctaaaaccaaagactgagcgagcaacaatataagcaaatgaagggaaaatatagataaatgagcgataaatatcacttcgaattttgattgaatgatttttgagtgaatgtttattcagtgaaagaccttatggaatggagtatgctaaagctcaaattctgtgcaggtggcgtaaagtgaatcaactgaaaaaggatatttctctgggagcaggaattgctcaactttccacgacgttaatggggaccgggctgtttatggttccagcgattgccgcagggatcgccggtgtattctcactctgggcatggctgctgctgtttgttgcgatttgcccgatcgccttgacctttgcgcaattaggtaaacgttaccccaatgcggggggcaccgcttactttgtacgccaagcatttaatccacgccttgaacgtgcagtggcatggttgtttctcagcgttattcctgtgggcgttcctgcggcagtcacgctcgccgccagttttctgcaagccttactcccagcgcctttggctaacccactgctgacccaaactctaactatattgctcttagttggggttaatttggcgggtactaagtcatcaggccgtttacaaaccctcatcgcgttggccattttcagtttggtgattgctttttggtggcgtggtgaagtaaccacgcaagatttggtcatgcctgcattaacacaggaaggatgggtttcgatcggagccgcgctggcagtcatgttctggtgttttgtcggcattgaggcttttgcccatatgggagaagagtttcgtaatccgcaacgcgattttccattggcgattttgatcggcagttttgtcgctggattgacctactgggcgtgttccgtcgtcgtactcaaatttagtgcgtttggcactcctcaatttgatagtggcgcgattccttggctcagtgaccaactgtttggcactcgctgggcaatcatgatcagtgtgattggctttttagcctgttttgccagtctgaacctttacacccaaagcttagcgcgcatggtgtgggcacaagcacgagaatatcgtcctgaaagtgcgatcgctcgcgtctcgattcggggggttcctgcccacgcaacgttactcgtcggagtggtactgtttgcttcttgctttattggtcatttgactgggcttgatctcgaattcttcctcaaactggcgaatggcatttttgtgttggtttacttattggcgatgttagccgcattcaaactcctgacggggtggagtaaacaccttgctggtttggctttggttctgtgtgctggggtgtttctctgtttaggctggtcaatgctatacgctctaggcgtctttgtgctactgattcggccatggcaagttcgggtgcaaacaatctaatggtgtggactggtaggtaagagtaagaagggaaacaccgctttagaaaagttcaacgtcatcagaaaatggccgttgcgcgctggcaattttaccgttctcacacagctgttcatagcagtgcacctgattccgaccatgctctttggcgtaatacaacgctttatcggcatggtcgagaatggtaggtaaatagtcacccggcctgagtgagcaaaaaccagcgctgaagctcagttcaccgattctcgggaagttatggcgtcggatctgttgacggaagccatccaactgttgcttgatttgtggctcattaccgcttgaaaaaataatcacgaactcttcaccaccaaagcgaaatagttgagaagacggtccgaaatagtgctgcatctgctgagcgaacataagcagaatttcatcaccaatcatgtgtccgaagtgatcattgatcgctttaaaatggtcaatatccaacatcgcgatccagagtttgtgattctcttctgtcgagggattgatggcaaaggtgtggcgcaatcggtcttctaacgttcgacgattgagtaatccggtcagcttatcgcgttcactctcatgcaaaatcaccgtgtaattacggtaaattttcgcaaatccgttgatcaacatgcgataaggttcaggatctttattgaggattaagcacagctctgcggaaaagtgttcttctatcggaatcgggcaaaagcattgatattggccattcgcttgttgggaaaacgccatttccgattgagagtgctggtaaccattgtcggcacatacttggtcgtattgccactggtactcctttttacctgcagcatttttggtaataattaaacgtgccaccataagggttgaacgtccaagatggtgaaataaggtcgccgtggagagcggtaacaattcagacaaggtcgccaaaatactgtaactgagtgccagcgaatttttctgctcagtaatttcaataaccgactcaagcactttgtcattcatacgtttttctatccgaaggagaaccgcgttttcccaagtataggaaaggaaacggggaatagaaaaatcgcgagaagaaaaaatcagcccctagaagaaggggctgatgattcagtcgtagaatggaacgttagtcgtgacgcaacaaattctgatccagcaaggtgccgataatgtccaatgaactcattcccgtgaaatcaatttgagtcgcgaggttttcgatcacaatggtttgttgaacctgattatcggtcgtgacttgcaaggtgacatcattatccaccacctgcgcggtcaattgattggacacgctcaagttgttcaacagttgttccatggttaagtggttaccgaggtcctgtaccacatcaatcaggtcaatgctatcgccttcgttgacattgaaatcacggatatggtcaactttatcgtcgactccgtcgagcgtccatttgaacatatctgcgcccgtgccaccgaccaaaatgtcagcacctaaaccaccgaccaagacatcgtcacccgcaccgccttgaacaaagtcatcaccgctaccggagagcagcgtcatgccactattgcccgccaccagcaaactatcatcggttgcactgcgatgatccagcagtgagccatctgccgcaatctcaatccgataatcgatgctgtttgcggaaggcgcgctgctaccatcactctcggtagacagtgctgtaagcgacaaggtgtgtactccctcatccaaaccgactactttgagactctctagcgcatcaggggagacttcccagcgaccattacctaaatcagtcactgagcctgccgtgctgcttaagcttgctcccgctggaagatgatcaacacgcaaactcaatgtttcatgtaaatccgttaaggccgcaatcgcgcctaaaagagcaatcccttgtgcactcaagctctgattagcataaatctgctgggcataaccgaaggcaggattcatgctcaagcttggcgcgttagccaccggattgacctgaatcgggtaggttttgctctcttccaatgccatacctgaggcattttcgaaatagacgcccatatcctgcgccgtcacggtgagattgatttgcgtccctgcgatagccgttgcatccacaaataagccgtaagcggagtcactatggttcagtagcgcgttaatcgcctctgggctgccttcgaggatcacactgccatctaaggcataactgacggccactgagctgcctgcaggcgcttgtacactcaaaatgccttcgctgatactcagtgtcactttcatcacatcattcgtgtgtgatccggcataatccacatcagacaccgtaatgccagtcagtttttgccctgacgcttcatcaatctgagcggtcaagtggatgccatccacttcgggtttgtcgttgacagccgtaacatcaatcacaaactgcgcgctgttatcgtgcgcggttgatgcatcgcccgcgatttcgctccccgcattgccgttatcattcacgttaagcgtgacggcgacctgaccataaaaatccggtgatgggacgaatttcactaagccagcgccaatcgcagcattgatctcggccacattacccgtgatggaaagcgcccccgtaccatcgccctgaatggtcaaaccgctgctgagcgatgagtcgatgatcagcacgccgctattcacaccgatttgcagcgtatagtcagcgttcgggtcatccaactgagcatcaatatcggccaacgtaaagctattgagcagtagaggcgtatcctcttccgtcacttgatcctgcacgttaatcaattcaggacgatcgttcaccgccgtcacatcgacatgcacatcaaactcttgcgcactgccaaggtgctgatcacctgccaatccggtatccacggactgcactttaaaatgcagattgccattccaattcagttggttgttatcaccggaattgaacaccactttatcaagctgctgcgcattaatttcaaatacccaaacgccgccaccaagagaggttcccaaggtgccatccgccaagctcaagaatgcaccatccggcactccggagatctcaacacgcaaagtctctgggctgttttcggtgtaagtcaccccacccggtaagcttggtgctttatcgagaatttgcgcaccaaggctgatgtcaatcgcttgaccttcattgccaacaacattcgttatcggagcaatatccacatcatcaccaataggcgtcacattgagtgtgaactgccctgtgtgttcaacgggttcaccaagcaatgattcttgggtaaatactttgatccccaattgcacttcgccactgaaatctttggtcggtttaatcgccagtgcggatagatccaagctggttaagtttggattgcggatttgcacgctccactcgccgccgccgttatttttcaccacatagtcactcgacagtgacttgacgaggaaatcggtcggcagtccagtaagaaccaaggaaacaaattgttccgagccatcattgtcattcaggctgacattgaacgcattgccttgatcggcaagggcaatccaactgtcttcatctcccgtcaccgaaatcggactaccagagccaatcgtgatgtcatccaccacaggtttcacttcaaaactgacttgtgaggtgaaggttttatcggcatcactgctgctcacaccttgtaaactggcgttggtttcatcaaatacggtgctgtcagtgacttttccggtcacagtcattcccacggtattgatatcgttaccgcttggatagttcggcgctggtttgaagtaaatttcgccgagtgcagctggtagctcagcttgagtgagcgtaatactcgttcccaaactttggccgttggcatccacgaagacaccagagttggtgtcattcaacgtcagtgtcacttcggttaacacttcttgcccttgcgtactgccattgaggctatccgccaagccgatcgctaagttgagatgcacaatgccatcttcataggcgataccgtcttgcgttggggtatcgttcgccaaatcggtcggttgatggttcgcatccagtcccagcgtttcttgcacattcagtgtaatgcttggggtcacatgattatcgagtggctgatcgccactgctgctgggtacatccgcaaccggagagatcgcgacaggcacttgcgccgtcaatgttttctcatcacccgactgagtatctgtcgtcacaaacgtgatcggcagcttaaaatcccccgcaaaatcgcgcggtgggatcagcaccagtccttccaatccagaaattgaaccatcaggattcagcgtgcctttaaatacatagtgaccatcaacaaagttgaaatcttgcccaccaatcgaggcgccagcaggcagatcgctcgcgttaatcacaatactcagttcatccgccaccgcatcaaaaccggtggcattaaccatgagtttgtcttggatctgttgccctaagtttaccgtgttatcttctttgccaatcaccaaatcatcggcatcgccaacccagttgagctgcgcggcaacactgttattacccgtgacctcggtggggaaactcaaggttaactctgtactcacctgcttggtgattttcacttcgctgctgtcttcaccttggtcatagactttagcagtgatggtgatcttgatgtcattgaaaccgttcttatccgggtcgttattactgctgtacaccaaaccattgggcgctttgatgctgaaatcggcttcgttggtgattgtccatgtaccatcaccattgttgatggcgccggtgatcagcagttggttcaatacttcctgcggtacgttgccaaagctgaccaccagttgatccaccaactcatcggactgataactgcctgcggtattgctatcaaggttatcaaagcgaatcacattcgcccccgcttgaccgccactcacattattgatggtgaaatcaatcttgccattggcatcggcttgcacggtttgggttacgctgcccgcgttttcgaccaaaagctgtccatccggctcagcgatcgggttcactttcacgccaatcgaaccgtggatcacttcctcggcaataccttggcccggattacccgcatccacgtactcgtggtcttgctcttttacggtaatcgccgtactcaaagtgaagtcggtactggagttgtgcggaggaatgacctgaatgtagcccgccgcggaaacctgatttgagaaatcgagatccgattgtcctgctgcaggttcaagtaccagcacgccattgattaaggtcacttccacattattgacgaacactcggctaccatctgggaagccagagatttcaactcggctgaagtactcttgcgcatcagggttttgaatatttcccggtgtgttttgtggtacccaagtgacatgaatacggtcatcttcattaccagacacagcattgtgatagttttcggtcacatcaattttcggctcgaccaaaatacggatcgtctcttccacttggcgaacatgaccatcattttcagtcacaatcaccgttgccttgatatcaatattggctgtcgatgacgccactggctgaacctgaatacctgtgactacctgagcgaccgtcaagttggcttgataaatcggtttatggttgctgtcgtagccggcaaacaccaaatcgacgctcgtaccgtcactgtcaaacagctttacaccgtccggaatgttcgagagcagtaccgaaatggtttctgagctgtccgtcgggctgtccgcgatttcaccagaaatgatgctgaagttgagatcgactaaactatcttccgctacggtagttatcacaccttgatgagttccgtcattaaatgactgccattgcgtattgccgctaataaaatcaatattcggaagatcggcgactcctttcacggtgacattgacggttttgctgcctagcgattcaatatcctgcacttgaccggttgataggttaaccgtgtctttcacaataccttcgaccacgaatgagaaattctcattgctgtgtttcgttggtagaacctcaacctgagatagcgcactctgcggtatctcataataagtttccccattagggtaggttccaaccgtgatcggacttgggccagagcctaaccacaccaaagtggcgcccgtatccgtaaaatcggacagacgaacgaacagcgcttctgagccatctgcatcgcttgagcctgtcatggaaatcacttcactgagcagaagaggatcgtgctcaacactcggatcaaccgcgttttgattagaggcgttatcttcaaaaatcgaaatacgattaacggtaaagctgccgcgatccgcttctggcgcaacatcaatcacaatctctttggtttctgattgtgccgtctgcttgccagcaacgtaattggtggactctttagtgatggccgtgacatccagtttgatttggcctgcaaagttatccgccggatcgacctgaacttgggctatcttgttggccggtacttcataataagtaccgttagcatcggttttggttgggatcggcgagccatcgctgtacaccaagttggcgtttgcgccattttcagtaaaacgaatctggtaggtgatcgcttcaggattactgttgtcttgagtctccgctgcgatattgaggctaacattgctgccatcctcaaccgcatcatagtgaaactcactgctgctcttccaagtcgcaatatccgctacgctttcaatctcgatgcgcatgttgccgttggtgaaatgatcacgcacaccattgtgcagaatttccacacttactgaggcattcatgcctccattgcctgtcgagtagtgacgatccggcacaaagtagaggttttcgaccgtggcaatagtgccattgatcgattgttgcaacagtgcggcaggcagcacaacatgtccgcttgccggatcgacatccagtttcactagctggttggcgctatccaaataatagaaatcgccacggatctggtttggattccaaatcgagacttcacctaagctttccccttggtctacgtcatacaggttgacctgcaaggcgagtttcagtgcttcaaccggtaatccacccaagttatcttgcgcattgctttgctcacccgcaggcaccaagttcagagccgcatcgtggccttggtcttcatagcccgtaaatttctgctgagtaatggtcgctttgtgatcgtaaatcgtaatgttgagctgttccgtcgaggtatcgtgatcgtaatcggtcgccgtcacatccacagtaaatttgatgtcgtttccatcagtgtgatccaactgtgtaactggagtaaacgtcgccgttccgttaggttgaatggttaatgtaccaagatcgcggctcacaccattaacgatttccaccacagtgacggttttcgcggcgccattgagctcaatatcattactcagcacactgccttcacgaaactggatatcacgccccgcttcgtctactgcactaaagtgagtaatcactccgcgatctgcaccttgtgtatctgggcttaagttattgtcacgcgagaatagattcaccgacgatgccactgagccctcttgcagtgcgatatttttatcatgcaggatcggtacatcatccacgatagtgacaggcaaggtgatcggtgaggtatcgccgtcagcatcttgcgccagcactggaatattcagcgttagctcattggcattgagcggatgatccaccgcgccatttaaagtaaagctgtagctgccatcagctcttaacactagggtgaagatcaccacgccattggcgataccttgataggtatagacttgaccactactggttgtagttatgctaggcgcgccccataccacaggctgaccttgtgaagtcagcccggtgttgctacttgtgctggtatcaatctgataatgggcaatgccatctgcaccttgggtggttgtaaattgaccattggcggtggttgattctttgctttgatctgtaccagtggctaaatcatcttcgttgaccgacaaggcttgcgcactgatcaccgatggttggtcatctaatactgtgactggcagcactatgctcgccgtatcgccatcaaagtcggtggcaatcactttgaaattcagtgtcaagctatcgctattcagcgcatgctcaaccggtgccgccagcgtaaaactgtaagttccatcgctatttagggtcaaggtaaagacggtaactgagcctgccatcgctgtgtaagtcaggttgccattaccatcatcgacaggcgctgacagcgtcaccgccacgccatttgatgtcagcccttgtactggattgacgctgctatcgagcgcaaaactcgcgaccgtatctgccccttgcaccaactggaattgaccattaacggtcacgggctctttgtcggtgtccgagccttgtggcaagtcgttttcgtgtacgtacaagccctgcacattggtgaagtaaggcttgtcgtcattgattttgacgggcaacacgatgctgtcgctatcaccatcaaaatcggtggcaatcacttggaaattgagcgttaaatcgttgctattgagcgcatggtcaaccggcgctgccagcgtaaagctgtaggtgccatcggtattcagggtcaaggtaaagacggtgactgcgcccgccatcgcggtgtaagtgagatttccatgaccatcatcgacaggcgctgacagcgtcaccgccacgccattcgacgtcaggccttgcacaggattgacgctgctatcgagcgtgaagctcgctacgcgatccgagccctgcactaattcaaactgaccactcgcggtgagtggttctttcgtcacatcagaaccttgcggcagatcgttttcatgaacgttcaaactggtgacattggtgaaatagggtttgtcatccttcactgtcactggcaaggttatgcttgctgtatcaccatcaaaatcagttgcgactacggtgaaattgaccaacaactcatcgctgttgagcgcgtgatcgagtgagccttgtaaggtaaagcggtagctcccatcttggttgagcagcagagtgaatactggctcaccgccagccgtcgcggtataggtgtaattgccgttagcatcaaccgattcgctcaatgtcaccgcgacaccacctgacgtaatacctgctacggaatccgttaggctgtctaaacgataagacaccacaccatctgagccttgagtggtagtaaaattgccatcggccaccaaactcgcgccaccaccgatcgagcctgtatctaaggtttgttctgcgacggtaagctgctcggctccgataatgatcggtttatcatcttgaatttcgatattcaaattacccggtgctgagctgtcgttatcgtaatctatcgcgacaattggcaagctaatggtcaatgcatcactgccggcagcatgatccagagtgccttgtaatacgaactggtaactgccgtcggcattgagcgtcagttggaaaatatcacggccgcccgcggtagcttgataaacgcggttgccatcaatcagagttggctcacctaatatgaccgcgtcaccttgtgaagtcagcccagcgataggattagcagtgctgggatcaatttgataagacgcaacctgatcggaacctaactgagtatcaaactggccagacacagtcagtggatccgcgccatccgatcccgcgggtagatcattttcattcaagctgagggtcggttcatcgaccatcaccggcgcactaccatcattgatggccacaaccacatcaatcggagcttggatcacgttgccgttactgtcggttcccgtcagttggagtgcaattgaaatttgatcaccactgatagagaccaaaccgccccccaccgaaggcaagtggtcaatcggctggctgagagtggttgtgatggtgagattaacatctcggcctatcgattccgcgctaatcgcgatactcaataccgtgctaccgttttgctcaccaataatgctattggtcgcggcatcataacggaaaactacaggttgcccggaagaggtaatgtcttggttgagctcggcaagcagcgaggttaaaaaagccgcttcaggcacaaaagaggctggcagcagcgcgaggctacctgccgtaattaagctggtcaccgtagacgtttgcggataagtgccaagtgacagcgacccttcggtgacttgcgtgctcaggctttcaccacccgcggcaaaacgcagtgggttaaccaaagtttgagttgtcgaaaacgtttggttgtagccttgagtatcaaaggcggtactggcaagcacttctaagaagttatagtcaatggtaattgcaccaccgttagccgagccacccgcaccagcgcctgccgcggcggcttctaatgcggtggttgggtcgacaccgtctaaaatcgcctgctgaatcgccgcgatagcttgctcatcaaaattcgccgtatccaattgcgctaaatcaaggttgatttgaccttgaacgggtgcagcttgcacttccggctgtccatctgctgagaactctggcaaacacgccacgcagttctcatcaatctgcacaccaccttgtgttgtttgcagttcgatcgcagattgattgaccgtaatgataatttcatctggttgcagaacatcccctgcattcacaatccgcgcttggccctgcgcattaacaacaaccacattgccagacaaacttgtgactgttacaggttgagtgacgacttgagactgcatactgcccccatttctcgcggtaaataattggtaataaattggccccctttcactttgaaactgcagccgtgttgctcacagccataccaataagaaggggatatttttatttggaatcgtgattatgaatttgtaactaaacttcctgcttaagttataagcgatgcataactaaataactactaacaagaaagctaaatagcgacagtctcaattgtgaaatggctcgcaagcactcttgcgaattaattgttagacagtaggagagtggagagaaaaataggcaggcgtgctatcggtttaactgactttgaataggtgctgcagtgctcgactcacgggtagctgaagtctatcaatatgcacccacattttgccgccaaaatcacgggtaactttatcgatttttccgacattgaccacgatagaacggtgaatttgccaaaactggttgggatcgagctgcgcaagcagctctttcaaagaagaacgcaacaaatactcatgcgttgtcgcgccatgcactttgtacaaagagaggtacttatcctccgctttcacgtagagcaactcatttacggcaataagatggatctcctcacctttactggcttttaaccagacctggtattgaggtttaacagtgcgagtaagttgctcaaattggctcatcaactgtgccaaatcattgcttggagccacgttacgccgcaattgttgctgcaatttttcgcagcaactcgctagtcgagaagacgaaagtggcttcagcaaatagtcgatagcatgtgtttcaaaggcactgactgcgtactcatcatacgcggtgatgaaaaccactaacgggactttaggctgttgaagtagacgccgagccacttcgatgccatccattttaggcatccgaatgtctaaaaaaaccacatcaggctgatgctgttcaattgcctgcaaagcgatttgaccattttccgcactggccacgatctcaagcgctggccacaactcagccaagagcttattgagatgatgacgcagtaaaggttcatcatccgcaagaaccgcagtgtaggtctggttcatcattagagcctcttcttactttttatatacccaagttgcttgacgttgcaggtaagcgccgaatgaaaaatttatctggaacagattggcatcgccgtaggccgacctttgttgcttagccaaggatgccctcattcctcttattatgcgcatagacaaactctacgattgaggtgaacgagcctgcgagtaatcataaaaagaacgctgcaatccctgcaaatggtgcaaacggatgcgaagcgtggccgtaacgccgccagagcaattttgcgccacggtaagtaaaccttcatgtccaaagagcccagacagtcgatcgcgaacattctgcaaagcaataccattgcccttgggggtatcacttaagcccatgccattatcttctaccgatagctcaaaccagtcatcagccacttcgattctcactcgaatagtaccgccttcggctttaggttcaataccatgtgacactgcattttcgaccaaaggttgaatcaacataggcggcatgccgagtgtacccaattctgacaactcgggcagagtgtattccagcctttcccctaagcgtattttttgaattcccagatacgcatcaatcagttgcatctcttcacgcaagtctcctgtattggttcgtcgcaagcgcatagtaccgcgcagtaactcagtgagtttctccaacattaactgcgctttatagggttctaccgcaatcaaagcattaatattggccaaagtattgaatagaaaatgaggctccatctgactttgtagctgcttgagttgactcaataacagcgctttttcttgctccgactggcggcggcgagccgcttccaatgcgccttgagctaggattttttgttcgtgagaataaaaatacaaaaaacagaccgcggaaaaaataaacccaagaaaaataatgggcttataagcagaaaactcatcaaagcccgggtaatggcgcagccatagataggcgctgctggtacccagcaccaccgcacagcttaaagataagatattcaccaaacgttttgatagttccggccagcgccgtgcaatccattgcgcggaaaaaaaggcgctgtagccataactaaagctgatggcgagatgctctccaaatagcccaccccaaattgacatcgtcgcgagagcgatcacgatgcaaaacagtgtggtaaaaccaaaacttttcaaatcttgtgctgaaatatcaaagcgttccatcatctagaattttccttttagattgaacaaaaccctaacgctatcgggtaagttgacgtacgccgaatccgtttcgccaccaaagaaacgcgcggccagttccagttccaaagaggcagagcccgtgtcgtaagcttgccaattgatccattgagtaatcatccaaccgccctcttccggagaccacaaaacatcaagagttggcgtgaggttatccataccaaaccgttgaccattaccgctatcccatgtccaatgcagcataaaattgtgcgccaccaggttagtggcttgatagccttgtgcatacgcaaaagccattggtgaccggccctgttgatgcagcaaagtcgcatcagccaatatttgctgccattcatcagcattccaactgcgtccgtcgtaccagtattcggcaatgacgttgtgcccctctgggtttgcccagtttatgccaaacaaaaactgcgccgcattttcttgtttaaccaattcgatcggctgctcagtttgtctttggtattgccaatattctcgttgatatagccaagagctgtgcacgccccatgtgctattgagtacagaaacccacgagccgcccactaaaccacgccggacattgtcgtaataaacgatgccttggatttcactctcccctattaagcgatagtggcgtaatccaatgccttgttgttcattttgagtcactaactgcgcttcgctcgaacgcccccaagcactatccgtggcgatcaaagtccattcacctaactcttgataggaggagagcgcgagcacaccagccccctcttccacttgaatacctaatggattgcgccgatagggtaaaaaaagatccagcggccgataaccatagcccactccccaatcgagacgaatttttccggcggtaatatctagtgtttgtccagcaagcgtgctttccccttgccaaaacagttcactgagtgtcagcctcgtttcttttgcctgctcatcacttcgatagagtgcgtggctagtgagcgcaaaactcgccgtccaaccttgccagcgagactgtaaatcgagcccgatatccacttgctgctgttcatcatcttgagcagcagcccacaccaaggagtcattgcgttgagcatgcgaagcgctcaccatccaatcccagtctaacttgagcggctcttgtgtccatgcaggaggacaactcagtagcccaataattcctaacgcctgagcacacctcatagcattactccaaggccgtattttgaatcaaatacgccgggttgtagaacttatcctccaaacgtttcggctgtacggattgatattcgatcacggttcgtcgcaagggttgaattttatccagcaacgtcatctcaaccactcgatcaccttgcacggtaaaccacgccaccttggccagtttaccggaatgcagataaagttcggctttgattggtgaagcatccgcacgattaagccacaaggtgatcgcttgatagctggcccctgcggttttcgctttgagcgccaagcggtacgtttcaacgctggattgatcttcacgttgcaccgagtcttctccctctaaactcgcttgataatcatcactccaagtcagtgttgaaatatcaccgactgaagcttcaccgagcagtttttgcatcggtgtaatacggattgggcggcgacttttcggcatcagtaaccaatagttatctccgagcatcaacattttttgtccagcttctgtcgccgattgaaacagcactagcgattcgcgattttcacgcacatagacatcatactgattggttttttccaactggccatcatgataaagctgcaccacagagacgactttcgctgccgcttctttaagccggtactcatcggctcgctgcaccatgctgctcacatccatctcgaccgcgaaagatcgatccatcaccacaagccctaaaaccaccataaaaatgagtttaaacatacgctaacgcctccgtaattggcttattgacgcctttgcgcgcagagaaccacgccgcgagtacacaaatcagcactgtgcctagggtgcaaaacccaaccagagtgaaggaaaaatagagatcgagcggataaccttcggttcttcccgggggcggtggcatttgaatatccgctacgcgtaccgccactatggttattcctgtaagcaaggtacccaagagtgagccgcacagcgccagcaaggtcgcttcgcgcacaaagcccgccaaaatgtcgcttgggtacgcgccaagagccgacaaagttccgatttcacgagtccgctcactgaccgacatggttaaggtattaaagagcgcaacaaacaccaccatcgccatcacggttcccatcacgccaaacaatcggtcatacaagtctttgactcgggtgtaaaagaaagcgagttgctgccaaggtgtcacttgcagctcttgtgataaggacaactgattcagttgattttccacccacgtttgtagcgtttgagtattctcggtgttaaacagatacacagacaaggtgctgactttactggagttgagcagctcttgagccgatgctaagtgcaaatagagctgccgtttatccaactcaggcactcctgtcgaatagagaccacgcacttgaaaatccagtgcgttcagtgcgccatccgccgtggtagcgagcagcgtcacccaatcaccgacgcccacacttaagttgcgcgccagatctacgccaagcatcacttgaggttgagtcgggtcaaagcgcggagacttaggatcttgcaaggtttgccctgctcgcagatccaaaaacgggcctttcatatcaaactctttgtcatccacaccaagaccaacaaaaatcgttgatttttggccattcgaaaccagccctgttaactcaatacgtggctggatgccacgaatcgccggattcgccagcaacacttggcgaatgtggtcgctgccttctaatccattcgccaaaggtgtctcttcctcttgtgcaaaatagccacgctggctcagcgttaaatgtccgacatcccgcgctgtcgattcacgtagtgaatcataggtataaagaccaaagccgcctgcagatgttaatgccaatactgcaatcgcgatgatcgaaatagagagtaggctgcggcgacgattacgctgcaggtttaacgccgccaatcgccatgcttgtgagatcaacttgcccattgcatcgcctccaatgaaatttgtccgtccaccagattgagggtgcgatcgcactgagctgccatgcgcccgtcatgagtggcaaccacaaaagtcgtgcctaactcatgaccaagacttttcattaaactgatcacgaggttggctgtttgactatccagactcgcggtaggctcatccgcgaccaccaatttcgggttgtgaaccaacgcccgagctatcgctacacgctgctgctgaccaccggaaagatgatctggacgctgctgcatcaccgcttctaatccaaccttggttagcatgtcatgtgctaacttgtgctgatcacgacggctaaaaccattaagcatcaagggataggcgacattctctagcgccgtcatcacggatactaagttgaatttttggaacacaaaaccaaactgagtacgacgcagtaaggcggcagacttacccttacgtggatatacacgtccctctaatgccacttcaccttggtaattagggtcaagtaatcccaagatgttgagcaaagtgcttttacccgagccggaggggccacacagcgctaacatctcgccttgctgtaccacaccgctcacaccacgtagcgctggcacgctttgaactcccaatgagtactgtttttctatactttgaaaatgcagcatgcgtcctcctacccttggctcagcaaggcttgagcttgctgggtatctggatgttgcgcatccgcttgctgcatggcttctagccaaaggcgagcttgcgcttcatcttcggcgcgcaaggcagcaacaatagctaagcgatagatccacgcggtggccgcaaacggctgcgcttgaaattgaggatcggacaatagattcaggtagagatcatatccgcgctcaaaatggttaaacatgtcgggcatggcggtataagtggccgccgccactgccatagcaagcatttgaactggtaaaccgttgcgtatctcttctgaacttgccgtgtgctcacttgattgggtcacctgactacttaataaagaaaggcctttctctattgtggcaagcccctcttcgctataacgcattttcttccacggtaaaaaagcatcacgtcccatcaaggtgcgtgtactgcccaaatagaccaagctcagtgccgtcgccccttcttgcgcaaccaatttttctaaatcggcgtacaagggttcaactaacttttcatcaccttgtgcggcttggttataacgttggatcatggcttcgcttggcagcgcaaatacaggccaagcagataagctaaacaacaaaacggagacataagcagtcaagctcaacgaagttcgaattttcatgtgaacggtccttttcagtaacgtaattgtcagaacgtaaacgtcctcaactgctcatcgtgtttgtgccacgacgcagcagctatcaagaatggagtgagcttactgaacttcgtctgtcgttatcgggctttgcgaccaatggtctttatggggcgtgaatggacaatatcgggagcgaatgggtggcaagaagtgaagagataagatatgagttgataaaaactgcgccagtacaaagactggcgcaagagtatctcctcaaacaacttggagctgcaggtaggaagaagattgagccgtaataacccgttatggcacgccatgacctttggatgcgacccacacccgataccactgctcacgagaaagctctaacgacaaggctgctattgcactttgaactcgctcgatttttccggatccgataatcggtagtggttggctcggtaaacgacgcacccacgcataaatcacctgctcaatcgactctgcgccgagctcaacacggatctcttccagcacagctcgtacgcgctgcgtttgctcagtttgacctgagaaaattgcgccgccaccgaggcatgaccatgccattgggcgaatgcgcagacgctgcagttgatccaaggtgccatcgtgtgccacatcaaaattgagtggattgatttcgacttggttagtcaccaatagcttacctaagcgtgactgcagcaaatcaaactgcgctgggctgaagtttgaaacaccaaagtgtttcactttaccgaccttgtgcagttcagaaaatgcttccgcgacttcatcagcattcatcagtacatctgggcggtggatcagcaagacatcgatctcattgactcccaaacgctcaagcgagtgattgaccgattgatagatatgcgccgcgctggtgtcgtagtgattaattttgcgctcaggaaagcgatcgctacacagtttaatgtcgcatttggtcacaatctcgatctgctcgcgcagtgaaggttccaacgctagggcttcaccaaacagtgtttcacattgatagttaccgtaaatgtccgcgtgatcaacggtactgatccccagctcaatatgctgcttcaaaaaggttaagcgctgctgaggcgtcatattccattccgccagtcgccagtaaccttgaaccagttcagacagctctggcccttgttgcgccatggtcactttctgtacggttgcttgttgttgcatggttattctcctgtttttcactcagcacatcctatgcagctggccgtctctgtgcaaaaactatcaatatcgatccataaagttgtgacttgaattagatttttagacgataacgcatggcggcaatctggctttctacgccctatcctgttgggttgtgacgcggtgcaaattaacaaggcgtagcgctaagaatgatgttgagtgacgcggtgcaatttatcctttatcgatacaaaaatcggcgccatttgggtaggaaagccgaatcaataataagaaggatagacaatgaaactgaatgccttgaccctatcgctgctctcagctctagctttgccagcgctggcctcgccagcttccactgcgaatttaacggtagcaaccaccaccaacagccgcgattttccactgcaagccgatgaaccactggtgatcccgctcactaagggcgactacaccttgaccattagcgggattggcggtgattgcccaccggtccccgaacaagagatcaaattcaacacgcccatcgctctcaattgccatgtcccgactcagttacctttgagtatccgttttaccggggattacgcatttcagtggcaagcgcaaaacaatactctcaccttcgtgcgtcaaaccactaaggcagccaaaactgagtttcatcgcccgatcccaaacgtcagttgcgaagtgtatcaaggcggtgaagtgactttagatctggcgagcagctttgccgatggaaccgagttgcaagatgctatgactgggcaagtagtgaccatcgagcaaggcaaagtgcgcttaaccccttccgctaacagcggcggcttggtgttgttggaacctaaacagacagcaaaagccgagcccaaacagccctttacctatcgaaatgccaatatttattttgtgatggttgatcgcttctacaacgcagacccaagcaatgatggcagttatggtcgtcacaaagatggccaagaggagatcggaacatttcatggcggcgatctcaagggtgtgattgcaaaacttgaccatatccaaagcttaggcacagatgctatctggctctctccgattgtcgaacaggtacatgggtttgtcggcggtggcgagaaaggatcattcccgttttatgcctatcacggctattggacccgcgatttcaccaagatcgatgccaactttgggaaagatgaggatttacaaaccttagtgcgtgaggcgcatcgtcgcggcattaaaattttgatggatgcggtgatcaatcatgcaggttacgcgacactcgccgatttacagcaagatgcagtacaagtggtgaacgcacctatgctgcctgaacgttggaatgactggaaacccagcgccgacgaaaactggcacagcttccatcaagccattgattaccaaagcaagaattggcaacagtggtgggggccagactgggtacgcgcaggcttaccgggctatcctgcgccgggcagcagtgacatcacgatgaatctcgccggtttaccggattttcgcactgaatccccccaagccgttaccccgccgcagtggctactcaacaatcccggcacacgagtggtgagcaaacccaattacactgtcgctgactatttaattgaatggcaaagcgattgggtacgccgctttgggatcgacggttttcgcatcgacaccgtcaaacatgtggaaggggaagtgtggcaacgcttaaaacagcgcgcgacggaaagccttgcagcgtggcgtaaagacaataatcaaagcggtgagccgttttggatgatgggcgaagtgtgggggcacggtgcctatcgcagcccctactttgatgatggctttgatgcattgattaactttgacattcaaaaacgtatggataacggcgcagcctgtttgagccagatggcgatggtgtatcgcgattacgcgcaaaccctcgccaaatatcccgactttaaccccgtcagttatatgtcctcgcacgatactgagttgtttttcgggcgctttaaatcactggatatgcaacgtaacgccgccaatgccctgctactgacaccgggtgctatccaagtgtattacggcgatgaagtcgcccgcgaagcgggaccgtacgcagacgatttccatcaaggcactcgctctgatatgccttgggaatggaatgccgaacgccaagcactgctcaagcattggcaaaccttaggtcaattccgtcaacgtcaccctgcgataggaacgggagagcatcgcgaaatcgcccaatctaacgcttatgttttcactcgcacattgggtgaagataaggtggtcgtggcgttcgttggccgctaagccactccatcaggagcatacacagtatgctcctgaatttgtcgaaattcgtggcgatgtcccctcctcaaaagcactcaaaaatcatcctttggttgtaactgactgtaaagcctgcaaacttaaactggtacaaccagaaaatgactttaattcattgatcttgatgaattaaatctctatcttgcgcctcttttataaaataattcagttattttctttgacatagcattaacacaaatttaacatcgcgcttcatgtgctcttttcagtggttgggttcctttacttgcaccttctcacccccacccgttacgcatccaaccacttgctcgccataacaaaacgacttggcgttatagatcggtagcaagggatatccgtcatgggtcaactgaaaaaatcgcatcaagccaataacaataaccacacacccaagcggtttgagaataccgattagcaaccaagcactcctgcgtgctgccaatgttgcttttgttcttcaatcgtgcggaaagacctaggaggtcgagaatgttgtataaatcttcccttgctgtcgccatctcagccctgattgcggggcaagttagcgccgctggttttcaagttgccgaacactcagcatcgggtttaggtcgtgcattttctggtgaagcggcggtagccgataatgccagcgtgttagcacgaaatcctgccgccatgatgctttttgagacggcacaattctctggtgcactgtcgatcgtcgatcctgaagtcaatgtggacgatctttccaacaatcagtcgatgaaggatgtggctcctctgcaaattgtgcccgccgcgtattatatccgcccaatcaacgaccaatgggcttgggggctagccatgtttacgacctatggcgttgcgaccgactaccccaatgagatttatgcaggcgacttagccggcgatacctcactcatctcagtcaacctcaacccgaatatcgcttatcgtgttaacccagaactgagcttaggttttggccttgatctggtcgccgccaaagccaaattaactcgccacaaaggtggattggctcccttcatgggcggcggaaatcctagcgataacctgattggcatgacgggtgaaacccttgctttaggctggaatatcggcgcgctttatgaattggatgagcaaaaccggatcggctttggctaccgttcgcgcgttaagctgaatttcgatgatggcgagttctccagttatgactcaggcatcgcgaccagtgcggttgttccgggacaactcaaaatcgaactgccagccatttgggagctctccggcttccaccaactgaatgaacaatgggctgtgcattacagctaccaacaaaccgattggagcagctttgaagaactcactgccacttccagccaatgtaaaaacggcacctgtttccaaaaaatcgaacaataccaagacaacggacgctggtctgtcggcgcaacctatacgctgaacaccacttggacattgcgcgcaggtttggctttcgatgagcaagccggtaaggcaacactcagtattcccgacagtgaccgtttctggtactcagcgggtttgacgtacaccttgacgccacaactgactatggatgccggttttgcgttagtacagagccgtaaggggtcttttactgaaaaaaaccaaatcggccagaaccttcagtttgagtctgaggcggtcgcctatatcagtgcattgcaatttaactaccgttttcactaatttctggagtcgaacatgaaacaggttattaagctctccctactctgctcagcactctggttagccggttgcggtgatgagaccaatagttcaggtgcaagcactgaggtggtatacgaatcctatattcaacaagccttgcaacgtgataccacgatcaaatttgcgttaagtggcaaagatgccaatgtgcctctaccctcctttgccttaatgaatgctaaggatggcacgttggaaattccgccaggaagcaatacttctggctctaacccattggtcgcgatgggacaagtggatggctggcccatcactatgccgctgttcctcgattttaaaggtgcaggtttagccgataacatcatcacatcgggtatttatctgtacgagttaaccgactcgatgaccggttcaccgagtatcaaagctttattaaccaatggggtggattacaccgccgtatccagtgctgcttccgataagattctcatcatgccgaccaaagcactcaatgcctcttcggaatacattctggcggtcacctcagaagtctcggatgccaacggtaatccggtggggacttctgcaagctatgccgcactaaaatccaaaaacaagatttacagcgaaggagatattgcgacgctacaaaaagtcactcaaggggtagaaaaaatcttccaactcagcggcgtcgatgagactcaaatcgtttactcgacgtggttttccacccaatcggtgagcaatactctgtttgccacgcgcggtgcgaccgcatccgcttttgccagtggcagcaaccaattagagacagtgtggaaacaaacaggccttgggctcgatacggcttacaccatacaattaggtacacccgttgacttcgctgccgctctgacagcggatgacaatttcagtacctatgttggtgcagacaaaaaaaccgctattttaggtacttacacggccaataccgttgatgtaaccaaaggcacagtccgtctaccttactaccttgaaactggcagtaactggaatactcaaccgtttgaatcggcgatgccaagcctcgccaagatcaaagccgcactggcagacagtaaagagcaattaacgatcggcagccaactgcttgccgcggggattgataccaccaagctcgccactgatgcgagtgaacagctcaagctgatgggtttgacattgaccaagtccgatggcactgcattggaccctgaacgctacatcactcgctattcacccgtacccaaagtgaaatcggtgcaagatgtgccatttttactgtttactccggcaggtgctgcgccaactgatattgtgatttatcaacacggtgtcaccactgccaaagaaaatgcctacgctttcgcgaaaaatcttacagctgtgggacttgctgttattgccattgacttaccgctgcacggggaacgtagtttagacagcacgcgctcggccaatagtgatccccttgcttacatcaacctcacctacttggccgtggctcgggataacttacgccaaagcattctcgatgtattgggactgcgagcagcgttaaccctgtctcagcctcttttcactggtacccgactgtctggcatcaatgtaggtacaggctcgaaagttcgtatgctgggacattcattagggggaattgtcggcacttctgcgattgcggaaagcaacaagaccttaggatctactgctgcagatgctatgtacagcttctctggcgcggcgattcaaaactcaggcgggcaaatttctaacctactattgggatcagcgttttttggtccgaagatcaagcataacgttgcattaagcgctagcacagaatacaaagggtttgctgatgcacaatgtgccagcttagatgattctgcttgctataacttgttcacttccttggcaacccaagagcagctggcccaagtcacctcaggcttccagatgttctcgtatgcggcgcagaccctactcgacaccattgatccttactctgtagtgagcacaaagctcaataatggtgggctgaccacaccactttacttctcagaagtggatggtgatagcgtggtacctaacaaggtgagtaatcctactggctcgctggtttatctcagccctcagtttgccggcacagagccgctggctaccttgcttggtttaaccacagtcaatgcaggacaaacagcgccaaacgcaaccaaaagctttgttcagttcaacagcacggcgaagcactcgacctttgttgcaccgcaagatgcgggatatgcggatcttgcacatcatacggagatgcaaactgaaaccgctgattttcttgctgacgatagccttggcgccgtatctaatagcaactctgtcttgaagtaactttcatcccttcttagaggtttaaggataaagcgaaaagcgcactctcgagtgcgcttttttatccagtgtaaaaaacaccttccgcatcgattaagtgtatccaaatgtaaaaaccttcctgaaatgcatgaaccttaactaagcttactattaataaaaatattcataaataagacaagattcacggttattatctcattgattagcgttggtttacctaacaaccgatattccgattgttttgtactttaatcatttaaaccgacgtaagttgaagtgttgcttagaggcgggatcgttttgccgttttgaatggagaggcactacgctcaataagtcgaactcaccatctcagcgatgcctcacattaaagggaattgccctttcagccatgaaagattgctgcgttgggtggtcccagtgacgaatttgttggctgcaaataagggcgtatcaactattaaagggtcacttatgtttctttttcaaaaacaaaaaccatcgaccaaaccttcccatcaggacaatattgtgcagtccctatccgagcatattgcttcgattgaatttgatacctcaggtaatgtcatctctgctaatccactttttctcaatgccgttggttatcggttagaggagcttaccgggaaacatcatcgtattttttgctctcccgcagagtgtcaatcgcaacaatatcagcaattttggacctctcttgctcaaggtaagtcgcattctggtacttttatgcgctacaaaaaagatggttcacttttagtcttagaagcgacctatttccccatcaaaaccgatgggaaagtgagtagtgtgatgaaaattgccagtgatgttacggaacaatatctccacgctgagtcacaacgagatcttttgacggcactgaaccaaaattttgcagtgatcgaatttgaacctgatggcacgattatttctgcaaacagtgcatttctcaaaacaatgggctattcactcgaccaaataaaaggcaaacaccatcgcctgttctgctttgatgagttctatcagcaacatccaaccttttggaaaagcttggcggcagggcaagcttattctggtcggttcttacgcaaaaatagttatggtagtcaggtatggatccaagcctcctacagtccggtcaaagatcaaaacaataaggtatataaaattgtcaagttcgcctcagacatcactgcagaggtattacgtgaacagcaagtaacagacgctgccaatatcgcctatagcacctcagtagaaacctcgcaagtagcacaaggcgggaaccatgtactgcaagattcagttcgtttagcagaaaaaatggtgggcaatatcgaacaatcactacaacagattgagcagctcgtggttctctcgaaagatgtctctgaaattgtcaaaaccatcagtggtatcgctgaccaaaccaacttgctcgcattaaatgcagcgatagaagcggcgcgagcgggtgagcaaggacgcggttttgcggtggttgccgatgaagtgcgtcaactggcttctcgcacctcaaaagccacagaagagatcaatcaagtggtgaataaaaacctctccttaactgaagcggtaaccagctctatttctcaagtctctcagattgccaatgaaaccaatggccgcattgtggaagtgtcaaccatcatggaacagatttaccaaggtgcagaaaatgtttcttcggcggtcagccaactcaaatagttgatacatcctagaaactgcccttcaaaaacaacgccctcagactttgctgagggcgttgcaggtaggtggcaaggaagttagtccaagcgtaacgtcacaccagaatagttactgtaaccgcgtaacatgacatggtatgtcgtacccacgaccgcagagatggaacactgctcggcattgcctgaacggtatggacgacaatcccaagaagaggtggtgggtttgctgcccgctttgacatacagatccgcatcgcccgttccaccactgatggacacaacaacactgcctgaattggtcaccgtaaaggtatagaaatcttctcctccacgtgagccgctcagtcctgtgatcggtttacctttctcaagcactttgccgacaggtggtggcgtggtgccacaagaagcattgacacccacggtattaaaggctgccacaacgtctgcggtgttgtagttgagatcctgcgccgctttcactaccccacagccaccttgatcaaacgtgctgttcggtgtccagtacaactggttagccacggcaaacacttcaaaacctttacgtacgttccaacccgatttattggcgagtaggtaaaacgcgcggttaaacacgccactcgaatggtgaacatcaataccgctgtaatactgtgaagcatgatctatcgagcggccatcacgtgacggctgatcgaaataacgtagaccaccggaggatttaaaaatatccgcgccgacaatccagtcgacattgccacgcataaagtactctgccgcttcccctgcgatatccgagaatgcttcgttaataccaccggacatatctcggtaaacgaggcctgaattctgctcagtaaaaccgtggctgacctcatgggcactaacgttgatatccaccaaaggatagaaacgggtatagccatcaccaaaagtcatggcgcgtccatcccagaaggcattttcatagttattgccgtagtgcacacgcatggttaattggaaagtcagcggcgaagtattcaaccactgctgatacatatcaaacaccacttttccaaagaagtgcgcgtcgttaagcggtgagtaagcaccattcactgttttcacgctgttgtagttagtgctgttgttacaagcataactgaacgccgtgctacccgaggtgccgccattgaggttaacggtttttaccgcactgttattcatcgtacaggtggttccggtcttatcaatcgtgaaaccgggtaaaccgttactgccgtattcataacgtcccgttttttggttaccgccggggccggttcctgttgcctgtgcgtggttaatgccatcccattggtctagcacttctcccgtttccgcactgataaagtagaacggacgcgaaggtgtttctgaagcgacaaaaaagtcgaccaagtacactaactgagcctgttggttatcatccaaacgtaccatcagttgcacactttcgttttccaccgggagcgattctccagcgtgttgttcaccaaaatggctaaccgctaaagcgatggcctgctggctttcaatgtcaggggtcacggttgggagatcggcttccaactgctgagccatttgaccatacacttgcgaaatccctttactggactcggttgccaccacaacggtgccatagacaggaaccccgttgtacatctgctggtaacgcactttcaccttaccattcggcaactgtaccgtattgacggctttaaaaccgctggcggcaggcatcatactgtactgttgctgcgccaacgcttgttcaaccattgatgcatcatcaatcgtgaccatttgtgccgcatagagagggaagccagttgccgctccggccagaactaaccaattcagaggacgttgtatcattttcatttctcaatcctagagatgttgaatgtattaagcgttgaaccgctcccatcaacgccgattgcacgcgaaataccgcgttcaatcaaagtggtacaagtcaatgaaaaacaccaaattcgagttaaaaaaatgttaacgagcagtgtgaactctacgtgtcacaaactactcagtaagcaggaatactcgataagaaagccagaaataaagaaaataaaatcataaagatagaatcttactgataggtttgcgcctttaaaatttgacacctatttatcagtatcaacaggggattgacgtacgtctcaggctctgaatggagattactttagaaaacaatcactaccgctaaaaatgatgaaattgaggccacaaaaaaataaagccgcgatttcgcggctttattttcgaaatagggcgttagaacttataaccacccgcgatcataaatacccaaggattgatttcaacatccgtggatttggcatctgcacctgctttgtaggttgccgttgtttcaatattggcataccacacagaagcgttgaggaaccagctatcattgagcatataatcaaagccaacgttagcagcaagtccccatgagtcgtcaagttttaaatcactcaatccagcattagtacccgtaccattaaagctttcatcaaagaaagtggtgtaattcaaacccgcaccaacatatggacggaaagtcgaattagcttcaccaaagtagtattggaccataaaggtaggtggcaaatgttttgtttcaccaatatcaccaaggctacctaactcaccaccagaggtagaaatcttatgtgaaaatggcgtagcagcgaggacttcaaaactgatgttgtcagtaaacatatagccaagcgttaaccctaactgggtattactattaactgccaactcactttgagtgtttaacactttatcgctactgtcattaggtactaccgaggcaatacccgcgcgcacaataaagtcaccttcttggtgagcaaatacaggagcggagcttagggctgcaagtacggctaggccgcaaatggtttgtttcatgacgttttccttttttgtagggctatgttgttatctttgtgttgcgcgcacagtagcacacaaaaatcacacaaacttgatggaaatcaatttgcatcatttaggcacattaataatgtgtttttgcaacttgcatcactttttgcaaacatccttaacattcttctagtgcgagcatgacgtgccatcatggcatcaaatatgcaaaagattcgttgttccccaatcgaggatgacgatatggacacactctacaaaatcgagtcatacagtgatgaagccgttaataccattgccgagttcattcgatccaaaggcggcagatgttgcgtcgccggttacgccgtcatcaccaatcacccgtttcgagaaagtgaagcgtggcgtttactgccgttggtcggaaaagtcacggacagttgaagtgattgggatatcacccaatttgaagagttggtgagcgaagtcacccattaatagtgaccgtagttaagtagagggttgatacgttgcatatggcatcgcacttgtaggcatgcctcacggtagggattgaaatgaatgagcgcaacaaactgtgctttcgtactcaaactttatcattaggtgcgactcgcttcagatggacaccttttctaagtattgaaattcacataagctcagcacgccagaccgtataccaaaatctagatttttccagtagttgagtgccaaaaaaggataaatatattttcaatggcgcttctattgctccgaaactaagcctcttatacttactttgtcagtgatacccaaacgactcgatgtccaggtaaccactcaaaagtaagccaccagcagcatagtgtaatcgtgccgcgggcattcgtaagcgcggtttaatgctgtggtttcgagtagattgggtacaaatgacaaacctttgacttaattaaccgttcagtgaattcaaaatgaagatcttctctcgccttggtcatgttcttctgatatgcagcagtttaatcattgccataccagcgcattccgccgattcctcaactacgaccaaagctggcgtaaaaaaaaccgttaagaagcaagaactctctgccaatagtgcattggtgatcgatcttaaaaccaatgagattatttattccaataatcctgatgcggtaaaacccatcgcttcagtcacgaaattaatgacagccatcgtgactttagatgccaagctgcccatggatgccaaactgcccatcaccatcaaagacgcgaaagagatgaaaggcgtgcactctcgagtaaagatcggcagtgaaatcagtcgaaaagatatgctattgctgacattaatgtcatctgaaaaccgcgccgcggcaagccttgcccaccactatccgggcggctataaagcgttcattaaagccatgaacgccaaagcgaaagcattaggtatgaaaaatacgcgctttgtcgagccaaccgggctctcagcgaaaaatgtctcaacggctcgcgacttggtggtattactgaaagccagtaaaaaataccctttgttgggtaaattgagcgccaccgacaagaaaaccgtcaccttttctaaacctcgatacacgctcgatttccgtaacacgaaccgattggtgcacaacgacaattggaaaattgacctcacaaaaaccggattcaccaatgccgcaggacattgtcttgtcatgcgcacacagatgggtagacgccaagttgccttcgtcgtactggatactaaaggcaaactttcacccgtcggtgatgccaatcgtctacgtacttggatagaaaccggcaaggtcacgcctctttcatcggaagccaagcaatataaaaagcaacgcagccaagagcaaatcgctaaaatcagtgattacaaaagctgacgatccaatctcactctgagcgctatgccctttgcctctcttacgacgtaagaaggcaaaaggcggtattggaatccatctcaatctcggcgcacaggctttttgcgatgagaataaactcgcctcaccaatctcaccctagtctcaacgaacaagcaaagatatagttcgctctgcgtcgccacagtcagtaggatggataagcggtggggcaaatgagagcaaacaggttttttgatgaagaaatcgcaagtactggccaacacaattaaaagtcaaatcgagcagaatatctggcttagtggagaaaaaatcccatcgattcgatccacctgcaaacgatacaagctgagtattgaaactgtgctccaagcctatcaacagttggaagatcaaggctatattcgcgccaaagcgaaatcaggctatgtcgtgttaccgcgaagaaatactctatttgccggcaatctcagtgcaaaagtgattaaaccctatccagtaaaaatcagcgatttactatacgacgtcctacaaagagcaaaagaccccgagatcattccatttagttcagcattccctgaccctgcgttatttccacaccaagcgttatcacgcagtttagcgaatgctagccgtcaaatgttgggaagctgcatgctgactaatttacctcctggcagccaaacgctaagacggcaaatcgctcagcgctatcaaaaaagtggtttaaatgtattacccgatgacatcgtcattacttcaggggcaatggaagcgttgaacttatgcttacaatcttgcacaaaaccgggggatttagtcgccatcgaataccccgctttttatggtgttttgcaagcgattgaacggctcaatcttacggcggttgagatcccaaccgatcctagagatggcattgatctcgatgtgttagcctctgtattttcttctatggatattaaagcatgctggtttatgaccgagtcacagaatccgctcggctattctatgagtgaaacaaacaagcagcgtttggcagagttagtcaatcactatcaaattccaatgattgaagatgatgtttatcgtgagcttggtataggtaacccaagctcactgccagcaaaagcttacgataaagtaggcaatatcctgctatgcggttcattttcgaaatctctatcgcccggttttcgtatcggttgggtcgttgcgggagaacgcgccttaaacatccaacgcttacagcatttgtccactctttctagcagcatcccgatccagctcggcctatctcattacctcactttttataactttgatcaccacttaaaaaaactgcgtaaattgctgaacgagcgtaaaaaagcacatgctgaattactgcgaacctacttgccacataacactaaaatccatctcaataacgggggctattttatctgggtcgaactgccccaaaccatttacgcagaaactctgtacgaacaggcacttgaacacaatatagcaattgctccggggatcttgttcagcagcgataaacgcttttcccatcatatccgtctcaactgttcttatgcatgtgatgaacgaatcgagcaagccattcaaactctaggtcagcttattcacaccatggaaatcaataggtaatcgcacaatgatcgtcgtgaccaccatcaatctgttctattttttaactttcgaactgttctagttctcacttcaaaagctgtgctgaaatgccttccaattcttgatgtaaagccatcttacgatggttgggagctttcatgattgatgttgttgaattatcgcgtttgcagttcgcattaacggccatgtttcactttctcttcgtccctttaaccatagggatgtcttgcctactcgctatcatggagtcgatttatgtactcacagggaagcagatttaccaagacatgacccgcttttggggcaagctctttggaataaactttgcgttaggtgtgacgacgggtttaaccatggagtttcagtttggaaccaactggtcttactattcacattatgttggcgatatttttggtgctccgttagcgattgaggctctcgtcgccttttttctggagtccacttttgtgggcctgttcttctttggttggtcacgcttgtcaaaacgccagcatttgctcatcacatggctagtagccctaggatctagcttttctgccttgtggatcttggttgcaaacggttggatgcaaaatcccgtcggagcagagttcaactatcaaaccatgcgtatggaaatgaccagctttgccgaagtggtattaaacccggtcgcgcaggtgaaatttctccatactgtcgcatccgcttacacctgtggtgcaatgtttattctcggggtgagttcttattacttattgcaaggccgtgacatcgagtttgcgcgccgttcatttgccatcgccgccacttttggtatggcagccattatctcagtgatcgtattgggggatgagtcgggctataaacttggcgatgtccaaaaagtaaagttggccgcgattgaggcagaatggcacaccgaaccagccccagcagcgttcactctgttcggcttacccaatcagaaagaaggtaaaaccgattatgccattaaaattccctacctcatggggttaatcgccacccgttcgtttgatgaacaagtaacagggctccacgatttacgccatgaacatctactacgcattcgtaacggaatggtggcttatcaactacttgaacggttacaggctggtgatgcatccgtagaaacacaacgaaaatttgagcaaacgaagcatgacctcggctacgggctgttactcaagcgttataccgataccatcacagatgccaacgaggcacagatccagcaagcagcagatgattccatgcctactgtgtggccactgttttggtcatttcgcatcatggttggctgcggcttcattatgctgtttgtatttggtgccgccttgctacaaacctgccgtcaacgcatcactcataagccttgggtactcaaagctgcgctctggtcaattccattgccatggattgctatcgaggcgggttggtttgtcgccgaatatggtcgtcagccttgggcaatcggtgaagtccttcccgtcacggttgccgtctcatcccaaacgttcgaaaacttaatcacttcgctcgccatcattctaagtctttataccgtttttatttttgtggaaagctatctcatagtcaccgttgctcgaaaaggacccagtagcttaaaaactggtcgctatcaggacgaacaaagcttatacgagcataagttggcacaacaagtacaatattaggagagagtattcatgtttgaatatgacacattgcgcctcatttggtgggggctgatcggtgcattgctgattggttttatgatcaccgatggttttgatatgggggtaggtgcactcttgcccatccttggacaatcggaatccgacaaacgagtgatgatcaattcaattgcgcctcattgggatggcaaccaagtatggctaatcaccgcagggggagcactctttgccgcctggcctttagtttatgccacctctttttcaagcctgtatattgctatgtatttaatactgttggcgctttggttacggccactagcattggaatatcgcgcaaagattgataccccttcttggcgaaaaatctgcgatatctcgatttcgctttcaggtttaattcctcctcttctatttggtgtcgcctttgggaatttaatgcaaggattacctttctcgctcaatgcgttactgatggtagattatcatggatccttcatcgatctcattacccctttcagcgtgctgtctggcggtattggcgtattaatggcattagtgcaaggcagtgcatggctcacgctcaaaaccagcgatattcttcataaaaaagcgcggctaaccgctcaaataagtgtcttgtgtctctttggattattcatcataggtgggtttatggtgcatggaatgaatggatacctgattgtcagctcattagactataacgccatatctaatccgttaaataaggtcgtcttccaacaagccggtgcttggctaaccaattttgaacgttacccgtggatgtggtttgcacctatgggtggcttaatgatggctatgggagtattcctcagtgcgaaatggaaaaacgatgctatcaccttcgtctgcgccagcgtgacgaatgcttgtattattttaaccgcaggttttgcgatgttccccttcatcatgccatccagttttgaaccaagccatagtttaactttgtgggatgcgacatccagtgagcgaacattaaatattatgacgggcgtagcctttgtcatgttgcccatcattcttttttataccgctttcagttacagaaccatgtttggtcgacttgataagcaatatatcgaacgtaatcatcactcactctattagaggtattcgcatgtggtatttcatatggatttcaggcttatttctagcggccacattctctattctgaatatcattaatttagagaaaaatagcacggaaagacaaccttaaacttaagcagaggttaccaacataaccatccagtgccatatcgaaagataccctagaaaaatctttcaggtatgtgggtaaacaagagcacatggatcacgctcgcataccatttatgagcattttaatcatggcatgtcactcagtggcatgtcatggttgcatcaaaatctgctcaacgatcaacgctatgagtgatgctaaaaactacaatcaatgcgttcacacattaactcttgtgaagcatgttaaccttaaggctaaccatgaaagagcgaaaaaagtctatctatttcattttatccgtgtatagtgagcctcgttttttatcttgaaatattcattctttggttagtctgaatttcttttaggtttcattttgagtgtgtagtaaaacgagcacttagtgacatgtttttattatcataagataatctcaatgcatatcattgcgcgagccatctttagaagataaaaaatcgcgcattggaattttaaaaagaagtatattcctcatataaccaaagaagcataaattattgattaacgtgttccgttaattaaatgaccacttctcaagataacaagtcaagcattcaagattatcttaaatgcttgggtttaaatattgatgagtatttattattaaactgagtaaaaatcacaagtaataataaatatgcatcacatgactttcaaaaggtaaatcatgaagaacaaaagagttaaattgcctaaaaaaaataaaaaaggtgcatatgaagcaaaatttgaagagatggtaaaagagtatcatagcgcccaagcggttttaggcgaaatgtctgtcggctctgaagagtacactgaacaaaaaattctctgtgacaagctatttgctcatgctgagcgcttttttaagcagaatcaataaccaaacttattaataagcctaatgatggtggtgtgtaagttttattcctcttcacatcattctcatcactcacctttgataaatatgacttgtctctagagcaatttcccaaacggctgcaacatcaagtcgcaagggatatgttgagtccgatgaacctttacacatcaacggcgcttcactttttggtgaaacgccttacctcttattgttaaatcaacgattttttaggtaagagtccatctcttctgctggaaccattcccccgccagtcgcccaaacaagatgcgtggcattccccatcacggtatcatcaaactgcattcgagctcgatattcaacactctttgtgaccacgatagggccaatcataccggctaatgcagaaggctcgagctggatattctccgcttcattcaattgcccaagcagtcggtacatacgctcatcactgatggttaaatagccatccagcagcctttccattgctcgaccgacaaaaccagaagctctccccaccgctaaaccatcagctgcagtgatgttatcaatcccgatatcttgaacactgattgcgtcatgcaagccagtatgaacaccaagcatcatgcatggagaatgagtcggctcagcaaaaatacaatgaacattgtccccaaaagccattttcagaccgaaagcaacccctcccggtcccccaccaacgccgcagggtaggtaaacaaataaagggtgctgcgcgtcgactacaatacctttttcatcgaactgtttcttgaggcgttcacctgcaaccgaataccctagaaatagagtttgcgaattttcatcatcaatgaaaaagcacgtcggatcattttcagcttctttgcgcccctgagcgaccgcaacaccataatcttgggcgtactcaatcacattgaccccaagagcacggagtctgtttttcttccacgcccttgcatcggctgacatatgcacagaaaccgagaaacctaacttagcactcataatcccaatcgacatccccagatttccggtcgaacccactgcaatactgaaccgtttaaagaaatcacgaaattcttcgtttaagagtttgctgtagtcatctgactccgtcagcaatccggcctctatcgcgagtttttctgcgtgagtcaacacttcatagatcccgcctcgcgcttttatagagccagaaatgggtaagtgactgtcttttttgaggagtaatcgaccttgtattggggtgtcatattcacgctcaagcacgctttgcatctctgaaatgggaacgacctcagactcaataattccgtttgttttcgcggtttctggaaacgcttttgcaagataaggtgcgaatcgttttaagcgttgactcgcatcttgaatatcctcagaaccaagtccaacgtagcttaacccttcctcaaggcgagtaatggatgggttaaaccaagatacctctttaagctcgatgagctctttgactagcggatattgctcggtaagttgctctatgttgatcgtcatcataaaaccttggtgtttatttatgcactgagcatttcatagaagattagacatcctgacaagtgaagaataatcactttcacatgaaccagattaaaacaaaatcgtgaaattcatagactcttggggaaacacaggacaataggtgtattttattcacaacattgggctaatatgacagaaccttgatacctcagtcagagcctaactatgtacactaaggataatatctttgccaaacacagccgaataaatagttttcagctttcaaagttgcatacttttgaagtagccgctaggcataattccttttctttggctgcggatgaactctcactcacaccgagtgcgatatcgcatagaataaataaacttgaggaagaaatcggaattaaattatttgagcgaacacatagaaaggtagtattaactgaagagggacaacgtatatatcactctttacaaaaaacattgaataatctaaatcaagaaattaccgatataaaaaatggtgaaacctcaggcttactgactatttattcaagaccttcttttgcacaatgttggttagttcctcgtattcacgcatttaaagagctctatccatccattgatctgaaattgctaacaggaaatgaaaatatcagtttccaaggttctggaattgatgtcgccatctattttgatgaccatatgccagataagctatcttgcaaagaaatattctcagaaacgatcattccagtttgcacccctgagtatgcccaaaaatattcgctcactagctcaatggataacctttataacaccacattactccatgacaatcaggcatggaactataattcagatgcagatgagtggaaaacatgggccaatgccaatcagttggaaaacttagaaaatatatcccgtatcggcttcgaccgatcagacttagcagtaatagcggctatcaataatgcagggatcgcaatgggccgattcagtttagtcaaatcgcgactatcgtcgggtgagctgatgaccccctaccccaatactgaggtgatttgtaagcaaagatactatgtcgcgactctgccgaataagcacaatcaaaaagtaaaacttttcattgattggttggaatcacaggtaaaaaaagcagtgtaaattcattttgtaatcactttatttccatggatgcatgggtatcttgaatttgtaatctaccattcatcctagacaatcaacgacaggcttgcgcctctcaatacagttctgtataaagcaaatatgcaacaaattacacatgtgttgtatttgaattctcaatgaactgcggtgattgcagttgttgtgcttgagttaagtgttaatgcgttgccgccccttaacctcacgttaggactatagggactaatgtttatgtctggaaaggactgcatcacatcaccaaagaggaatcagagatgaagatgaaacacatgaaaccatacacgacgatgaaaactgtgctcagcaccttagccatcgcgctcgctttcgggcctttgcacaacgcccaagcttgcacacgcatcttatacgagacggggaatcaatcctatatcagcggacgatccatggattgggcggatccttccgcagcgacggcgctgtgggtctttcccaaagggatgaaacgcgatggaacggttggtgacaatccaatcaagtggagcgcgaagtacggctcaattattgtctccttctatgatgctggaaccgctgatggaatgaatgagaaaggactcgttgccaacatgctgtatctgaaggaggctaaatggggggatgcaaccaaggcaggaaagcctacactgaccgctggtgcttgggcacagtattttctcgataactacgcaaccgtagaagaggccgttacggcaatggccaatcctccatttaccatcattgcgccttcactgccaaacggagacgcagcagccttacacctctcgatttctgacgtgaacggcgactctgcgatttttgaatacattgatggcaagctcgtgattcatcatggttcgcagtacaaggtaatgactaactcaccgacgttcgatcagcagctagcactcaatacctattggcagcagataggcggaagcaaatttcttccaggcacaatcaatgccgcagatcgctttgtccgcgcctcttatgctctcagtgcctcacctaaataccgagacaacgaccttgcacttgcatctgttttttcgcaaattcgtgcggttagcgtccctctcggcattactgatcccgaccgccctaacctcgcaatgacactgtggcgtacatttgcagatcatacagcgaagatttattactttgagtctgcagttttccccgccgtttcttggctagacatgagtaaggttgatctgacggaaggcgcagccccaaaagtcgttagagtggaacggggccagcctctcgcaggcgagctttcagctgcacttaagccagcagagcccttcaagtggctcggggcagaatgatcaggatattgcggtgactaatacgatatgcaactcatcaactcggtgcaaaaagaggcgtccgttaccgtaatcagtatcaacttcgacatacctacgccagttggatgatcactcacgctaacgtcaacgtgagttacttggcacaacaaatgggccacgctgatatcaccatggtcgcaagggtctacggtaaatggctggttgaatcgaacaagaaagaatccgaacgggtatggcaagagctagaaaaagtgaggaatcaataaccgccgattaggcggttttttgatcctaccgaacggaatccccataactcctacaatcaactaggtcgacatgacaacaaatttttgccccaaagtgaactcgaagcgtgtgcaaattgaagaaacattccgaggcttgaaagccctgcgtacggattaaacctccgccatagccgaactagcagcagttatacttgcacgaaatttattcaagcatgattagacattagaaaaaacatgaggagctccctcaacgtccaaccatgaaataattattccatcaaataaatgttcgtttaattattccttgcaatttctcacgcaaaaatatgatcaagcccacaaatacaatgattaataaataacaaaaatgaaattaaaattaagagccatccataaatttcattatgtatttatcttatttacatactgatatgtacatattagttatgcgaccttgattaactgaaatcactaactatatttatatgcatagagattaaaaatacatatatataaacactaatatcaataatatttagtgggtaaaacccaaaaaccattcgaaatggttaaatcagtacagtgataccctgtggctccataaataaacgtcagtaggtattggatgaaaaaaatagaaatacttatcgtggttgattgtgccggagcattagcaaccactagcttaattagtaacgtttacttaattgatagtaaccaatggcttggttcatgggatgaagggacgtgccaactccacacggtatctgaagatggtcagtttatttgctggcgtagctgcgccatttcgccagatgacgaagtcaatataacgggattctatggtgacatgattgatcaaaaagcttgcttaccaagccctgttaatgacgcatgggaaggcagagttcagactcgcggggatactgggcgttatctatataccatttctctttcaataaacggaataacaatgaatttttcaccttatctcgaagttcaataactccatctaaataaggaacattgtatgaaaaaagtagaaatactcatggtcgtagatgcagcagcagcgcttgcaagtcgagatctgcaaagtaacatttatctcattgatacaaataaatatatgggctcgggtaatgaaggccaagctgagttaaaaacagcctgtaaagacggccaattattatgctggcgagttgtcgctatttcaccagacaatgaagttgatattgtcgagtttaatgggcaaatgataaatgacagagtttgtatacccactaaacaaggactaagcggtgatgaattctgggaaggccgagttgaagcgcaaggacaagccagcacacaacaatacaatgcgaccttgtctattgatggttcaagattaacgtttgatcctttcctcgttatttcactgtagagggcgaactcatgttaagcccaaatgttgataccgcattaaatatgctgaccgacgtatatactgattttttaggtattagtaattacgatgcaacgtgcaactctctctttattggccatgtagcaaaagatccaaactggctcgtagaagttcgaagcaggactgagatcttaagagcggtaatgaatgagtttatgcagcaaaagcctaaaatttttgcgcaaattattacatcgtttattaattatcagaccacgttcgatgcctgcgcacaaaacagtaaggcgataacaagtacgaagcaatggattgaatgcttacaattattgcaaaaaacgttaaagcaaaatatcacgttaacaaatgaagctcagcaagttttcacgaaatcttacaaccaagcgaaaaatgcagaggagctactcgcatccagcattcaagatggctggaatgaacttgcgagcgaagaacaagcaatggtacgcattgcaacagagataggctctctatcgcaatccattgccagtttaggagccaatgtcacggcggcccaattaagagcaggaaaagcttacatacaaagtatggtcactatttcctacggtgtcgtaatgggagcaacgacgtctgtgccattcctttcctttgctggtgcgctattcacggttggttacagtgcatacagcacaatatcgagcgcgaaagaggtacaacaagatttagacaaactcactcaattacaaacactagccagtgaagaagcacaagcggctgccattactaaagccattattcaaaccctcagcaacatgagcgaagaattcctaaagattgatgatagcttgccagcactttcattgttatggcaagacgaattagacaaggtaaacgaactgatcaacgccttacaaagcggttcagaccctgccctattgactgatttgcaaaccatcaagattgcttcagcctcatggaaaaccatttcagaatttgtgcaactcattagtttaccgccaaacgttggaaaacccgttttagtcaacacactaaataacaccattcaagaacagtaaaggagatacacaatgtcacaacaagttactcagttgaacccaacacagcaaaccactcaatctgcatttttggcaaccacagtcatcacagcgcagtgccatgccattttaaacacacaatttacgccacctacggtaaaaccagattggtttgatgacctgagtaaaaagttagactcagcaaaattggttgctaagcaatggattgacgatttgggaccacaagtatcagcatcgattccctccagcgtaattaattttgacgctacttttcaagcatcaatcgatgccattcatgagttatataaagcggatccaacagcaagtggcaaagacaatacaacggttcagcaagcttcacagattatgaccgccctatcttctcaagtcagcggtatcgaagccacagtcaaagggatgaataaggaactctctgattggggggtgaaaatgcaagcagcacatgatgacttagtcaatggtgcgaccaatattcaaaaaacaattattgatttacaaacagatattgaaagtatgaataacgcaatagacaacaatcgtgcagccattgagaaactgaataaagatctggtctatgcacaagttgcggttggtgttggcatctttatgctcgtcgcaggcgttgcgcttaccgtcgcaaccgctggcaccgcagctgcagtctccggcggtatcgcagccgtcggcgcggcatcgattattgctggtggcgttacatggggcgtattacaaaatcaaattgatgatgactacgacagcatcgcgcaagaacaaaagcaaaaagctgaagatcaacaacagattatcgctttacaggggctttccaatgccagtagcgccgttgtttcagcgattgaaacatcgacatcagtattatctgattttgaaacaacgtggactgtctttggcaacgagttagatgatgtagtaacaaagcttaataatggtgcatccatgcagagcattataatggaaaaagtgatgtctgacgcagcgaaaaacgaatgggatgatgcggttgaacttgctaaacagctagctagcgcaaaaatagctatcgaaacgaaagagttagcacctgcagtaaaacaagcagcttaaacattactaaagggggttacgcccccttctattctttttcgaggaccatcatgaatcaatcagccagcgagcaacttcaaaccgacattcctgcatctattagcgctatggtgttactaaattctgcatgccaaggcgttgttgaaacttatattgatcaaggcaatgcagaacattggtatgctcaggtagaacaaaatttaaatgcggtgcaaaaactggtacgacaatggcgtttgagtggtaatttatatttttcaaatgacattatggacagtgttctttccattgcgaatacattcaaagattctaatgttcaaattttaacgttattcaaagcactagaaacccgttttgataccgcccaactacagcagctcacttcattaatcttaacattacaaaatccgattcaaagtcttacatcaaatataaaacgttatgatgagggattgaatgcttgggctcgccaagtggaagatgctcataacacattgcaacaaactattgcacagatccagcaagaagaagtttcaatccaagcagaaattatcgccaccaacgcccaaattgatctaatgaaacagcagatagcagcatttaaaaccgccattgcgaacgctcaatcgcagcgtaagaaagggatatttgaaacgatttttggcgtggtgcttgctccgtttacactgggaggttctttgatattggcagggtttggtgttagctctattgtagaagcacaaagtgaaatatctagcctgcaaagcgatatccaatcatctttaaataccatcaaccacgatcaacaaacgctctctcaagatcaacaacaaatcgcgtctctcaatgccctattgctaagtgtcgatcaagttaacaacgattgtgcggcgatcagccgatccttagatacactacaaaccacggtgctcagtttatacaatgaaaccaacaatgtcgtttctaaccttaccaaagcacaagattcacaagcggtcattctggagcaagtttggtaccaatcagcttacaatgagtggcaagatattctggaggtagcatcaacgctcaataatgcacaacctcaaataacaaaagctcaaatcaagtaattgatttcgctccagtgacggagccaatagctgatttaattgagcaagttataaagcaatgccgataccgccaataaccctattgccatgacaaagggtgtactcatctgctgttgatacttctccctgaggaatcatcgaattggcatatcgtattcgcccatgaacccacggggcgatttgctagtgttggacgtcccagggtaacagtgcatcgatatctggctaattttttcatacacattgacaatgtaattatcgaggataaggccattttctttcgccatctcgacgatgctgtacagcatcacgctcgcgtctacaccattgggattattggttaacagctagatggtatgaccttatattttaagactcacctatggtatcttttggatgtcgcggtataaaatcagtcaactattctccatatacagggcttgatgttcactagagcagaattgccatagcaataacagtttaatgagctttcccatcagtcgctcatatcgacaactgttttggcgttataaaatcaagcaaagcttatctaggtgaggtaattgttgggcccctacctgtattgagagtttcaacaattcgatgaaagctgaagcgatccaatatgagctaattatgacgagagcctagatgcaacaaatgatctttgaatacatagaaaattatgataatcggatgagaaagcacagcactcttgggtatctaagcccagttaactttaaataacaatatgtcgcttaatttagtgtcaagtcttgcaggagcactctttcctagcaattttggacacttagttaaactaaacaacttttcaacacctcaaataatttgctaattcagtaaagccaatgactcacttttgtccaattattacatagaacttcttcgcctctacgtgttgcgatgatgggaccaaaacaaactgaacgtggtcccattacaaagtcagatgggaccaaaatgggaccaaagcgagggctaaatcgggtcatattttccactttactgtttataaaaacagtattagccaaaaacaaagcgccccttgcggagcgctctgtggagagattttcggttactgccaatcgaggataactttgccagaagccccgctgcgcatgatgtcgaagcctttttggaagtcatccactttgaagtggtgagtgataattgggctgatatcgagacccgattggatcaggctcgccatcttataccaagtttcaaacatttcccttccataaatccctttaataacaaggcctttgaagatcacttggttccaatcaatcgccatcgatgacggtggaatacctaacagagcaatgcggccaccgtggttcatggtttttagcatggcgctaaacgcactcggtacaccagacatctctaagcccacatcaaaaccttcggtcataccgagttctttcatcacgtcttctaggttttgctcagcaacgttcacagcgcgagtcacgcccattttacgggctaaatcgaggcggtattcgttcacatcggtgatcaccacatggcgcgcacctacatgtttcgcaacagctgcggccataatgccgattgggccagcaccggtgatcagaacatcttcacccactaagtcgaatgaaagcgcagtgtgtacagcgtttccaaacgggtcgaaaatagacgccagatcatctgaaataccatccgggatcttgaatgcgttaaacgctgggatcactaagtattcagagaaacaacccgtgcggtttacgcccacaccaatggtgttgcggcacaggtgggtacggccaccacggcagttacggcagtgaccacaagtgatgtgaccttcaccagaaacgcgatctccaatttggaaaccacgcacttcttggccaatcccaaccacttcacccacatattcatggccgactaccataggcactggaatggttttttgtgaccactcatcccagttataaatgtgtacgtcagtgccacaaatggcagttttcttaattttgatcagcaggtcgttgtggccaagctcaggcatgtccacttcgttcatccagatgccctgctctggtttcagttttgaaagtgctttgattttcataattaaataagtcccatatcacgacccacttcaatgaaggcgtcgatggctttgtccagttgttcacggctgtgtgcggctgacatttgcgtacgaatgcgcgcttgtccctttggtacaaccgggaatgagaaaccaataacgtaaatgcctttggccagtgcgcgttccgcaaattctgcggcaactttggcatcacctagcatgatgggaatgatggcgtgatcggcaccacccatagtgaaacccgccgcttccatacgagtacggaagtgcgctgcgttttcccataggcgctcacgcagatcgccgctctcttgcagcagatccaacacacgcagtgacgccgcaacaatcgaaggtgcaaccgagttagagaacagatatggacgtgaacgttgacgcagccaatcaatcacttctttctttcctgaagtgtagccgccggatgcaccgcccatggctttgcctagcgtgccggtgatgatgtcgatgcgatcaatcacatcgtggtattcgtgtgtgccgcgaccattcgcgcccatgaagcctaccgcgtgagagtcatccaccatcactaaggcgttgtatttatctgccaagtcacagattgcaggcaagttagccactacaccatccattgagaacacgccatccgtcacgatcaacttgtggcgagcgccagcagcatctgccgcgataagttgctcttccagctcggccatgttgttgttcgagtagcgaaaacgcatcgctttacacagacgtacaccatcaatgattgaagcgtggtttagtgcgtcagagatgatcgcatcttctttatcgagcagagtttcaaacaaacccgcatttgcatcaaagcatgaggtgtaaagaatggtgtcttctttacctaagaattgagagagcttctgttccagctgtttatggatatcttgcgtaccacagatgaaacgcaccgaagccataccaaagccgtggctgtccataccctgtttcgccgcttcaatcagagcagggtgattggccaagccaagatagttgttggcacagaagttcagtacttgttcgccagtagaaatttcgaccgccgcttgttgctgcgaggtgatcacacgttcggatttataaagcccctcagctttcacttcctcaagctgagtacggatttgctgataaaaagcagaagacattgcgtattccttcttgttttcgttttgcgggtaacaggatctatacccaaacaacttagcgggtacgcttcaagtcggaaggggatatttacactgtaaaaaacctttcccttagtgtaatccaaggtcactcaagcgattatctgcgataacggaaaagcattcgtgaacctcaggcacagataaagaatgatttgcctgcgcttatcatcaagtcctaaacataagaattattttcatttaggggaaatcccttattttttaatcaaaggtcaccgctataatcaaaacgacttaaggtttaaccaaggagaacaccatgacgacagtaatgaatgataaacatccgactcccgacccagcagaagataatgctttcttcccatcggcatactctctgagtcaattcactgcctccaagtcagatttaagtggtgcccattaccctaccccttaccaaggcggacgttggaaaatccttgtcgttggtgccgatgagcgttatctgatgatggataacggcactttttttctacgggtaatcatcccgttgaaacgcttttgccaatgtatcatcttgataaggcaggtttttcttttgatattgctacactttctggtaatccagtgaagtttgaatggtgggcaatgccaagagaagaccaagaagtgaatgggttatatagcaaatatcaatcttctttcaggcagccacttaagttgagtgatgtgattgaaactgcgttaggtgaagactccgattatatcggtgtgtttattcccggtggacatggcgcgttaatgggtctgcctgacagccaagaggttaaagcggtcttacaatgggcgatgaaacaaaataaatttattatctcgctctgtcacgggcctgcagccttccttgccgtaggtgatgatccattgtttgctggatataaaattgtggcctttcctgacgaaatggatgctcaaacgcccagtatcggctatatgccaggtcatctgacatggaagtttggcgaacaattgcaagcgattggttttgaattactgaatactggaatatcaggacaagtcttccaagaccgtaaaatgttgaccggtgatagtccgcttgcaggcaatgctttagggcaactcgccgccaaggcattacttgctgaagttgagcagaaataaaatagagcagaaagaacctatgcccgctgtcgatttaatcaccttgataagccaactggaagaaagccatagcttttccacggttcaagatattgttcggcaacgggcgcatttttatggttacgataagatcgtgtttttctcagcacactccacgctcgatggcatcatagagcgtatctattggattgaaggtgattggtttgacgatggagaaaacattgatgcagcgacttacatcaaatattgccctataactcgtcatattattgaaacggatcgtcctttcttttggactaaaaaacctgacgtcaatcgagaacaatacagagtggttgccaaacccaaaggtagcggcatacacggcctacaaattcctatttttggccatctaggactagaaggagctgtgagtctaggcggtaaggcaatagatagctcaccgcgagctcgttgtgaacttagtcttttatcaacttatgcgttttttgcggcacgtcgtctgcttgagtcctcagatccaaaccgctcagcattgctctctaaacgggaaaaagaagtgctgtcattgacagcactgggacgcagacaagccgatattgctatagctcttggtgtttctcccagaaccattgaaaatcacttgcgtaacgccagactcaaacttggtggggcaacgacagccgaaacaataagaattgcgatacaacggggcgatatcaatagtcattcaatatgagctataccggattaaactctgactttactaccaccaaattgcatttagccgatgattctgcgacagtgacgccactggttggccgacttatcgacacttatgctacttcccaaattgattgctcttttgcccgacctcgccacttttattgtggtggtcaatgaaggcagttttaccgctgcggccagcaaacttggcgtaacaccttctgcgctcagtaagctgattactcgccttgagcaagccttgtcggtcaagctgtttgaacgtacgacgcgcaaactcatcattactcaagcggggcaaaaggtgtatgaccaaagcttattgatggtcaatgcggcgcagcaagcgatcgaaatctccagttcggaacatgccgagcctgctggtgcactaactgttgctgcgccagaggcgtttttaaattccgtattgcagccgtttgtggtgccatttctcgcccaatatccgcatattcagctcaagttgcgtgccgccgatggtgacattgatctgttcaaacacaatattgatgtcgcctttcgcttgacggataagccagatgaaaacctcgtgctgcgggaactgtgcaaaaccaatttggtgctgtgtgccagccctgaatatttggcgcagcgtggcacgccgattcaccccaccgatttagccgagcatgattgcctctacctcgcggaaaccgataaagatcatatctggacgtttgccaaaggccgtgaaacacacacagttgctgtgagtggtcgttacgccgtgaaccaatcgcagttacgcttaactggggtgaagaatcatctcggcatcgggattttccatgattttgtggtgcaagatgcgctggctgcgggcaaggtggtgcaagtgctgcaagagtggaatattaagagtaattatcacggcgcgattgccatgcagtacgcgcaaaccaaatacatgccggctcgcctacgggtgtttattgattttgtgctcgaacacctaagtcctaagctcaatggtaaggaatccacatgctaaaacgcattcatcatgctgcgatcatttgttcggattatccacgctctaaggcgttttatacggaaattttaggcttacgcgtattggccgaaaactaccgtgcagcgcgagattcttacaagctggatttagccctgcccgatggttcgcagattgagttgttctcttttcctaaagcacctgaacggccaagttttccggaggcgcaagggctgcgccatttggcgtttgtggtcgatgatgtggcagaaataaaagctcaactcgagcaacaaggcgtaagtgtggagccaatccgcattgatgaatacactggcaaagcctacaccttttttgctgatccggatgggttgccacttgagttgtatcaggcttaaacgaggtcgactcgtactcatgtgaactaaaaaggccagataaaatctggcctctatttactttcctagttttgcacttaactgaaagcgattttcagcttagcaatacgactcaccagtaacccatcaagcagcaaagccaacactatcgtcgctcccgccagtgggaatgccacaccaatcaccagtaacgtggctaagcctgctttccatactccatcttgctcaaaacgtggcggaacacctagccgagcttgaccggtcgggcggcgcagccaccacatcaccacacctgtgacagagatcagaatgaaagcgagacaaaacagcacgttggctattttgttccatacactcagatcgccttggtgtagcgaaatccccgccgccattgctttggcaaatggcgaataatcttgccaagtgacctcggtgagtaacgcaccagaatattggtcaaaatgcgcagtgcgatcatcacgtggatcgacaatatcacccgccatggtattggcagaaacggtatacacgcccgtttccccacgcggaaaagcaacgcggtactgcgtaaaaccgagcgccttggcctgagcgatcacttggtcgataccgaattgaggattaaccgcaaccatttcatgctcacccccatgatgatgcgattgcggtactggcgtttgctctaagttccaaggcatctctttttctgagccatggtttaaatccgcatgcgtgagtaccgattgcggtttttctccccaagtgtaatacgtcgggaaggtattccatgcctgcaccagtttcccgccccaaatgcccgcccacgaaagaccggaaatcaggaaaaacagcagtactaaggacagcatgccacctaaatttgcgtgcaggtcacgccagaaaattcgcgcaccactgcccactcggattttgagaaaccccgctttacgcgcgttatcgagcggcaaccataagtagatgccactcaccagtaaaatcatccccaagctcgccgcgacttcaatcaaataatctccccaatcgccaatcaataaggtgccgtgaatgctgttcgcccattcataccagctttcgctacgatcaatggcgcccagaaccacagcgctgtacgggctaaccgtgacaaattgggttgaaccatcgctaaacagtacagaaaaacggttggctaaatccggctgatgcgcaggaataaactgggtaacttgcgcttctggatacgccttttgtactgccgcaagctgctgagaaacgggcataacctgcgcttgtggtgtaacgtttaatacctcggcgtagcgagcttgttcaatttcatcatcaaacaacatgactaagcccgtcagcgccaacatcaacataaaaggcaccacaaacaggcccgcataaaaatgccaacgccaagtgagaaaatagagggttttacgacgcgcagccgccgtcggttgaggtgtagtaacggtactcaacgtatttcttccttttttaaacgcaaattatcccttcggtgaagaaaccaaatgggatatgagcgtgtgactttactaaatagttttattgttattgggtaatgaattcagttaagtcacaggcggagcacgcgggacagcactttcaaaacggacacttagagccaaaaaagtgtaaccatctacttgcgccgtcgtttgtcgaattggaagttgtgtggttggaagttcggtgtgatgaaaattggagaaatgggcaaacggacacggcttactgtgctgagtttgcggtttgccatcttcaattttgaccagttcaaaaccattgatggtacaaagtgttgcccaaacgcccgccgcattgccgtgtgcattgagcacaggcatgagcgaaaccagcagccaactaagtaggctaagtttcagcatcaagcggtgaaaggtacgttgtgggttcataacaacactctttatggattgctcactactataaccattagtgataaccataacagtgtgttacacccaagttttaacaaaaagatgagggttgtttacatctaacaagcgttccttcccacttaagtcgctctcaagcaggaaggaaaaggcagactaaccaaacaaccgcttccaaatacttggattgcgtttgtcatggtattcaattcgcagatcatcaacggtttttaggctagcttttgctgcctcgagttcaccggcttgcaaatgagcgtctattttatccaaagtcaccgcgagcttttggaagccttcttggtaagtggcttctttttcaacaggataaacacctcgtttggcttgctcaaccaagctttcgagggtagaaatcggtgcttgcatcgcttcaacggttgtcgcttctgcggcctgtttaaaggcgagcttcatgtcctgcatgattgatttaagatcttgtcccgcggcaagaaccggagtggcgagcaatgctgccactagaatcagtgtttttttcatttttctactcacttttgaagggagtggaattgtacgccattctgcctgcaaaagtgagctgagttttgttgcaaaattaaagtagaccagcaaactcttcaatcggctggcgaccacgcaactcaagaaagtcgagaaactgacgcgcggtatgagtgatcacacgttgcgggttaatgcccacttcatcaatcagttgactggctagcgataaaccgccgatatccagacaaaaatgggcatcactgccagtggtgatgtaggcatcgagcgatttcgcaacacgagcaatctcatagcaacgatcaatgctgcccactcggctatggccttttaaggtactgttgttgatttcaatcgccacattgtgcgctttggcacaggcaatcacctgttcaaaatcgaaatcaaaatgcggattacccagatgccctagcgcatccactcgaccgcctttgatggtttcgatcagggcttgggtgtgcgctgctttatcggcgggatgaaatactggctcgtggaaactaccaatcacccaatccaagttgtgatccacgctcgggtgcaaatcaatctcaccttgcgtattgaggatgttagcctcgacaccgcggatcacgccaacgccctccagaaaacggggcaaaatgcgctggttagagaaaaaccaataatgcggcgctccgggcatagactcggcatgatcagtggtacaaaacagcgtcaagccattttgcttggccgcacgcgcattctcaatcagcgtgctgtaagcgtggccactggcgtaagtgtgagtgtgagtatctacagctaatttcatttcaacagtccttccaaacgcattgccggccagtgtaacagcctccccttagggttgctatgttcaatcgtgcacttcatggcattgcacaacagacataacacgccacaaagagaggctcagtttgcgacaccaagccaaacaaacagatttaatcgcgtgattttttgcaacctagccaagatgaacaatacttatctgtgttatttggcttaggtaacattatgaaaaagcgtcgttattccctatctatccatatcagcagtctgttttttattctgatcttgttcatcggcagtgtgctgattgcgatcagttattacagctctcaacagcttctggcgggtagtgcgagaaccttagcacacgagaatagcaaaaagctcgaaaccgtgtttacccaaaatgtggctcctatcctgaccagtctcgattttcttgccactagccgttttattgagcacaccgaaccgccactacaagatcaacgttggttaacctcagtattacgcgcatttgagcaatcttcgaacttaaattcgctctattttgccaatgaaacagggcagttttttatgttccgccccttacttagccgtgcagatcgagtgatgtttgcggcaccagatgacgcagtactatggatgaactacagccatatcgatggcaccaacgacatctattttctcaatcaagagatgaaattagtcgggcaatacaaagaggtcgcccatttttttgatccgagagtacgcccttggtatctgaatgccgccaatgatggggtgatccgcattaccgagccctacctatttttcactctccaaacctatgggttaaccttgtcacgccgctcattcagtggcaaacaagtcgtgggggccgatttaacgttgaaagccctttccagtgaactgagtaaacttggcttctccgatcattcacaactgatcttgctggatcagcagctacgccccctagcagagcacaattcagggctcaatcttcgctccgatccagaacagattaagcaatcgctcctaaatactgacacaccgtttgcttctgtcatgagccgcattactagccaagcgcaatacgataccccccacagtcaaggtcaagattgggtcactaccctaacgccagtcaaactcaaccagcagttgcatctgtttttagcgcaagcaacaccgaaagatgagctgctggcggatcttatcaccttacgtaatcgtcaaatcaccagtgcgattgtgttgcttctgttctgcttccctgtcgtcatttgggtggcgaaacggctctccagtccattacacaatctcatccaactgactgataacatcgcgcgttttaacttcaaaaaaacgcgctacccacaaaccatgattactgaagcggcgaacttaagccaatccatccaattaatggaacatgcgttacacgacctgcttcgcttactgcgcgaaaccactaacaatcaagatttcgctcaactggcaagaaccatagctcaccagagttatgccatcaccaaagccgaaaccatactgctgtatgtgtatgatcaagaaaataatcaattctctgttgccgccaatcacgccatcataccgttcaaaatcgatattaatcagctactcagcagcagtgcatggctgttagccgagctgcgcaaaggggaaaccatccacctcaatcgtaaagacaatattctgcgcacgtatctcgatcagctttacaactcagacttatacttcttcccgctactgaaccgcgagcgtcaattagtcgggattgtctgtttgggctatgaacgcaccatagaaaacgttcaagccgataaacacgcctttttgcgtgaactgctcagttttgccgaaattgccaaagacaacatcgataaaattcagcaacaaaaagagatgctgaaggcgttcgtcgaactgattgcatcggcgattgataccaaatcgccctataccggaggccattgtcaacgcgttcctgaattaacccgtttattagccgaagccgcggccaaagataaacgctatttcgctgaattcacgatgagttccgaacagtgggaagagttaaccctcgcggcttggttgcacgactgtggcaaagtcaccacgccagaattcgtggttgacaaagccactaagctggaaacgatttacgaccggatccacgaggtgcgcatgcgctttgaactcttaaaaatgcaagcggagcgcgattactggcaaagctgcgctcaagggggggatccaaaacaggcagagcaggcgttgaaggcgctgcatcaacaattagacgacgagtttgcttttgtggctcagtgtaaccttggcagcgaagggatgagtgatgaggatatcaaacgactggagcagatcgctcagcgccaatggcagcggactttagatgatcaaatcggcatctcttgggttgagaaaagccgcgccgcagccccagctccattgccggtctgggaaccgttgctggccgataagtctgtccaccaaattccttggccacaaggcaaaaccccacaagaaacatggcaagaagccttctgtctcacgcctccggctctgcaatacaatcgtggggagctgcataacctcaaagtcaaacggggcaccttaaccgcagaagatcggtttatgattaatgatcacatcatacagactatcttgatgctgcaacgcttaccctaccccaaacatttacaaggcgtgcccgaaattgcaggaggacaccatgagcgcatggatggcaaaggctacccacgaggaatcgaagcctcacagctgtcggtacctgcacgcatcatggcgattgccgatgtgtttgaagctctgacgtctaatgatcgcccctacaagaaggccaagtccttgcaagagtgcatcgcgatcatgacagatatggccaccagcgggcacatcgaccctaaactctatctgctgtttttgcagcacaaccttcatcaaacttacgcagagcaatttctttcggtggagcagtatcaaaatagcgttgtcgatactcaagagcatattcaaaaagtgctggcgtatttacgggaagattactagaacatcacgacagaaaggcgcgttgacgcctttctcatttttccttttaaaaactgacggttaacattttaacgtgtcacaattcaatcgattgcgttatcaatagttgatgtatgtcaaagagtcgtagacaatacgcccccgagtcggggatgagtttcgctagcaccagttcctccccgccgattgatttttcctattaaacctataggcaagatcggtttttgatttgtgtattgcgctgctagggttggcgcatgctaacaatacccaaaggttttccggtgaatatggatattgattcactgcaaaatcaagggagtacctcgtttctaaaggaaagatgatggtaatacctgaaaacagcagcatcgtaattttcggtgcttcgggagatttgacgtaccgtaagcttattcctgcgttgtatcacctctatgccagtcagcaactgcctaaatcgtttgcgattttaggtgtgagccgtaccgagtacagtgacgagtcttaccgcgagaagctaaagcgctcactgcaagagctggaaaaaacagaacctgccgctctcgaagccttcatgcagcatgtgcattatcaagcgctgaacacctcagaagtagctgattatcagcacttagcgacccgccttgatacactggctaacgattatcagtttgagcagcgtaatacgctgttttatctcgcaactccaccaagcttgtatggcgtgatcccagcttgccttgcggcacatggcctcaacgatgagagccaaggctggaagcgtctgatcatcgaaaaaccttttggttacgatctgcaatctgcacaagatctggatgtggaaatccaccaccacttcaaagagcatcagatctaccgtatcgaccactaccttggtaaagaaaccgtgcaaaacctgctggtgttccgctttgccaacggcatgtttgagccactgtggaaccgtaactttattgattacgtggaaatcacaggcgcagaattcctaggtgtggaagagcgcggcggttattacgatggttctggcgcggtgcgcgatatgttccaaaaccacctgctgcaagtgctggctatggtgggcatggagccgcctgcggcgatcaacgcggattccattcgtaacgaagtgaacaaggtactgcaaagcctacaaccgctttctgaatctgatctgcgcaacaatctggtgctcggtcaatacaccgaatcggaagtgcgtgggcaatttttacccagctaccgtaatgagccgggcgtggcggcggattcacgcaccgaaacttacgtcgcgctaaaaatgttcatcaataactggcgttggaatggtgtgccattctatgtgcgcagcggtaaacgtttaccaacgcgtgtcaccgaagtggtcattcacttcaaacgtacaccgcatcctgtctttgggcaaaatgcgccagagaacaagctgatcatccgtattcagcctgatgaaggcattctgatgagcttcggcttgaaagagcccggcgcaggtttcaaagccaaagaagtgtcgatgaatttccactacgcctcacttgagcagatcaaaatgctgaccgcttatgagcgtttgctgctggatgcactcaatggtgacgcgacactgtttgcccgtactgatgctgtagaagcttgttggaagtttgtgcagccgatcctcgatttcaaacaagatccgcaatcgctgtatggctacgcctgtggcacttggggcccgaaagagtcggatgacttgctgcgccgtgacggccgtgagtggcgcttcccttgtaaaaacctcactaacacggattactgcgaattatgatcaaccataaaattttcccaactgcggatgccgtagtgaaaagccttgccgacgatatgttggcgtacagccagcaaggtcagccagtacacatttccttatctggcggcagcacaccaaaaatgctgtttaagcttttggcaagccagccttacgccaacgacattcagtggaaaaacctgcatttctggtggggggatgaacgctgtgtggcaccggatgacgcagaaagcaactacggtgaagccaatgcgctgctgtttagcaaaatcaacatgcctgcacagaacattcaccgcattctgggtgaaaacgagccacaagctgaagcagaacgttttgctcaagcgatggcgcatgtgatcccaaccgaaaacggcacgcctgtgtttgattggatcctactgggtgtcggtgcggatggtcataccgcatccctgttcccagggcaaaccgactatgcagacgccaatctttcggtggtggcaagccatccagaatctgggcaactacgcgtttcaaaaaccgcgaaagtgctgcaagccgcaaaacgcatcagttatctcgttcttggcgcaggtaaagccgagatcgtagaacaaattcacaccactccagccgaacaactgccttatccggcagccaaaattcactccacttcaggagtgacggagtggtacttagattcagacgccgcagcaaagattgcgtgaaggagagaaataaatgaaaggtgatatcggtgtaatcggccttgcagtaatgggccagaacctgatcctcaacatgaacgaccacggcttcaaagtggtggcacacaaccgtaccgcggctaaagtggacgagtttctagaaggcccagcaaaaggcactaacattgttggcgcttacactctgcaagagctggtcgataaactggcgacgccacgcaaagtgatgctgatggttcgtgcaggtcaagtggttgatgacttcatcgagcaactggttccactgctcgacaaaggtgacatcatcattgatggtggtaacaccaacttccctgatactaaccgccgtgtcaaagcgctgcgtgaaaaaggcattcacttcatcggtacgggtgtttctggtggtgaagaaggtgcacgtttcggaccttcgatcatgccgggtggcgcacctgaagcatgggaagcggtaaaaccgattttccaaggcatttctgcaaaaactgacgctggtgagccttgctgtgactgggtgggcaacgatggtgccggtcacttcgtgaaaatggttcacaacggtatcgaatacggcgacatgcagcttatcactgaagcttaccagttcatgaaagatggtctgggaatgtcggccgatgaaatgcaagccgtatttgctgactggaacaaaactgagctagacagctacttggttgagatcaccgctgacatccttggctacaaagatgaagatggtgaagcgttggttgagaagatcctcgatactgctggccaaaaaggcacaggtaaatggacgggtatcaacgcgctggacatgggcatcccactgactctgatcaccgaatccgtgttctctcgctgcctatccgcactgaaagatcaacgtgttgaagctgaaaaactgtttggtaaaaccaaaactcaagtcgaaggtgacaaacaagtttgggttgatgcgctgcgtcaagcgctgctggcttcaaaaatcatctcttacgcacaaggctttatgctgatgcgtgaagcatcgaacgagaatggttggaacctgaactacggtaacgtggctctgatgtggcgtggtggttgtatcatccgctctgcgttcctaggcaacatccgtgatgcgtttgaaaagaacccagaactggcgttcttaggttctgatgcgtacttcaaaggtattctggacaactgtctggctgcatggcgtaaagtggcagcgaagtcgctggaagtcggcattccaatgccatgtacgacttcagcactgaccttccttgatggttacactacggctcgcctgccagcgaacctgctgcaagcacagcgtgattactttggtgcgcacacttatgagcgtatcgatcgtccgcgtggtgagttcttccacactaactggacgggtacaggcggtaatactgcgtctactacttacgacgtgtaatgacacctagtaggaaagcgtcatactgataaggatgaaattagggctagctacttctttcgtatcagcctataatttcgccgttcagggaggatgtcggttttaccgacatcctctatttttttctgcacatttcgcttttaagagaatcgacgatgacaatcaacaagtactatgttttggttccacaggctttggaacaatcaacacatcaggacagtgacgttgcatctgacatggaagctcagcgccaacaaatggtgaaagaagcacaaaatcaaggcggtttgtaactcaaaccacgccgataaaaaagcacctcagggtgctttttttatgtccattttccacgatatacccaaagagagagtggttactaggaagcgagtagattcattcccatgctcataaatagactacgtgattggagtgagctgacgccaccgcacattcaggtagagacagtatagaaaatcaactaatcatcgaaacttcctatagattagttcaattatagaaacaatcatgttgccaagtcgctatatatccaactctgtgctttgcttaaactcaccgcaacaaaacaaacttcccaacaacggagtcttaaaatgaacacattaaccaaactacttgctgctaccatgaccttatctgctcaagccatggctgcgaccccactgactttggatgtctacaacgccgatggtaacagcttccatgtgaatgcaaccgtggtgtacggtgaaaccgaagcgatggtagtggatactggctttaccaaagcagatgcgctgcgcatcggcgcgaaagtactggattcaggtaaaaccttaaaaacgattttcatctctcaagcggatccagactactactttggcgcagaagtgttaaagcagatgttcccgcaagcagaagtgattgcaaccccgggtgtaaaagcgaaaatcgaacagaaactgcaaggtaagctggatttctgggcaccgaaaatgggcgccaacgcgccagtgaaaccggttctgccaacggcataccaaggtaaaacactggaaattgatggccaaactatcgaaattcgtggtaccgaaggtgaactgaaacatcgtccttatttgtggatccctgccaatgcagcgatcttggggaatgtggctgtgtacggtaacgttcatctatggatggccgatgcacaaacagacagtgagcgcaaagcttgggctgaacaactcgatgagatggcagcgcttaagccaaaagtggtcatcccagggcatatgacaccgggaaccgccatggacagcagtgcgattacgttttcacaaaaatacctagctgattttgctaaagcgaaagcctctagtaaaaatagtgcacagctgattgaaaaaatgagcaaaatctatccggatgcaggcctgcctatggcgcttgaaattggtgcgaaagttcatactggtgaaatgaaatggtaagggttcactacatttttgaccctatgtgtgggtggtgcttcggcgccacctcactgatggaacaactggcacaacaatcccatcttgaactggtactacaccccggtggcatgatggataaagcacagctcagtcctgattttcgtgcgcatattttgcaagccgaccaacgcattcagcgtgaaacaggcgcagagtttggcgaggcgtatttagagcgtgtacgcagtggtcaaccactcatgctcgattcgtacttcacagcccaagccatcattgcggcacgtcttgctggcaaacgtgatttcgacatgctgaaagccattcagcgtgcgcactaccagcaaggtctggatgtgacacaaacggaggtaatgcaacagttagcgcaagcgatgggcattacccctgaaacatggcaaaacgtgatgccacaagctgcagcaaaagtacgcagtgacattgctcaaacccaacgcttaatgcaacagctgggtttaggtggttttccttcgttagccattgagcaaaataacgagtggtacaccttaagtcctagccactactatcgccgcccacaagagtggcaagcatggttagaatcactcagcgtgacagcataaaaaatgacaccccataatggggtgtcatttttttattcgattaataaatcagagactcttcctcgccaatccgccagctcatctcgccaatgttgttgctgtttatctgagctattttgcaaaatttgcacaacataacgctgacctaattcgcggttataactcagcttagctttcaagatcatcccgtaatgctgctcagggtttagtagtaaagattcgagttgggtctgaaatgcttctggttgtgttctttgttgcaataatgtacgcacctgctcacgcatcgtcgtttgaaatcctatccaatcgttggcggtgggttgaatattgtcgctccaaaccttgaccaactcttgctgggacttatttaagggtccaagccaatcttctaagcgatctgtgatccgctcttgataaaaatcacgcaactcactctcatccatcttaatgaatttcttggcaaatttgtcatgtcgtttaatgaaggcttgcataaactgttcggtttgctcctcactgagcgtggcggccagccggctgacatccggtagcagcttgataaccagacgctgatagtaaaatcgcattttctcttggaactgggctacctgctcaaccgttacgtcaggtaaagaaagcgccgaaagttcatccatcattgccaaataatcgggcaattcttgggcacgatgccagctctgtaaactcggcatcgtttgttcaatcaaggttttctgctgcgtattcaggtcaacaaaatcctcagcataatcaatcacaaaccaatcaagattgtggtagaccaacttagtcgcgcaaccaaccagaaaggtacagagcagaagtacacgaagccatttcaacataagagaggtcctttcttaattactctgagttttacgcagtaattcaagcgaacgttcaacaacccagtgagaaacttaaaaaagaatggctgaagctttgagagaaagaaagctggtcaagaccagctttcggatttatttggagagaacccacaatctggcgacattctcggccaaatcggcaaggttaaaatcggactctttaagcgcatcttcaagcgacatggcccgcggcaccgcagcgaaaaccgcatcgatcccgcactggtatacggcttgatagttatcgccagtacagccgcacaacgccagcacaggaacgtcaaagcgtttggcaactttggccacccccattggggttttgccatgtacggtttgactgtcgatacgcccttcgccagtgatcactaaatctgcatcactgacttgataagcaagttgcactgtctccagcacaatctcaatacccggtcgcaatcttgcttgagtataggccaaaagcgccgcgcccatcccccctgccgccccccgcaccggcactctctaaaaccattttgccagtcactttttccgtgagtaaaccaaactgccgtaaggctccatccaataattgaacatcttctggcgttgcccccttttgcggaccaaataccgcagacgcacctttatcgccacataaggggttgttcacatcacaggccaccaagatatcgcaatgctgtaaccttgggtcgaaatcttgtaaattgatgtgggtcaactcgcgtaaaccgccgccagtcagttggatgggatcgccatcggcattggtaaagcgcgcgccaagtgccgcaagcatgcccacgccgccatcattggtcgcactaccacctagaccaataatcagcttagtgacaccttgatctaacgcgtgtcggatcagctctcccgtaccaaaactggtggtgagtttagggtcgcgctgcgcaactggcacatgatgcaggccactggccgcggccatttcgatcaccgcagtttggttatctcccaaaattccatagaaggcctccactcgtttaccttgtggccccatcactttgacttcaacaagtcgtccttgtgtggcgtccaccaacgattgcaccgtaccttcaccaccgtccgcaaccgggatagcgacaaattttgcatcatgccatacccgagccagcccagcttgaatcgcatcacacacttgctttgccgttaagctctctttaaaggaatctggggcgataaccactttcatatcacgcgctcctaatttttataacaatactaagcttagaacatataccacagccatcgcagtgcccccttggactagagttgccatggtttgtgcgcggtaggccaaacctacactcatgcggctaaactgcgacacaacccagaagaaactgtcattggcatgagaaaccgtcattgcacccgcaccaatcgccattacggttaatgctcgtcccatttcactgtccaagcccagttggcctaaaagtggcgcaaccaatgcagaagtggtgaccaaggccacagtcgaagatccttgtgccgatttcagtgctgcagccacaataaatggcataaagatgccgacacccaacgccgacaacgtggttccgaggtaatcacctagtggtgtggctttcaaaactgcaccaaatgcaccgccagcccccgtaatcagtagaattggtgcggcagcggtaataccttgactgatacgctcgccaaactcagccactttgtcggcagatttcaataagcgtacggcaagaagcaaaccgatcagcagtgccgtcaatggctgaccaaggaagcccaacacctcaaacagcataccttgaccaaaagggaaactcgggaatttcgcgatagaaccaaaacagatcagcaaaatgggcacaaagatgggagcaaacgcttgactggcagaaggtaactggccgtaagaagccttaagggcttgccaatctttttttgggctttcttgcgaatcaatgatatcagcctcaaccgcttggaaacggttcgcccacaacataccagcaatcgccgcaaccgccgcgacaaacaggccaatggcaataactaaacctagttgggattccaagcccaagttacccgccgccgcaatcggtcccggagtcggtggaacaaaggtatgcgtagcatagagacccgtagcaagcgccacactcatggccacactggaggtggctaaacgtttggccagcgattcttttaatgaattgaggatcacaaagcctgagtcgcagaatactggaatcgaaacaatgtaaccgatgatactcatggtcaacgttggaaaacgctcacccaatagcttgatgacagtatccgccatagtaatggctgcgccgcttttttctaagatcacgccaatgatggtacccagtacaatcaccaagccgatgtaaccgaggataccaccaaagcctgtggtaatggttttggcaatcgtgtcagcaggcaaaccataagcaaatgcgccaaggaatgcagccagaagtaatgctaagaaagggtgtactttgaacttggtggtagcgagcacaataaagacaattaccgctaacaggattaagatcagactcataataactccatgtctttatgttctgaggcaaggtgaatgtcattccccgcctcttcgtagggtcgagctattatccttgttggctcgcatgattcctttaggcggaacaacaaatacaatgataaggaaaatgttaataactgtgcagatgcacaattttaatcataacttgtgagctgatacgcaatatacaattccgccaaaccaagtaaggagttagtctcaatccctgtaatttcggtgattttttctaaacgatagcgcagcgtatttcggtggataaacagttgttgggcgcaaagattcaagttgccatttgccgcaaatagtccctttaacgttttcacgagttgccctgacttatcctgtgtctgcaactcctgcatgactcgtcgccactgttcaccttgccatccttcattcaatggcaaaagcaataccggcaaacgcagttcctcgtagagatgtttctgtttttctggctggcgtacttggccaatcctcagtacctgcttggcactttggtaagagagatggatcgcgtttgggttgataaaaagctggcctaaagcaatgtcatatcctgtgatgtcataggctttgagcctcgccatcaacttatcaatccgcaaactttcgtattcgctggtccaatgctctggtgttcgacaaggtttgagcacgactatctcttgcatagaaaccacagcgaccagattgtcccgttcagggtgctccaaaagctcaaccacttgacggatctgatccaagctttgtccacttttcggttgacgaaaggcgatgaccactgccacgcgaggcttagagaggtcaatggaaagtctcgccgcccatgcatcaagttcggcggccgataaggtattgtgtatccaagcggaaatgaactcttcacgatgccgccgatcccattgtagttgttcgaccaaagctgcttgctcaatgatcatttcggcactcattttgaccagattggcaaaatcacgaatatctttcggctctccggtaatccccacaatcccgaccacttgctgctgatttctcaacaccatgttgatgcctggttttacacctttcagtgccacgcagctttctgccgttagctctaccgaatcgccatgtttgagtgccaaaattgcaccatcatgcacttggccaatccgatttttctcgccactgccaatgatcactccagcttgattcatcacattgatgttgtagccgatgatcgccatggtgcgatcgacaatttgttgcgctaattgactgtccagtatcatgacgactccctatccactctgcgtagacttataagtcctcttactgaatttcaataacatcatcactcacttttgtgactatgcacaaaaagaaaagctgcccgcaggcagctttgatggggataaaatagaggtcttgattaggtgcggatatgcgctattgcactattaagatcgtcaacgttgcgttgtaaatccaccacaacaggacccagttgtttgatcgctaggttcatttcaccagacagcgttttgatggtactgaggttacttgaaatctcatcacttacagttaattgctcctcagtcgcggcagcaattgacgtgttgagtttatggatctctttggccgagccctggatagccaccaacgactcgttggccacgcccatattgccacgggttgattgcattttatcggcactgacacggatcgttttggtcgacatctccgctttttcttgcagcatagagatcatggtttcaatctcgcccgtcgattcttgcgtacgctgtgccaaagaacggacttcatcagcgaccaccgcaaaacctcgcccttgctcacccgcgcgagccgcttcaatcgccgcattcaacgccagcaagttggtctgctctgcaatcgctttaatcacatccagcacgttgccgacattattggactcagtagccagttgttgaatgatctctgaggttttttggaattcgccgtctaaatccgcaaattcgcgaatcgttttctcaaacacttgtttgctgttattggcttctttttcagcactgcctgcatactcttctgccatattagtgctttgggacacactcgataacgccgaagtcatctcttccatcgcggtcgccgccatctctaactcttggtcttgttggctagacatcttcatattttgatccgtgatgctacgaatagtgtcggaaatcgaggaaatggtgtggttaacctgattaattttactgatggttgagccataactacctagaactttgttaatcgtacgtccaatcacggccagctcatcatcgcttttttcttcaacccttaaggtaagatctgaattgtcatcggctctttgtaagacactcgccattcgatcaattggagtcacaattttacggttgacgacgacgtaaccaataatggcaataatagcgaccacaactaatgagatattgccgatcaatacggtactttttacttgctctgcggcttggttaaactgctgtgccgttcgtgtttcaagctcttggaagaagcggtcaatgggtgccatgatcttagctttttcacgatggtactcttcactgtgcagcagttgaaccgccatgttgacatccggctcgccttttaccgtgtagttgccactcgcatcaggaaacaagccttttaccgcattcatggctttcacttccatattcactaaagcatcggagttattttgcgcttctttcagcaaagcgaactctctgtcactaaaaccgaggtctttcatcatttgctgtagcgcgatggtttgcccatccggtttaggtttttggccgtattgcaggacaagatcccaataaatggtgtggtagctctcggggcggggctttttgccgttacggatatcaagaatatccatatacatcttttcgtatttttcatccccagtgaccacataggtacgccctaagcgggtcaagtcatcggaactttggcgtagctcatccgcagcttggtaagattgataacggatcaacgataatctatcgacttgctgttcgagactatccaattggaacacagtcgccatagtaatcgccatgcctacgcctatcgccgaaaaaacaagcttcatcgtggtgttaattttcatggaaaatccttctaggaaaaaaaagcgtatatccggtcatttataatgacttttttattgttactttcagcttagaagatgtttaacgaactggtaggagaatgttgctttttttctatgggtaatgactcagatgtctttgaacgatacgtatctagcacatatgcctaaaagcactgtgatcattgtgcctatcaaagtgaagtagatcacatgattactttgatatggggtcaggataaaaataaagcggctttgcagccgcttatagagaggtcgatttatgactcaagagtcatgcttagccattagaaatcttacgatggccttcttccagatgaacaaagtccaccaaatcatcgccagaaacttggtatgcttggccaaagcctttcacgaataaaccctgctctggctgtagacggaataacatgaagtcttgcagttgactgagaccatcaatgatttcgccaaagcgctcacccatttgtgcaatcacttggcaccacaactcgctgtcacgttcaaccatgctggcaaccgcatcaaaggtcagacgtttacgggcgaaaagttgttttgcttccgtttcatcttcaatcatcatgatcgacacttgcggattcacttcaaggttacgggcatgacgggcgatgtgcgaaatcagcacaaagtagccttcttgattttgtacgaaaggggcataactaacattcggacgaccttgcgcatcgactgtcgccagttgcagcgttttacgctcttgacggaactctttgatttctggctctaaacgaccctgcaaacgctcttgcttaacttgctgatccatctctttctcctcaacgatggtttattattgtttgtgttgttgctgcattgctttaaagcgtgcgacttgctctgggatcaattcgcgtttctcatcacgtcccagatagattttgaacgcgttttcaccttgagcggtaaagaagccaaagtagtggctctcgcgtcccataaatggcttactgactaaagccacatggctaatattttcgagtttcaaatggccatgcagttccccatcacgacccattaaattgtagtaaccccgtgcaactttcccttttggaaaaggtgctttgacttcaaaaatagaacccgcaatggtcatgatcgtggtgacagggccccattctggcagactttctaaaatggtttgcgcatgagagccatccaccaccgcgaccatctcttcaggaagagcatgcacgatgtcaaactcagtgacattgagttgctccgccattgcggcaggtaataaagtgggttgctgctcaagcagttgagcgacttgctgttgtaatgattccattgttttttccagtctagttatgcttatgcgatacgctgctgttgatatttgtacgaatgaataagcacctgaatacacgcctgcgcaaggcttaccgaccagaagcgtccggcggtagtcagagtgagatagtcttgctccacctcaaccagaccgatttgttgccagcgtaaaaagagcggcattaaccagtcaaaggtttggtggtgataaaatttaggtaaacgctgtttggcgatgacacccgcatcaaatccggctttcaaggcggcaaacagggggtcatattcatgttggcgagccatcatggcgacaagcggttgaccatttttcatcgcgtcaaggtaagtatcgagttggcgatgttgcatcagtgaataaccgcccatatttccgcccgcaccacaaccaatcgggagcacttcggcgtaggttttggccaaactgttataaaggctgcgctcgcggttgtcgcgagtccagtggtttacgctcaatgggcgcagatgatgcttcgccataaattccaccccgatttggtacaaggaggctttatctggcgtagttgccggtgggggtaacttgcctttttcaaccagattgagcatcggggcactaccgccaacaacgagctggtataaatcaatcccttgtgccccagtctgcataaaatcttgtagatcttgctcgaacacttgcgccgtttggtagggtaagccgtagagtagatcaatcacaatcggcgcttgttgggtcgcagccaatgaggcgatacgctccatcaccacctcacgatcatccagtcgtttggctcggcgtctcacctgagtattaaaactctgcacaccaaaagagaaacggttaaagcccccttccagagcgttttcaaacatctcatcactaaagcgatgaattcgaccttctagagtgatttcacaatctggcgttaatggaaacgactcacggattgcagtacccaactgccggatttgctcgggagagagctcagtcggcgtccccccgccaatatagaccgcatgaaagacgccagtttgtgtccaaggcagtgccgctttttgtttgatctcttcaagtaacgctgcaaaatacgcatccaccaactggcgactcgccgcgttttggaagaaattacagaaagtacagcgtactcgacaaaaaggaacatggatgtagagacaccgcacctgttgacgttggctgacttgttgagtgatgtgttgccacacgttcgcctgctcatgactcggtacaggcatcgcgataccgcctgcatgggctgaatgcttattttgaaaagcaaaacgcagcggatctggcgtattcgcacccaaaatagattcatcaaaattatctaaaatcaacattatcatttctcaagccaatccccatacgacaagggttgcgcttctcttcatctcatacgatcaaaatcataaattgacgctaatgataatgcaattgataattgctattattaagatgctgagcaataatatttgcccactaaggctaatcgcgtatggatttatccatgcctcgttagtctgcatgaattgaaatagccagtttgatcagcctgccacttgctgagttttcagagagacaggagcaatatcgctgatcatcgtgagggagaaggacgtgaatctgaacagatatgtcattgcgggagggctttccctagcttttcacgcgctattgcttatcacgacagatgaagcacaggtgtttgccatgcctgctggaaacccaactcaatcggtttcgatcaatatggtttcgatgcctaaagtcgcacccgctcaaccagagcaaacccaaacagaacaatcaaaaccggaatcggtcaagccgacaccagtacaagaagtcgtaaaaactccgcctgctaagccgaaggtgaagccgcacaaacctaaacctcaaaccgtgaagaaacccgtaccggctgagcaagtcccatccaaatcggtagcgaagccgcaaccggagaaggtagagcgtaccgctgaaaccgcacaaaagcctgcgccaacacctaaccagcaaccgagccagcctacggcggctagccaaggcatcacaagtcaacctattttggtggataagcccgctttagtgagcgcacaagttcaaccacgttatccacgtattgctcgtaagcgcgggatcgaaggtacagtgatgtatgaaatttggctggatgcgcaaggtaatcaaatcaagcagcagttgctctcttcatccggcactgaagccttggatcaatcggcgctcgaagccattaaacagtggaaattttctccacatattcttgacggtgtgcccgtagctcaccgaattcatatccctattcgttttaaattggaaggctaatggaatcgttacaacaactccaacaacagctaggcctgatggcttggccacttttcatttgctcagcattaacggtaatgctgctcgcggagcgcctatttcaagtgctgctcagtttaaccgtaggcaaaggagcgattcgtcacgctttgcaagctacctcccccaaaaacccaaagcaactggctgaacttacagagcatttcgcgagtaagcgtccggtgctgtatcgcggagtggcgatgcttttggcccatcaccaatttgataagtcattgcgcgaagatgcggcgggcatttggctacaggagcagcgtcaccagtttaactcggggttgcgtctcttgactttgattggtgtgatcagccctttgctcggtctgttgggtaccgtacttggcctgattgaaatgtttaaaggggtggccgccacgaccggaagtattacccccaatgtgttagccgatggtttaggcgttgcaatgtacaccacggcagcgggtctgctgattgccgttccggcagttgcgggggcccaattgctcagcctgtgggcggatcgcactatggctaaactggaacataccctgaactacgtgaacctttggctagaaggcatgacactgcacgccgacgcttcactgacagtcgtgacaccgcaagaggccacaacggaaaacctatgatcaagtcctcagccaaacacaacgacttcggcctgactccggacctcactccgctacttgatatcatctttatcgtgatggtgttcttgctgctgaccgcgtcagtacgcttggaatcgttggaagtggctctgcccacgaccgattcacccgtagtgaatgaagtgaataaagaatctatcaccgtcaatatcttagccaccgaaccttattgggcgattgatggtaagccctacctcgactggcataacttctcgttggcgcttttagagtctgtacaagtggataagcgtccggtagtcatcgccgccgatcaaggggctgaggttcaacaattagtcaaactgttgagctttttacaagaaaacggcattcaagccacccagttattaactgaaccttctcactcttaatggaaacaagatgaaaatcactcaatcattggctttattactggcctgctgcacttcaggcatcagtttcgctcaagaacggatcgtcagtgcaggaagtgcagtgactgaactgattctggcactgggtgctgagcagcaattggtggcggtcgatgtcacaagcgaagtgccgagttctctcaatttacctaccgtcggctatcaccgccgcttggccgctgaaggcttattaactcttgagccaacccacctgattggttcagatgaaatgggacccgatactgcattacaacaactgcgcagttccggtatccaagtcaatgtgatcaacagtgattcgacgccgcaaggcttgttaacacgtattgaccaaattgcccaaatcacccacaccgaacaacacgctcaaaagctgaaagagaacgttcagcagcagatcaatgcgttgcaagctaagcgtccggaaaaacctaagaaagtgctgtttttattactgcatgaaggtcgtgcggccaacgtagcgggtagcgataccgtccccgataccattattggtctaatcggtgctcataatcctgcctctccttccattacttcgtataaaccgctgtccatggaatccatgattgagatgcaacctgatatggtgctggtcagtggtcgcagcctagaaaaactggggggtgctgatgctgtgttgaatgccgtgcctatgctcgcggcaacaccagcaggacaaaacaagaatattgtcgcgattgatggccacgccttagtcggcggcttaggtctgaaaagtctgcaagaagcgcagcgtattcaaactctgctgtacccctgaggccactcccagtgttaagacgatttccttttgctgtgaccatcagttgcctgactctggcggtcttctttgcggggctgtattccatcactgtcggaccgatgaacatcaccatctctgacagtattcaaagcctgctttttcgctccgagcaactcacgaatgcgattcatctcgttatccatgatattcgcttaccacgcacgctcctttgtttgttggttggggcgattctcgcgctatgcggcaccgctatgcaggggctattccgcaacccgttagctgagccgggcatcattggcgtctcctcgggcgcctctcttggtgcggcactcgccatcgtgttactcagtgatgtggtgtcaagcctgccttgggtgaatagcttggtgctgcctatagcggcatttatcggtggcgcgctgacaaccgtattggtttatcgtcttggcacctctaaatttgggacatcggtgactatcatgctactggctggggtagccatttcggctcttgcaggcgcaggtattggttatcttaattatctcgcgagcgatcaaatgctgcgcgacttaaccctatggtccatgggttccgtggcaggcgcgacgacctccagtattttgctgtgcagtgtcactctaatcatgctatttgcctatttccattggcgctcgatggcacttaatgccttattgcttggagaggcggaagcgcgccatcttggtgttccagtacaaaaactcaaaagagagatgattctgctttcggcagtaggcgtcggggttgcggtaagtgccgcaggtatgatcggttttgtggggcttgtggtgccacatattggtcgcatgttggtgggtcccgatcatcgtaacctagtgccagtctccactctacttggtgcattgatgctcacccttgccgatatggtcgctcgggttgcggttgcgcccgctgaattgccaattggcattgtcaccgcactggtcggtgcccccttcttcttgtatctcctattccaacaaaaaggtcgaatattctgatgcagactattgcaattcaaggcagggatctttgtgtcacctacggctctcgccaagtgctcgatcatgtggatatcaccttgcgctgtggcgaagtcgcggcgttactcggtcctaacggagccgggaaaagtaccttactgaagctgctctgcggtgaaatgagcggagcaggcaaactcgattattttggtgttccagcatcgcagtggcctgccgaaaaactggctaaccatttgggcattttgccccagcagagctcgttgacttttccttttaccgcgcaagaagtggttgagctgggggctatcccactcaatctaccgcgcaaagaagtagaacgtgtcgcccgtcattacatgctcaaaaccgatgtattacacctcgcagccagtctttacccttctctttctggaggtgaaaagcagcgcttacatctcgcgcgagtactcactcaactgcaccaagctggtcaacagcgtattttgatgctggatgagccgacatcagcactcgatctcgctcatcaacacaacacgctgcaactcgcgcgtcagttagccgatgaagaacaatgtgccgtcgtcgttgtgttgcatgatttaaaccttgccgcgcagtactcagatcggctgatcctgcttcatcaaggcaaaattgtatgtgatgcggcaccttggcaggcgctgacggcagaaagaattgagcaggtttacggctatcaagcgctggttgccgcccatcctactcgtgatttcccaatggtttatccagcttgaggagtctctcaagtcggtttcatcacctttagggcttgtctatcccctattcccatagaccaaaagctctgtacctaaccgttgcgcttaggtgcagagctttttactgatgaagtaggcagaaggtgaagaatcaattcaccatgctgactaatgagtgccccagcaaccattccacttctttttggctctcttgtccgaatttctcttccgtcaatttatagaggcgattaacccctttatgagcaaaatcatgtgcacgctccgctgtcacaatgtggtgaaacagcaggcgcaaaatggccacaaattcagatttctccatggcttttagccaactgtcacgaaatgcctccatgtcgtgttcaaaatcgaggtattccataaacattttaaatatgcgtccgtctaacgcagaggcgaaatcggttttcttcgggaaatggtggctgatcccagttcgggataccccagtttgctggctgagagtggtgtaagacattttgtcataacccagtcgaagcaactggtcgacaaccgcatccataatggtctgaatcgtcacttcagtatcttctttactacgcttaggcatggtcaggctcttttctaacgtcaaatctttgtctgcttaacaagtcagcagcacgataattatcattaaaatgatcaggggcaaacactacgatggagtgaactcactactacggtttgactcacctattcaatactagacagccaaacggtgagttcttacatttgcataaacctttgttacttttttgaacaaggtcacttgtataaaccgctgttggctaggtaaccgcaataaatcatattttggtaagcaaataatccaacaatctattgagtgtgacaatgaactggtcgaaattctgacaattttccgacacttggaacgccaaattaccggagaagatcacagaagtccctactctctcccaccagatgatcgcgctttgtacttttatttccctgtatttccttcttcattttatatcctaagtagcagaccatttttgtggcataagcctaaagagaggactaaaatggccccattatgagtaagtaaattaagtcgtaagaggattaggatatgagtaaccaaacttgtgtagaaaatgaagtatgtgaagcgtgtggctgcgctggcgaaatcggttttattattcgcgaaggtgatgatgtcgcagaagtttctctgtttggttcggataaagcgcatttagaaggcaagctggcggaatacattagcttagccaagcaagtttatgcgaatgttgagtatgaagtggctcccgttgcagataacgcgacagaactgcacgctcgttttaaatttgaagtgagtgctgaaaaactgattttcgaactgaaaacacgggcgcttgcacgctaatcgtcacctcatcacatcgagcgggctcaagcccgcttttcttttctcactccctcgtcgacgccaatccaatatccccaacgacttgacgctgcagcttcaagtaggaagggaataaataggaaaagccataaagcctagtccactgccgccgataccctttatactgacaaaactcgccacacaggataaacgcttcgccatgatgcttcgtgttattgccctttcattgtcgcttatcgcgggtttcacacatgcgatggctttggatctctacatggtactcaaccatctcgacaattacggtaaccttgatctgcgcggcaagccctacacttccttgccggaaaacttcacgatcaaagggaatttgaatatcgctaaaactgcgatcaaatcgctaccgaaaggcaccatcatagagggcagcttggatgcctcaaacagttcgctggaaaaagtaccacgaggcacgagcatcaaaggctacgccaacttactcggaaccaaaattcaatcgtggccatccggtgtaaaggtaggcggttatctcaactttactgacacgccattaaccaccctaccagcacgaatgacagtaaaaggcgatctcagtgtgatccgcacaccgctcactgacttgccagaaggcatagtgattgaaggacacctcttcattggcggctcacaaatcactcgcttcccagacacaatgacggttaagggcaatatttacttagggggtaaccaaatcagtaaatggccaagcaaactcacactcggcggcgctgtcgctcgctaaagtagaaaaagcaaaagaggagccgactgagctcctcttttgcttaagcgggggaattcattagatgtgattacgtacgggattggcgtaagcatccaacaaataacgatgagcaggctcaggcaactgtgccaattttgcctgtaacactgcgcgcacttctggcgtaatgtctttatcgtcttggccagccgctaagcgattgattgggaacagcacatagttctggtggatctgtcggtcaatctcttgcgccagagcttctggtgtctcaaatggctgggtaatgacatcaccaaacgcgacatgcacacggcctttatcacccacaatgccttggatgatgctttcgatatcttcaaattcacctttttcataactgccttgtgtcgctttctcatacagctcgcgcgcttttgcgatgtcacaaggatcgttttcataggaaatcgaaaccggaaccagattgagtgaacgaacataatcggcaaattccattttttgacgacgtccttcaacgtggaacatttttaagatagccggatcggtttggtcattaccatctttggctcgcccctctttttgagcgatccaaatggagtggcctgtctccagcgaatgtttgatataagccgacagcgtaccgagagctttcatcatttctcttggaccttttgccgagcgtttcacaataaagcttttgttcaaacgcatcagctcggtcgcacaaggctttttcaagaggttatcgccgatcgcaatccgtacggtacgatgacctgccatatgcagtccgtagttgactaaggctggatccatcgcgatatcacggtggttacaaataaataagtaggcctgttctttatccaacttatccaagccactgtagctcacccctttcgtggtctgctctaaggtttggtctaggtatttttttacctcaagttggatcgcttcgacgctgtccaacttcgcccatttacgctttaggtaaaacttaaccagcggtgccatcaaagcacgcaaccaagcagaatggtgtttgaagcgatgtttcaaaatcgctgaaataaactcttggtcgttgatgagacgagagagcgccgcggggatctcgtcatcattgtaaggacgaatatcaatataaggatcagttgttgaagtcataggtttgtacatcagataaaaaacgggcctattctacgcatagttagccctgctatcagcaaggatgtctaaggtcagaccagaattatgtatccctttatttaccccaatcacgggaattggctttttctgcgataagcgttaatcttagcgcccttaaaattcccgaggcatcttatgaactacgctattcagtctgaaacgcgccactatccttaccttgaggtatcggctcggaaacgtgcgctaaaacacagcctgatccgcgttgagcaaggtttgttactctttcgactcggaaagcatgagtatgccgtggaaaaaggtcaaacgctttggattcctttcgactgcttgtgtggcctcacattttttccggacacacacatcactcgggtcgatttttcactgcgtttaaacgtgcgcttaccgcacaatgcaggatttatcaaaagttctgagcttgcgctggccgtattgcaccgattacaaaactgtgaacgccaccaccctacgtttactcatctcacccaattactcatgcttgagctgaccacttgtgacccaaaactgaagatgtcaccactcacccaagccatcacggaatggcaaccgcaagcgcatgcgagtgtcagcaaagaacagcatgtggtgctgctggtgcgtgaagcgctcaaacgctcccaatccggcgctcagacacacagcattatcgaggaactgttttccggcaatgccgagcattatcaccagctttgtacgttagttttaggacgaacactataagcgcgcagttgcacaaaatctcaatataaatcaaatcattatcacaacctctgaataaaagtgtgatctctaactggctgaagtgccaaaacataactataaatttattaataataataaccctatcgttatggaaaggaatcacgatgaaattcagccataaaattgttgctgcgtcgtctgtacttctgcttgctactgttgcgctgctttcgggtagccaatacttcaaagtccgagatgaaatccgcagcatggtttctgacagtgttgatgagattgtcgatggtgtaagtaaaacgaccgccgaagtcatcaatggcagaaaaagtatcgcgcaatacgccactagcttgattgagaacaatcctgaacccgataatgtgcgcacgatcatctcgcaacccttgatcaaaaacaccttccttttagtaggatttggtttagagaaagacggttcgaatatcaataacgacccgagttggaacccgggcccgacttgggacccacgtgttcgtccttggtataaagacgccaaaaatgccggtaagttggtgattaccgcaccttacgccgattccgccagcggcgaaattctggtttccgtcgcaacgccagtcaaagacagtgcaacaggtcaattcctcggttccatcttttacgatgtcagcttggctgaactcgctgaactggttaacgaagtaaaactgtttgatgcgggttatgtctttattgtgtccgaagatggcaccacgatcgcccacccgaaaaaagagttcaatggcaaacccatgtcagaatttttgggtgaaagcaaaatcaatgttgatacccatcaagtcatcatcaatggcaaaccctatgcagtcagcttctccgatgtagaaggcgaagattggtatgtcggtgtggtgattgatgaagagattgcttacgccgcgctagatgaattacgaagaagtacgctcattttcactgtgatagccctagtgatcagcgtgtttgttctactgtttatcgttcgtgtactaatgaaacctctcgatactcttaacgacgcgattcaaaacgtggcttctggtgaaggtgacttaactcagcgtttgagcaccaataccgatgaagagtttgccaaactggcgattggttttaatacctttactgaaacgctacagaagcagttgatccaatccaaagcgattggtgccgagatcttacgcggttcagaatccacatcaatgacgctacaacagtcggcagaagccatgcgttctcagcttcatgagttggaacagttggcgaccgccatgcatgaaatggcgacgacgtcttcagatgtagccaataatgcgcaaggtgccgcttcggctgcaaaagtggctgacgatgccgccgccgcaggcacggatgtggttaccaaaaccacgaaagccattgataccctttctgccactattgatgccgcggtagacgatgtgaaagtgctggaaagcgcgactgcaaacattgaaaccgtgctgaaagtgattaacgacattgcggatcaaaccaacctgctcgcactcaacgcagcgattgaagcggcgcgagccggtgaatctggccgcggctttgcggtggtcgccgatgaagttcgtactctggcacagcgtactcaacagtccacgacggaaattcgtaacatgattgagaagctgcaatctggagccaatgcggttgcggttgccatgagccacagtaaagatacggcggccagtgcggtcaaccaagcgcaaggcgcgaatgaagcgttagaaaaaatccgccttgcgattcagcagatcagcgatatgaacattcaaatcgcctccgctgcggaagaacaaagcttagttgcagaagagatcaacaacaacactgtcaagatcaaagacctgtcggatcaagttgctgaatctgctgatgaagcgaacatgtcgatgcagatccaaacggaaaatatccgcgagcaggatgcaatcttgaataaattcaaagtgtaaccttaaccaaaatgcaaaaacctcccaacgggaggtttttttatcacttcaaatctgaacggctaaaactcgacatccagatccgtgttggcgaccgagcagcaagccaaagccatgcccatcgagcgttcatgatccatcaaagcaggaactttaggctgctccactaaacctgactttactttcactttacacgctccacaaatgcccgcacggcagctattgggtattctcacaccagcgtcttcggcgtgctctagcaaggttttctgattatccgcagagacttgaataccattgaaactgagtgtcacagcctttttctctcgcggcgcaacttgcagagtaccgaaggcttcctgatgataagccgattccgctaccccttgtttgagcagtaaattcttggctttttgcataaaaccgtctggaccacacacaaacacttggcgggaaacaaggttgggaatgcgtttaatgtgcgagagagataagcgaccttgctccccttgccactgcggcgaaggttgggttaacgcatagatgagcgtcagcccagcatgttgttttgccaacgcatccagctctgcttggcaagggatgtcttgctcactgcggcattgatgataaaacactacatcatcgagttggttatggtccgccagataacgcaacatagacagcataggggtgacaccactgcctgccgaaagcagcagcaaaggctgtagcgcggtggtatccagatggaaatgcccagtaggatgctgcgcggtcaaggtcgtgccaatctgcaaattctcttgcaaccaattagaaactcgcccgccatcaatgcgcttgaccgaaatcgctaaacgtcccggacgcgatgggctcgacgaaagcgtgtagtaacgctgcacaggctcaccctcaatcaccatttcaattggcagatattgccccggaaaatactgggtagcgatttcttgggtaggctctagccagaaggtcacaaaatcacgggcgatctcttcgcgctcaacacaagtcagtgtgaagtggctgatcccttggtctgggtaaacttctttctctttatattccaacacttcaatcggatcgcccgctcgaatcattccttcatttttggcaaccaagttttgcccgaaaaacacgccaccgcgctcattagcacgaaattgtgagagagtacgcagcggctctttggttggcctaaacgcccctttcttcacttcaaccgtggttaaaatgcagcgttcacaaggtttgacggcttcaaactccacttcgccgatacggatacgcttccagctatcttcagcgaatggttcagtaccagaaacgaccaagttggtacgaaattgatccattgaatgaaactcagggctgcggcggttgagttcatccaacgatgcttggcttatcaccaacagcggatatccatctgcaaagctgacattgtgacccactttttcacgcacacgattggattgctcgccgctgtataagagctcaacacgaatccctaacacctgactaaaccaatcgtctgcttcatcggtggtggtgtacgcagtgaaattatccgaccaaacttgtgcgggtactggttgaaacttgaagtctgcataacggatggtaagcgagggatgaccttgtgcagaaaacagcacaccatcatggcgcagcgcggttttgatcagcaccatttgcggaaatttacgcgccgtcaccatacttccgtcagacagtgccagcataaaacgacgatcaaaggttaagccttgcttttctacccaagcggacgacagcgccagcccacctaacgatttcactggaaagacattgatttgagataagagtccagacgacatggtgcttcctttggttgttgtcatacctacatttcttggatttgccgctaagcggccacagagcgcatcctcgtgagcatagacaaacgctatgattgggatggaagaatctagccaaaactgttgcagcttcgagtacgacggagttatttgcgcaacatcatagaacaaattgttacttcagactaacacgttgttacaaatcagggttctggtttctattcagatatacccaaaccacttggagttgcaggtaggcggcaagtgagtgacaaatttgtctggaacaaatttgcacagccatcggctggcctttggtgagagccaaggatggctctcataatccccatgagcatagacagactatgtgattggggtaaacgaacgtagccaacacccctgcagcttcaagtaggaagggtataccaagggcaaaatagaccaagacaaataacacgtgaaatggattacactttccactatcatcctgtcgcctaagcggaagcgtttgcgcgacgctttaggctccaatcatttcatgcattcatggtgggagcactcaatgacaacactgacgattacacgcccagacgactggcacgttcaccttcgcgatggcgatgtactggccgatactgtacgcgacatcagccgttataacggccgcgcgctgatcatgcctaacacggttccccctgtaaccaccactgagatggccttagcctatcgtgagcgcattatggccgctcagccacaagcgcactttgaacctttgatggcgctttacctcaccgataacacatcacctgaggaaattcgcaaagccaaagcgtcaggcaaagtcgttgcagctaagctttacccagccggtgcgaccaccaactcggattcaggcgtcacttcagccaaaaacatttacccagttttgcaagcgatgcaggaagtcggtatgttgctgttggtgcacggtgaagtcaccacgcacgaagtcgacatttttgaccgtgaaaagaccttcctagacaccgtgcttgcgccgatcgtgaatgatttcccgcaactgaaaattgtgcttgaacacatcaccaccgccgatgcagtgacctttgtgcaacaagcaggcgataacgttgcggcaacgattaccgcgcaccatttgctgtttaaccgtaaccacatgctggttggcggtattcgcccacatttctactgtttgccaatcctaaagcgtgcgactcaccaacacgcgttagtggcagcggcaacctctggcagcaagaaattcttcctaggtacggactctgccccgcacgccaaaggccgcaaagaagccgcttgtggctgcgcaggttcttacacagcccatgcagctcttgagttgtatgccgaagtgtttgaaaaagaaggtaagctagaaaatctggaagcgttcgctagctttaatggccctgatttctacggcctacctcgcaatcaagagaccgtcacgctcaccaagcaagcctggccagtcgcagaaagcatgccgtttggcagcgatatcgtggtgccaatccgcgccggtgaaaatatcgagtggacagtgaagtaaactcagttcagatgtacgaaaggagaggttcgcctctccttttcattccctattctgcgattttagttctgccgatgctgtttccgatactcgctgggggtcatccctgttactcgtgagaattcacggttgaaattcgatttggtctgaaaacccgagttcataaaaatctgagtgatggaatcgtcactctgggttagcgcccacaacgcatgatcaatccggtattcattaatcaacttggaaatgttcttttgatgcacttgattaacagccgccgatatctgtttcgcgggaataccgagtttgcgcgatagcttagataaggtcagttcaggatctaagtagtgcgttttttccctcatttgtcggtcaaacaaggccacaatctcttgtgctcgtgcttctggcatgccctcatcggttaacgtctctttcacttcatgtgaggtcgtcagttccaaattagcgacttcatcactgctggatgtgctcaccccaaccacaatcacggcgaaagccaaaacagggatcagtatcacatgcccaacggtcaaaatgtacagcgaaaaacgtccttggttgtagatgaaatcgagagacatcgcgctatcgatcaatgcagaaaacagcagcatccaaccggcgatattttcagcccgtttgacgttttcccaatggttaaacgcgacatagatgcgtaacgcatcttgtgaggaataacgcaccaacgcaatcccgtaaaacagatagatcgcggtcagaatttcatcgagaggtagcgaccaaaatggctgagccaacaagctcaccaacaccagaattgggccagataaatgcttataacaacgcgagaggcccttttcatgggtacgagtaaaggtacaccacgcagcaacaggaatgagggaagctaaaataggttgtgccatgcgcagcgcagaccaatcgaccgtccaacgtaatccaaccacagccgtggttgccgcacacaacactaaaaaaagacaagcacttttcgcctgctcagccagtcgtaaatagagcgttactgccaataacagcagcatcagcgaaaccacgaagggcactggaatcatcaacatatctttccctgaaaaagtaaacggtagaccgcattgaacggtctgattacgcaacagcttagactaatacccgttcaagtacgtcctcaaacccgttttaggacgtttttcgccacagattgccccaccatttccagtgccaattcccaacatgagaaacgcacatgacacctttactgaccgcctatttacaggcgtggaaacaatactttgatttttcagggcaaacaaccagagacgatttttggtggttcatgctcgctcatctactgatcacattggtggtggtcagtattgagatcgccacaaacaacccaggctggttagatctgttttacagcctcatcagctttatcccaatgctcgccatcttagttcggcgtttgcatgatactcaacgctccggatggtgggcatggttatttgtgatccccgtgattggccctttctggctaatttacttactggttcagccctcttcctcccacttcaccgataaggcacttttatcatgagaactctattggttttactgctgatttcaatggcgaatcttgcttcggcggatcctcttaaactcaatgaccacttacccgatcaaaccattggtctactaaccatcacgaaaatgacccaagggcagcttctttggttaaaagggcgagtgggagaaggaaaatatcaagccaaaaatgcgcaagggcaagagtgttcgatagaagtgccagttgcgattggcagcttttcacaagccaatattggtattcactctactcaaggtttgatgatcgcgattactaatccgcgtttaagtgaagcgatactcgaagggcaaagaatccacagcgatgattgggtatttagcacaaaagaagagcgtaaaaaggtggatggctacattgtgagtggcattgctgccgatgaaggcttcattctcaactctcgtcggcgttggatttcttggctgcttgatgcagagccacaggtgatctgcaatacggaagtggccaatcacagctaagtcgctcttaatcctataaaaatgccccttattgttcagtcttccgtagctattttctgaccaacaaggtcagcacttcagcgtgatctgtatgcgggaacatatcaaaccactgcacgcgaatcatttggtaactggaaagctcagcgatgtctttaaccatagtttgcgggttacagctggaataaagaatgtattttggtgcgagcgcttccaattgcgcggtcagttcgctgcccaaaccacgacgtggagggttgaccaacactaactctggcgcactcatctggctttgtgaaaacttggcagaatcgagcgctgcaaagctgagattatcaatccccatcatttgcgccgaacgttgcgcgctggcaatcgcttctggttcaatttcaatgcccgtcacagcagtgtctggcgcggcgcaatgcagcgcaaagccaccgacgccacaaaacagatcccacatttgcgttggcgcaatctcgcgcacccaagtacgtgcggtcgcgtatagctgctcagccactttggggttggtttggaaaaagcttttcgggcggatcaccataggcacatcgttgaagtgttcaagcaggctttgggtttcggtgaggaaaatttcctcttcgccttctaaacgcgccatatgcaccggctggatattgacggaaatgacttcgatcatcgggaaagctgcgatcaatgttggcaaattgcgttcaattcgctcaagcaccgcatggctgcgcgccacaaaacgcagcataaattggccgctgttttcactgcgggtgagcagaataaacttcagctcaccttttttcttcagcttgttatagggtggaatacccgcaatgcggatccagttttccagataagcgagcagctcttgcatcggctgcggataaagcgggcaagtcactagcgacaaaggctgaccttgcgcatcttcaatgcctaaaatcggcgcgtgagccgcaccaagcaccaccattttggctttattgcgaaacgcggtgtcagcactggtgacagggggtaaccactgcacatccgtggctggcgcaatcaactcgcgcaactgctgatctttattcgtaacctgctcggaatacggctgcgcacataggtggcaagaggtacaccgtttttgaataaagaactcacactgcataatatcgaccgccgaaaaacaaaagccgctagtttatttgccttcccaaaaataacaatgagaattttacggataccctacttcatgttgtagacaacaagtcagaaggagaattaaccgcgaactttgtgccacacttccattaccgctactaagaggctgccagccaccacgccaatcacaccattcatcagggttggcatcagtgtcccgaccactggccatgcatggacgacatcaagcatcggttcaagaatatgatgcaccgcaggcacgttatgtaccacaatcccaccgccgactaaaaacatcgccgcagttccaacgaccgtcagccctttcatcaatttgggagcaaaacgcactagcacgccgcccaaactggctttgagtccttggcctttggattggcgttgcaggtaaaaacctaagtcatccaacttcactatgcctgccactaggccgtacacgccgatcgtcatgatgaccgcaatcaagctaaccaccagaatttgtgtgagcatcgagtgcccctgcacggtaccaagagcgatcacaataatttctgccgacagaataaaatcggtgcggatcgcgccaccaattttacgcttttcatactcggctaagctttctgtcgccaaactttccgtttctaaaccttcattgactatcgcggcagcacgctgttcagcattctgcttgggttctggatgcaaccatttttcgaggatcttctctgcgccttcaaaacagagaaacagaccgccgatcaacagtagaggcatgatcaaccaaggagcaatcgagctaataataagtgctgccggaaccaaaatgagcttattgcgaaacgagcctttggcgaccgcccataccaccggaatttcacgctctgccgcgacaccagagacttgctgcgcattgagcgctaagtcatcccccaatacacccgccgtcttttttgcggccattttggacatcaatgccacatcatccaacaccgtcgcaatatcatcaagcaaggtcagtaagcttgcgcctgccatggaaattctctctatttgattggtagaagcgtgacaaaatgtaacattaacgaacggctgaaggaaattcagcaatgagaatataaccacgccaaacgagatctaagccttgttaggtcttatctgaagagtgtggtagttgagtatattcatcgggcaacagatttaatgcctttttcaaagcggcaaaacattctggatcaatcgcggtatggaggttctcctccataatggcgagcgctttatcaataggcatagccgcgcgatagggacgctcagcactgagggcatcgaaaatatcggccgttgtgattatgcgagtcatcaaactgatttcatcgccgttgacaccccgaggataacccgtaccgtctaatttttcatggtgcgcgccggccatgcgcgccagtgttttaaaaggagatagcttgtacagaatttgctccgtatacgcggcatgagcttgaaccgctcgccattctgcttcgtctaacttacctggtttatccaaaatggcattgctgacaccaagcttaccaatatcatgcagcagtgccgcacgcctcagccaaatgcgatccgcatcagagatcgccaattgtcttgcaatcaaatcggtatacacagcaacacgctcgctatgaccagcggtatacgggcttttcgcgtccacaattttaccaaaagccgtcactatgcattccaagtaagcatcatccaaaggtaaatgggcctgagcgggaggtaaattcatgacccgctgactgatatcggtggctttcagtccggataaaaaacgaggattttcaacaagctgctcaacaacctcaaccagtttgggatcaaaccacacaccgctgcgtgccataatctcttgcagggcttcttcgatgctgtgctccatttgaaaaacatcaaatacctgagctaacaacgcaatacgtgagaaaagcggaatcgcttcaccttttcgctgttcgggtcgcccttgaccgttccaatgctcatccagtgaatggatgccttgtgcgacagcttcactaaaacgcaattctcgggcgacatccgcaccacgggtacaacgcgtctggatcagctcttgagcatagtcattgccatttttcaaaatatctatggtcgttaaaatgcgctccgtccagctttgctctgatcctgtgtttttcacaataaagttaatgacactggaaagactggtgcctaccgttttgtaacgtcgtttgaaagtcagatcatcggtcgcatacagctcacaaattcgtgctgcattgctgctgcaacccgcatctttcagtagcagagtaaaaaacaggtcgtgcagttcaggctcactcagctcaagctgcataccaatatgcataccgatccagcaacaacgaatgcagtgttcaggcggctgaccttctgtcatgtcgagcgctgtcgttagcgaaatcattaattctgaaagagggaaggtattttgtgcaacactcattatttgggttcatttaccattttctatgtatcgagtgtagacagagtcggcctgagctgccatgagttttatggtgagcatgcgctttttgcgcagcataagattccccagaaaataaaataattggcttagattgaaaataatcctagtcagaactctttttccgtgtatactcactcgcagctcaagcaaatgagctattaatgaaaattaagttaaagttttacctcagtcttttttcgatacccttcgttcaacctctgtgatagcttctcctttataatccatataatagcttttgttttaagccctaataaattattgtaaaaattatctctagaggtctctatgtctactaaaatgactggttctgtaaaatggttcaacgaaactaaaggtttcggttttcttactcaagacaacggtggcaacgatgtgtttgttcactttaattctattcagtcagaaggtttcaaaaccttagctgaaggtcaacgtgttagctttatcgttgaacaaggtaagaaaggccctcaagcgtctaacgtagtcgcactgtaagccaaattctgcgtggtgctcccagcgccacgctttgctccccgctcattatttaccactccttcattagcatttatctgtattacatcgaggaattcatgtctcgcagaacatctcgccagcgacactggtatcaattattacgagagaaatctcaccaaaaagaaattttaattcatgataaaaatccacttccatcttctgaaaaataatctccgctggtcatctaaaattcatcaattaaatagtgacattctacagcgccatatcctgccccgaataaactctaatcattaccctatttattttgatttttgcgaaatagagcaatcaggaaaaatattatctgattcgggtatcgaattgggccattttaatattcattaacgcgttgcccgtgtattccttttattaaacatttagacatccactctctctgaatattgattaagtactctgattgggcaaaatcgttccctacgctattgatccattattctattactctttccccggctacgctcatctacccccccttagctcaagcctgttgatacctcagagtctcgttgtgtcgcattaaaaactgcatttttcaaatactcaactacactcatattgctcaatccgagcaaaccataaggaaaatcaaaatggcgaatacaatgttaggtggctggggactgttccatgagctctccaatgaagataaagcagcatttgcaagcggcatcgaaggctttgtaggcgtaagctataagcctgttgcggtagcaacacaagtggttgctggctgcaactacgcctttttctgcaatgccgagatggtttaccccggctctcaaccttacccagccatggttcacatgtttaaagacttggaaggaaaagtcggcattacgcatattcagcgtttggattattaaaccaaacccactgtgggacagggctgttttctgtcgtccactcattttcatgttgaaagacctccgattggaggtctttttcagtcgtgatttttcaatcatggtaatcacacacattcatcgccaccccattcaaagcgaatgacattcctattgcgcctgcaggtgagagcctttactcttttttcatcttcaatctaaatcgagagaaatgatgtctgcctcatccccctacccgattggcactcccggtcagccttggcaagcttcagagcgccaagcttggcgagaacaacgccatattcaacgcgaatatcaacaagaagtagtgcccaagattctggccttgaacagcctattcgacgtgagtacttatggcgcgctctcttatgacccaacacgctacccgctgtatgtagtgaaaagccgccactggaatgctaacaagccgaccgtattgatcacaggcggggtacatggttacgaaaccagtggtgtacacggtgcgctgcaatttttagcgacagccgcagagccttatttggctcactttaatctgcttgccgcgccctgtgtcagcccttggggctatgaaaccatcaatcgctggaacccaaatgctatcgatcctaaccgctctttcgttcaggatagtcctgcagaagaagcggctctattgatggcgatggtggcagagcacgggccgattttgttgcatattgatctgcatgaaaccaccgatacagatgaatctgagtttcgtcctgccttggcggcgcgcgatggtaaagcctatctcgaaggttcgatccccgatggcttttacacggtaggtgatacggaaaatccgcaattggctttccaacaagcggtgattgattcggtacgccgtgtcacgcatatcgcgccagcggatgaaaaccatgaaatcattggttcacctgttgtcgctgagggtgtaatcctctatccgatgagagaactcggcttgtgcggcggcatgactgattgtacttacagcacaaccaccgaagtctatccagatagccctaaagtcaccgcacaactctgcaatgacgcgcaagtcgctgccatcatcggtgcacttgattatgtgcttgccaatgagcagagtctgctaggcgagtaatcggcttttatactgctccggggttaacccggagtactttttgaacatggtgataaacgggctggcttggttatagcccaaggttaacgccacctctttcaccgcatgcccttgacgtaacaattccatcgaatagagatagcgcacccgcagccgccattcggtaaagctcatccccagttcagcctgacaatggcgcgccagtgttcgctccgtggtatgcactttttccgcccactgctgcaaggttgtgttatcggtggggttctcttccacaaaagccaaaatcggcgctaaatatttatgattggttgaaggaagaaaatggtgctgagtttcacgtgtcgccaattgatcgagcaacacttgcactaagcgcttatcttcacagctctgcgccacattgatgtttcgctctcgaaagtcatcaatgatcgccgaaacaatcgatgtcaccttaattaaactggttttagcaggaaatgccgtggtcagttgcgaagcaatattcagtgaacagtattcgatgggcttgcggttgtagcttcgatggcgaatcccagctggaacccaaatcgccaaatgaggcggagccaaaaagcgcgtatcttccgcttccatctccaaaattccgccagaaatgagctgtacttgcccccaagggtggctgtgctcacgagtttctgtattggacagaaacgcttcaaaattcataaaaacatccgaaggtggatgctcgatagataatgagggatgcaagtgtcgagtgcgttttttcaatcttgtcttcctatcgctcgcaatgtctttttagagatagttgtaattataaagacctgccacactataacccaaggaacaaattgcgacgaggcgcacatgatctatcttctgccattttttactgtgctgatttggggtggcaactcgattgtcaataaactcgcggcctcgaccatcgaacctagtgcgatgagcttttatcgctggctattggctatggcgatcctcactcctttctgtctacctagcgctatccgccaatggtcaacggtgaaacgccacttgagtaaactcgcatttttggctttactcggcatggtgcttaaccaatccctcggctactacgcggggctcaccaccacggcgaccaatatgtcactcatcacttcttttgttcctttaatgagtgttttcatgagcttgccgttacttaacaaacccatctcagcccttagcgtggtgggtggcgtactgtcgctgagcgggcttgcctacatgctcggagaaggaaatccgctgtttttcctccatcaaagcgtgaccgaaggggatgccttaatggtgatggcagcactggtgtacgccttgtactgcgtgcttttgaaacgctggaaaatgccgtttagcaactggactttaatttatctgcaaggggtatgcgccgtattcatgctgatccctttatggctcaccagcgatacgctattaccgaccgaaggttcactctctctgatcgcttatgctggcattgctgcttccctattagcaccttggatgtgggtaaaagccattgatgcgattggcgcagactccaccgccatgtttatgaatctgctacccgttttttctgtttctttggccgccactttattgggcgaaaaagttcatccctaccatttgattggtggtctattagtcatcagcggtgtcgcgctgtcacaattgaaaattcaacgtcgaaacgatgacggcgtcgagaaagtgacgcaggtataaaagcgagtattttcacgcgcaaaatggttctcttcacgctatctttagagaagaaaaaacacgccgcgaggcgtttaaaaataacgattggctaggttccccaagcccgaagcaaccgatgaaaaattggctgtgtcaggcagtgagaggtgagcctatgatagaacttaatagaattgaagagctttttgataaccaacagttctccttgcacgaactcgtgttgaacgaactgggagtctatgtcttcgtcaaaaatcgccgcggcgagtatctctatgctaaccctctgactctaaagttgtttgaagcggatgcacaatcgttgtttggcaagaccgatcacgatttttttcatgatgatcaactcagtgatatcttggcggccgatcaacaggtgtttgaaactcgtctctcggttatccatgaagaacgagccatcgccaaatccaatggtttggttcggatttatcgcgcagtcaaacaccctatcttgcaccgagtgacaggcgaagtgattgggctgattggagtttcaaccgatatcaccgatatcgtggaactgcgtgagcagctatatcagctcgccaataccgattctttaactcagctgtgtaatcggcgtaaattgtgggccgattttcgcgccgccttcgctcgcgcaaaacgtttaagacagccgttaagttgcatctctatcgatattgataatttcaaactgatcaatgaccaatttggtcacgataaaggtgatgaagtcctgtgttttctcgccaaactatttcagagcgtcatctctgaccatcatttttgtggtcgtgtgggaggtgaagagttcatcatcgttttggaaaatacgcacgtagagacggcttttcatttggctgaacagatccgccaacgttttgcagagcatccgttctttgaacaaaacgagcacatctacctctgtgcgggggtttccagcttgcatcatggtgatcatgacattgccgatatttatcgacgctccgatcaagcactgtataaagccaagcgtaatggtcgtaaccgttgctgtatctatcgccaatccacagaataagcttcacctagcctctcttatcctatttcttttcgttttgtgaaaaatgataaaaacgaaaagaaaacgtaagaaaacgcaaaccaagatttgaaatcaggcactgactccgtacactgaaagcaatttaaaccataaggatattcccggtgaaagcagtaaagcgccatcaagaaatcattgaattggttcaagcccaaggttttgtgagtacggaagagctggttgagcgatttgatgttagcccacaaaccatacggcgagatctcaacgaattggccgaagccaataaattgcggcgcaaccatggcggcgcaacgattgccaccagttcggagaactcctcttatcacacgcggcaagtttcttaccaaaatgaaaaagagaaagtcgccatggccttggttcagcacattcctgacggtgccacactgtttattgatattggcactacgccagaagccatcgctcgcgctttaatggttaatcatcatcaactacgtgtggtgaccaacaacttaaacgtcgccactatgctaatgagtaagcctgatttcagcatcattttggcggggggagaagtccgtaataaagacggcggcgtaacaggcgaagccacattggattttatttcccaatttcgtttggattttggcattttggggatcagtggcatcgattatgacggctctctgcttgatttcgactaccatgaagtgcgcgtaaaacgcgcgattatcgaaaatagccgcagtgtcttcctcgcggtcgaccacagtaaatttggccgcaacgcgatggtcaaactcggcacattggccgatgtcgatttggtcattactgaccaaacgccaccgaaagagattgaagcgttcgccaaagagaatgaagtcacgattcaggtggtgtaattgctcatcaataccaagaaaaggcgctaacgcgccttttttgttgcatgcacaaaatgcacaaatgattgcctgtgtgtaaaaaatttgttgttattaactctatacttatttgagcaaaacgctcaaaacgaaaatgaaggataagccgatgagcagtggcaaacgagagatcacattacgttttctggcagagccgggagatgtcaattttggtggcaaagtgcatggtggcgcagtaatgaaatggattgaccttgcggcgtatgcttgtgctgcggcttggagtggtaaatattgcatcacggcttatgctggtggcattcgctttgtcgctccaattcatgtcggtaacttggttgaagtgaatgccaaggtgatttataccggaaaaacctccatgcacatcgcgattgatgtgcaggcgagcgatcctaagttcctgaaaaatcatctcacgactcattgcattgtgattatggtcgccgtggatgaagcgggcaaaccgtctcctgtgcccgaatggattccgcaaactcaggaagatcaggaattacgcgcttcggcgatccgcttaatgaacatgcgcaccgaaattggtgaagagatggaagcgcacgtgaaatatttgaaaaattaaggggctattctgcgctccaaccactgggatggagcgcttgtcatcgaattgtcatcaagctttgttttaatccatgcccatctttggcacatggatttcacgcttctgttatggcgattaccctagataaaatcaccctcaccgagacgaccctaactaaccccaaagcggtcgaatatcaatgggtaagaacattgtacgtgcaaggttatcagcctgaagcgatcaaccattacatccaaacctgttttggcggagacgagacatttgcagaccttttccgtcgggtcgccatgcatgaagagagcttgtatttactgctgcaatacttaagttgcgcaccttccagccgtgagttctaatttttctgcaccctctaaaccagttacaaatcaatattcgatctgactcgcatcctgttcttgtttcactgttgagaaaatgtgttgtgcttatactggcaaccgttttcgcaccgcgagctgtcacggcttcaggcataaaaaaacccgagctaagctcaggttttggttacaaaaactgttagtcgtgaactagtaaggaatagagctaacagccagctatgcgtaacgccagaattgaagcttcttaacttgtcggcggccaaaccaattaatgttaagaagagacaaaatgggcgactttacgtcgcccttatcgttattatcctttcacaccgccagcggtaagtcctccgacaagccaacgctgtgcaagtaaaaatacgatagtgattgggagtgctgagagcaccgcagcggccgcaaaatcaccccacagatagttttgagggtaaagatactgctgcataccaaccgcaagcgtgtacgagtttacatcagaaagcagcagtgacgccaccggaacttcgcccaccacaccaataaatgacaaaatgaatactactgcaagtataggcacagacaatggaagtagcactaatctgaacgcttgccatggtgtcgcaccatccaaggccgccgcttcttccagtgagcgatcgatggtttcaaagtaccccttaatagtccaaacgtgcagcgcaatcccgccgaggtaagagaaaatcaaaccgccgtgcgtatttaagcccaagaaaggaatgtactgcccaagcttatcaaacagagcatacaatgcgaccaaggccaataccgcagggaacatttggaaaatcatcatcgcttttaagatggtttctttgcctttaaaacgcatacgtgcaaaggcgtaagccgaagtagtagaaagcgccacaatcaataccgatgtaatgcccgccacttttaccgaattccacaaccatgtcatcaccgggaatggcggtggagtgactgaaccatcagcattctgtaccgcaataccgagtgccagcttccagtgttccaatgaggggcgatccgggatcaagctgccggttgcgaagttaccttcacgaaatgagatcgcgacaatcatcagcagcggaaaaataatcaacgctaagaacacccacagtgccgcgtgggttgcccacacgcgatacttgagagatttgccttgtaccatagccatatgaatgctccttattgttggctcagcttagtaaagcgcaggttgagcagcgctaacgcgcccaccagcaagaagatcagcgtcgcaatcgcactcgccaaaccaaagtcctgaccacctgtaccttcaaacgcaatgcggtaggtgtaactcaccaagaggtcggtgtaacccgcaggctcagaagtgccgatccggtttggcccaccttgcgtcaagagttgaatcattacgaagttgttgaagttaaaagcaaagctggcaatcagcaacggcgtcagcggtttgatcatcatcggcagagtgattttggtgaagttatgaatgaaatttgctccatcgatcgctgatgcttcatacagatcatcgggaatcgctttcagtaggcccatacataaaatcatcatgtaaggaaagcccagccaagtattgacgatcagcaccatggttttcgccaacagcggatccgagaaccaagcgggactgaggccaaacaaaccgttgagcaccatgttgatctcaccaaaactctggttgaacaggccacggaaaatcaaaatcgagataaaggcaggaacggcataaggcaagatcagcagtacacgataaaccgcacgacctttcaacgcttcccactgcactacgctggctaatacaaggccaatcatcagggtgaaaatcaccgtcagtactgaaaagatgaccgtccagataaagatattgataaacggctctttgatgccttcgtctttccatactcgctcaaagttatgggtaccaatcgacaccacaaatcctggtgagactcgctcaccgacaaattcgccgctctcattgataggttgataaaaaccaatctccatattggggcgcaacacctggccggattgattgttggtgagtgtttcaccatcatcctgcaaggtatagagtggtttcaccgcagcaaatttgcgcaggccactcattcgaatgtcttcaccatcagggaaatgcagatcgataccactcaattcggtgcgatacccgatgatggttttaatcggctctacttcaccgtcaatgccgccaatcacttcaagattaagatcggtcggtacgttaccactgagcgaaaaaggcgcggtcgccaaacgctcatctccgtcctcaatcaataagcggtagccttgctcggttttataaagttggaaggcataactttcaccactttggaaagtttgatccatcaacactgactgtgcgcgttcaagagtgagttggtttttcgcgctgtagtttgtaaaagcaagaccaacggtgtaagccagtggaaacagaataaagaggatcatccctgcaatgccgggataaatgtaacggtgcgcgtacgttttacgacttccgaagatatacagcgctaatgtggtaaggatcagggtcagcaatgcaaacgccacctccccacgagaatacataagaatggttgcgtagccattcacgatacctaccgcgccaagtactgcccattttaaaaatgcacgtttgtcggctggacgtaccgcagttggatcggacatagcctgtgtaccttgaactgactgcataaagaacctgctagcgtgttgttaccaagaaatgtggagggggaaagttaccccctccaaggtgtgacgatggattatttcgtcatctgcttttcagcatcagccagagcggcatccacggtttgacgaccatcaacgatgttgatgatggcgtttttcgcagagctccaaaacgcgttcatttgtggaatgttaggcataatttcgccgttcatggcgttatccatggtcgccgcaatgcgcgcatccgcatccagttcacgttggaaagagttcagcgcaaccgcacctagtggtttatcgttgtttaccatgcgcagaccatcgttagtcagcagatagttttcgatgaattccaccgccagatctttatttggagaagcggtgctgatgccggcggtgagaacgccaacgaaaggttttgacgcttgaccgttaaatttaggcaaagtggtcacaccgtagttgatgcctgatttctcgatgttgccccaagaccatggaccgttgatggtcatcgcggtattaccttggttaaaggcagactcagacactgagtaatccatatctggagagatcacgcctttatccacaaggcctttcacgaagttcatcgcgtcttttacgcctttattgttgatacctgcgtctttcacatcatagccatcaacaccgtatttgaatgcgtaaccgccatcagccgccatcaaaggccaagtgaagtaaggctctttcaggttccacatgatggccgatttgccttctttcttcagtttggcatccagctcagcgacttcttcccagcttttcggtgggttagggacaaggtctttgttataaatcagtgataacgattccaccgcaattggataaccaatgattttgccgttgtatttcactgcatcccatgcgaaatctacgatgccttcttgaatttttgcagaaggtttgatttcgactaataggccagcttccgcataaccgccaaaacggtcgtgagcccaaaacacaatgtcaggaccatcacctgttgctgcggtttgtgggaatttatcttgtagcgcatcaggatgagcgacagtaactttgattccggtgtcggcttcaaacttcttaccgacttccgccaaaccgttatagcctttatcaccattgatccaaatagtgagttgtccttcttcaatagcagcatgggcaccaaacgaaccaagagccaccagagtgctcagcgcgactgtgcttagggcatttttcatgttcatatccttttctttttgtgttgtagggctcaccaagaggttttgccgtatttcgccatttatgatcagaaaaaaacgcgtttaactcatcctcctaacccctacgccctcgatattatggcgtattttcgtgatctctatcgtttgatgtgagcgagccaaatcacaaaaaacaggattgatgtgatcctactcaacttatccaccctcaataatttgaactggatctaactacgccttagtgcccctcctccacctcctcctcacctactccccctacaaaaaagcggaagaggaggatgtacgatttacctctttcacagaaactagcctcatcccagagaggatggtaagagcctttccagtttacgtgttgtaactggttccaccgccaagtaggttgtcgatataaagtcatgtttgtggtgaaagcgttacgggagagacatggctttgtgtagggggaaacaacctacttttcgcggcagtcgggtgaacggcttcatagccggagcgttcaccctttcttttcttacccaataaggcggcgctgccaacgaaaccacttgatgtggttcaccttatccaattcctactgttattgcgtgcacaataattcatataatgagccgcgataacgattaaaaatcttgatcgaggacgagctagatggcgagtgtcacgttaaaaaatgtatgtaaagcgtacggcgatgtgctgatttcaaagaatgtcgacttagagattcaagaaggcgaatttgtggtgttcgtcggtccttcaggttgtggtaaatccacactgctgcgctgtattgcgggtttggaagacattacgtctggcgacttgtatatcggcgaacagcgcatgaatgatgtcgaaccgtccaaacgcggcgtaggcatggttttccagtcttacgcgctttacccgcacctcaatttgtacgacaacatgtcatttggccttaagctctccaaagccgataaaagcgagatcaaaaaacgcgttgaccatgcggcggaaattctgcaactgagccacctgctcgatcgtcaacccaaagcgctttctggcggtcaacgccagcgtgtagccattggccgtactctggtttcacagcccaacgtattcctgctggatgaaccgctatccaacctcgatgccgctttgcgcgtgcaaatgcgttcagaaattaccaaactgcaacgtaaactgggctgcaccatgatttacgttacccatgaccaagtggaagccatgaccatggcggacaaaattgtggtgttggatgcgggttttgtctcgcaagttggcaagccgctggagctgtaccactacccacaaaaccgctttgtggccgggtttattggctcgccgaaaatgaacttcatgagcgtcttcattgaaggggtagaaaaagatcgggtacaggtccagctttctaacggtacgaccttctggatccctgtcgatggcaccactgtcactcgtggagaacgcatgtcactcggcattcgtcctgaacatttggtcgaagcagagcatggcgatgccaaaattgaaggcaaagtaatgatcgttgagaaactgggtaacgaaacccaagtgtatatgaacctgaagggttcagactcagatgtgatctaccgccagccagacacactcgatgtcgaaaccggtgacacgctcaccattggtattcccgcacatcgctgccatctattccacagtgatggccgtgcttgccgccgtttacataaagaaaaaggcgttgatcttcccgcataaccacttcacctttgcttgctatgccctctcatcttgagagggctttttataaccatcatccatgcttcttatgttctctgcttcgacattcatcgaatcggttcaacccactcattttgcaataaattgatgttataccccttgtgaataagccctctcttcctctatggtctaagaagaccaaccgagtcgagagactcacagcatcctttaggtaagaatatgaacagtcagttaacgcttagagcattagaacgcggcgacttacgctttattcacaatctcaataacaaccgcaacattatgtcctactggtttgaagagccttatgaatcctttgatgaactcgaagagctctacaacaaacacattcacgataatgctgaacgacgttttgtggttgaagatgcacaaaaaaacttgattggcctcgtcgagctgattgagattaactacatccatcgcagcgcggaatttcaaatcatcatcgctccagagcatcaaggcaaaggctttgcgcgtaccttaatcaaccgagctttagattactccttcactattctcaatctgcataagatttatttacacgttgccgtcgagaaccctaaagcggtgcatctctacgaagagtgcggatttgtagaggaaggccacttagtcgaggaatttttcatcaacggtcgttaccaagatgttaagaggatgtatatactgcaaagtaagtacttaaatagaagcgagtaaagacatggttagctgcagtcaatacgattacattgaactggcctgtttgtttcatctgccagtcaaattaacaatgaaaagtggtgaggtgtattacggagtcgccgccgacactcaacgtaatagtcaaaagcaggagtgcattgcgctaagaggcgaagaagaaacttggctcctcgaaactgatcaactgagttcgatggaagccttaagcgaacaaccccatttctctgttattcatttcaaataaaccacgctgaagacaacaaggccgctctagaatgacgagcggccttgcgttttacatttcagccaactgacgcgccacttgatgctatacacaaactacttggagttgtaggtgggaaggcgctctttgagaatgcgttagtttgcaatatccagcttattaccgctcacgccattggttcgaaaccagcccgcgatactgacgcggtccgcatgcgcttcgagcacttcatgagggaatcgttccgaaagaaataccaccagacgtcccgcaacgggcgctaacgtttcaatccagttatcctgcaaatcgtagatttttaattcgccgccatcggcaggagtccaattttcattgagataaaacaccgtggttaatttgcggttttcattaccgcgaaacgagtcgagatgtttaaggtagaaatcaccggcctcgtattttgcaaagtgcgcttcatattcaaacagcccaagaaaaaagtggcggttcacttcacaccggatctgctccatccgctccaaatagtcttgaacaggttgccccattgatagatcaagccattggattttatcgctccggatatccgcagcacgctgaatctcttcgtttctaccaatttttgctcgtttccaacgttcaggaatgcactctcgtagagcttgcacttcttgtgggttcaaaaaatcatcccacacataccaacctcggtctgcaattgcatccattaatccatctaacgccatgattctcactacacgaacaataagaagcgcgttatatctggcctaccaccagtcagcaattcgagttattaatctccaagatcaataattctgatggagggattgtgactcaaatgattcaagcctatcacgcaaagagattgagacaataagggaacttcgccgccattgtgtaatccaatctgaacatcaaaaacatcccttgaggaaatcccatgattgtgacaacgacacccaatatcgaaggtaaacgcatcgtccgttactgcggagtgattgcaggcgaagccattcttggtgctaacatttttaaagatctgtttgctgggatccgcgatattgtgggtggacgctctggcacttatgaacgagagctagaaaaagcgcgcgccatcgcattggaagaactacaacaacacgctgtggcactgggtgccaatgccgtagtcggtatcgatttagattatgaaacgtttggaaaagccaatggcatgctcatggtgtcggtcagcggtactgcggttgtcgtcgaatagttaacccgtatgcctaaccgactgatgtttcaggtactcagaaggtaatttcatcttaataaatctagagagatttgaaaggttaaaataaggcagtgtggaactgccttattggggcgaattttagcctattgaactaaaactcgaagagacattacacaacgaattaagaattgacttcctcaattccaatattatttttcgcccaaatcagtgcctgcaagcgatttttggcattaattttcttaaagacattatgcagatgtgtttttactgtattttcactcacaaagagtttatctgcaatttcaatattagaagcaccactaccaagtaacttgataatctgttgttctcttttggttaattttgcgtacatttgtgaggtcacgactgagttaccggcacgataatggagaatgtattcttgggccagtttacgcgttaaccacatttcatcttgcaaaattttactcatgcctttgatcagggtatccatatcatcatcaatataaaatactccagccaaattattccacttaaagagcagcttatgctcaatatcctgcggacagtttatgatgacctctttcgcatcaggacaactgatgtgcttaaacgagctgtaatcggtcaaaacatcatcagaaattctagaataatcaatcaccagcatctgaatactgcgactttctggtttattctcttcaagccagagctcagaaaatggtgtaatttccagcgccaaaggaagttttgattctaacgcctctttcaacaatctggattgcatgcaaacatcagaaagcattctaacgtttagtttgttttcatctttcatttcacccctcctaacacatcaaggctaacatggttaaaactaacgttaagaagagggaagtcaatgttcagaaaataagacaaacgtttaatcaagcggaatctgaaatttaatctgtacaattcataaggttaagaaaccttctcaatattaagaatatcaatagctgtaaaattattttttaacacatataagccaagttgcttaataaaaagccaatttatacgcaaaaagactcttatacatttaatattcgccataaaataagttgaaacacttaccactcaatttattcatagcgtatcaaacttaaaacaataactcatgaaaataaccaatgagttaacaaaaagcattcatattttagatgttttctatgcgggatattgagaaatttcaatgaaaaaaatcagcatcgtcatacaacctataactcaaacggtttgactttgctggtaaacggaaataagtgaatcaccaacgcatagaagagctcgatatgtgtttgcacacatttgcggtcaacaccactacagcgtcaagtaaacaaaagatagcgcaatgaatcagaaaaaggctaagtgcgataaagcactttaaccacatgccaaccaaatttggttttgaccaattgtggggttagcacttcaccttgaaagcaggctttgtcgaaagcaggaaccatttggccttgacgaaattcacccaagtcgccgccttttttgcctgatgggcaagtcgaatacttcttggcgagtacgtgaaacttcgcccctttcttgagttgagccaagatatcatcggcttgctctttgtgtttcaccaaaatatgcaaagctgctgcagtgcgagccataatgtttcccctattttgtcgagccgcgtagtgtactcgatcaacaataaatgtaaacgcatggctgagatcaatacaaaacggtcgaatatcgactaaattcaagccattccgttgccgatacggtaatttcgtttagtataagtaagagtccgaactgttaaagaaaatattatggctaaagtcgtcagtaaagcgaaccaatcacaaggaatgttgatgttcacgctcagtgcccagcagcaacttttcgctatcgggacactgaaagtccgggaaattgtgacttatcaaccaatgactcagatcccctattcacatcatcatgtgataggaacggttactattcgtaatcttacagtgccagtgattgatatggccgcagcgattggctttcgtccaatccaaccgagcgagtatcagaagtgctatttgatcgtcacagactgcttacgcacggttgtggctttcatggttcgcactatagagaaaatcatcgagtgtgattggcgacaaatcgaatcgtcccccgagacggcaggacatgatgttttcgtcaccgggatcacccgattccagaacaaaattgtgcagttgctagacgtggagttactgctctctaaaatctacccacaatatgaatcgaccaaagtccctatgttgacggatatcgagcgtgagcgcttaaaacccctcaatattttgttggtcgatgactcttcgattgcgcgtaaacagctctctgatgcgctggatagcatcaacattccgtatcatatctgtaaaaatggcagtgaggcgttggatttgatgcgtgatatggcacgcgatcaccgcgccatcgacattttagtgagtgatattgaaatgccgggattagatggttatgagctggcatttgaaatgcaaaacgatccgcagttaaaccatgcttattgtattttgcacacttcgctctccagtgaaatctgtgtcgatcgtgcccatcaagtgggcgctcacgaagcgttggagaaatttaacgccaccgagttagtcgaagccatgttgcgtggagccaaaaagcttcagacgcagcgtttgcaaaaatcgtgatcggttaagtatttaactcaaagccaatcgcaagactatttgctgtaacaaacaaaacatgaattctcggcagccctagcgctgccgagaattcagcaaatcaggtatacaccatagttgctcatgatgactcagccactcttgtaattgtgtcgataacgtctcttgctccacctcggaaaacttggcgagcaaactcgactgtaaatcacaatactctggtaaccagagttcgatgcgttgtcgccctgcttctgtcagtgtcacctcaacgttacgcctgtcatacctactgaggtttctctctacaagtcctttgcgttcaagccgcgttaaacggttagtcatagcccctgagctgagcaataaccgcacttgcaagtccgaagggtttaggcaataaggatgaccgacaccacgcaaggtcattaacacttcaaactctccagcggtcagtcccgcttgttgatagaaggcctccatttttaactcaatacgtctcgccaaccgttgtagccgatgaagtaccgacatgggcagagtatttagctcaggcagctcatttgcccattccatgacggatttttgcactgaatccatgcgttttatcctgtgttgttccctttattccttgacgttagcacttcaacgaggatgaggaaaatggctcgcattgagtagcctctctagcaagaacaaatttgcagcgtttctacagtaaatccgctaatcttaaggttatgaaaatgtcttgcgtatccgaaacaagtgatgacaactgaagatttcaaaaaatccacggctaacttaaaaaaagtcgtacctttaatgatgaaacatcatgtcgcggccacccccgtgaactatgccttgtggtatacctacgtcgaccaagccattccgcaactgaatgcggaaatggactctgtattgaaaaattttgggctttgcccacccgcttctggtgaacatctttaccaacaatacattgcgaccaaagcagaaaccaatattaatcagttacgtgcgaatgttgaggtacttcttggtgaaattagcagttcaatgagtgatacgctcagtgacaccagttcctttgctaatgtgattgataaaagctttaaggatttagagcgcgtcgagcaagacaatctctcgattgaagaagtaatgacggtgatccgccgcttggtgagtgactctaaagatattcgacactcaaccaatttcctaaataatcaactgaacgcggcaacactagaaatctctcgtcttaaagagcagctggcgaaagttcagaaagatgctctgtttgacagtttatctggactctataaccgccgagcttttgatggcgatatgttcacgctgatccatgcaggtcaacaagtcagcctgatcatgctcgacatcgaccacttcaaagcccttaatgataactatggccacctgtttggtgaccaaattatccgtgcgatcgccaaacgtcttcaaagcctatgccgtgacggcgtgacagcttatcgttatggcggtgaagagtttgcactgattgctccgcacaaatcgctgcgtattgcacgccagtttgctgaatcggtgcgacgttcaatagaaaagctcaccgtaaaagatcggcgtagcggtcaatcggtcggtagcattaccgcttcgtttggtgtagtagaaaagattgaaggtgactctttggagtctcttatcggtcgagcggatggattgctgtatgaagcgaaaaatctgggccgcaatcgagtcatgccgctctaaactctgctatacgtacccacacgttgtaaatcgacggcacgggaaaagttacacagctccaaattgccacaaaaaagccaagaattactgactcttggctttttcatacgatggcggattaatgtgaaaaacagtctccgaggaaatattcgtcaccatttcgagctgtatactctttctcttcaatacgagcttgtggtcgaccttgttcatcgcctttgatcaaacttacccagtggcgaatagtggtgcttggctgtgcgtggtcattagaatgattgagtactgtgcacgtttctaattgaatgtctgcgatttctcgtaactcaatgcaacccgtgccgcgctggcaacctaatgtcatttcaacatgactaccttgcccatcacgaaacagaagatggcttggattttctttactgccattaaacgccacaaactgttttgggtatttcaagccactatgacgtccatcttgaaagtaagcgagcagatggttgtaatctatcacgtatgcggtcacatcttggtgagtaccattttcaagcggaaacagacgatccaataactgtttggctttggtttgtttttcacgctgttgattggcggcgaccgtttctacggcgaacacagcttcagcgataaagggtttgttttggtgttggatttctgttttatcaaacgtcagcatgttcatcgtcgttccctcgtccagattcaatgtcattttgctgcaaagacactggcgatattttcgccggatttgtgacttcgcttacttggaagactagcggatttttgactacaatttcacaacaaaaattttacaatgtgaattttacaaaatgagtgtgtctaaaagtcttgttcgacagtcccattttctgggcactaaagtcagaaaccttcggaaaaggaaccacttaaccatggaggatctttctgcgcgctgcattcgtgttagccctgaatacgcaccatcggtttcttatctctctatgattgagcgcggaaaacgagtaccgagcgttgagatgctggaagtgatcgcggaagtgtttcaaaaagatcccatctggtttttagatgatgagccagagcaaattgatatcactcccgaaaaaggcaatcgtggtggcattagtggaatggctcttgagcccagttttttgttttccaatgatattttacaaatcgctattcccgagatgctctcgcaaactgggatcactggccgccaatttgctcatctcttgatccgagcccatcaagaaagtctgcaaaatcatttcccagatcttgaacgcgctgcagaagaggtggggctaaaacgccttaatttatctgtcaccgatttgctggacattgccaaagggcttggattggacgtgcgttgggtaaagcgtacgccgcatgatgtaacagacgaacttggggtgagtgccaaacagctcgttacctctttttttgagccgccaggccgcatttacctaaatgagatcctgcgtgaatacccaacgcgattgaaatatgaccttgcggtttatatcggacataatgtgctgcacaacaaagatggcctaaaaagtgtcctctccgtcggccacactcaagggtgggatgagatggtggaaacctccccctcttcagagctgaattcacaagatatcttgcaagcttggcgagattttgaatccagcttttttgctggggcactgctgtgccctaaggtgcccttccggcaactgctcgatcgtaacggatatgaaatcagcgttcatcagaaagcgggagtctcaccttctgtcgccatgcggcggatgaccgtcgtttcgccctatccccactggcactattttgatgcctatggtgaagggaaactcaaggccgtataccgtggaaatggtatcccacttccttggggaaatatgcgtaaagtgaatgatccttgtcagcattgggccgtttttcgtcgtctttcacaaccacagcaaggcagttcagcccaaatttcgattttaactgtgggcgacgagcctcgaatttactgttgtgaatcactcaatgttgtggatcctgccggcaacaaccgtgtcttgtgtgcgggcatcgacctcaatcctgcgattaatgcacaaggtggggacgctctcgccattgctcaagagctcaaaatgagttgtgtgcagaaaggaggaactaccgcgattccagcgccgattaaacgtgatttgcgcactatcgccaaaattctcaacatcaactgggttgaacgaggtatcgagaatgaagcgagattaatttgctcacgcggtgcggtttgtccacgaaagccaagatgctatggcgaatgtggtgaataaaaaaaaggccaaccacaagaagtgtgattggccgtctataagtgtgaacaatggtgttcactaacaacgtcagttggctaggtgaccctcggcttagaagggtcaatctaataaatgcagattacgtgccaacttttcattagcgacttttgcatgaaaatcgggcaaaaaacgaacagtttcattacaaccacactcataaacgaatgacgaaatgcgatttctattgcaaattgcaaaatcaaaatttgcaaaatgcaaaggcgagcgtggtaaagatcaaaagcgatagagtgggttttgcctacgcttagcggtatacatacgttcatcggccagtttgaacatttcatcaggtgtggcaaacgactggtcatacaaagcatatccgatacttacacgaacatggataagcttgtcgtcataaacgatgggcgtttcagaaatcctttttaaaatattgtcactgactttaagcacgtcttgttcacgatgaattcgtggaattaacacgagaaactcatcccccccaatccgcgccaccagatcggaaacccgcaggctcgatttaattctttccgcacaagccaccagcactttatcgcctgcgctatgtccatgggaatcgttgatagatttaaaacggtcaatatcaatgttcaacaaagcaaagttaccttcgctatgagagcgcttagcattttcaaagtagtgttcaatggtatagataaaatagcgccgattcggcaagtgggttaaagggtcatgtagcgcacgctcctccgcgacttgataaaggcgcatgataacgccaaagcctgccatcaataccaataacaccgagtatcccaacaagcgcactgcatttcgggtataccaagataactgctgtagtaaatcttgcttttcagcgaccgcaattcgccaacttccgtaagggaaatagacattctcttgtgcaaaagcgtgctcaaatactcgaggctctccaaaaaacacgtccccctcactgccacggctgtctaaaccacgaatcgcaacctgaaaatgctccccaaagctgtaaatactggttgctgaaagcaatgaatcccaatccatcaccacactcagtaccccccaataacgcgtatccttcggtgggtcgtagaatatcggttctcgaatcaccagcgcgcgcccaccttgaacgagatcgacaggtccagagacgaacgtctgtttgatttcacgtgctttttttattgactgccactgctgaggaacggtgcggtaatccaaaccgagtagtgcattggtttgaggaagcggatagctgaaagcgaccacatcattaggggcgatacctaatgagcgtaagtgatcgctattcctgatcaccgccgctgaaagcggctcccattgatagatattgaggtcgggatctagggttaacagggttgttaaaccttttacggtatagatatcacccaaaatctcagcttctaattgaaaacgtacgatggaaagatcttctttagcttgttgacgtaaaccctcttgtagatcacgtgtatggctaatatgaagggattcaataaccgcaatgcccaaaaagagtaaggcgagaaaataaattgagacatacttatatttgtgcgaggttaaccccatccctcaatcctcagttttattattgtttgttgattactgagtgaaccacacagatccattcgcaagcgtactatacccaaacaacttggcgttgcaggtaggcggaaagtcagttcatctccctgagcatagataaactatgtgattgaggtcaacgaacgtagtcaacaccgctgcagcttcaagtaggaagggcatacaacttatcgctactcaaacacggcctgctttacagtagcgaagaagataagccatccaaatatcacgacgagcttatttaatagattaacgcaaatgtacaataaagaaactaactgattataaatttgtaaatataactcatgatgaaaaaactgtttttggatactcattccgcttctggcgagataaagttaactgatggtttactctactggtttccgcaatttctcaccccgattcaagccgaccaagcttttcagcaaatgctcacacacttggattggcagcagaaaagtattcgtctatttggtaaaagcgtgcttcaaccgcgacttatcgcttggtatggagaaaaaggctaccgttattcaggtctctctttatctgctcaacccttcccgccaccgttgcttactttaaagacgcagtgcgaacaggccgcacaagccccctttaattctgtactcgcgaatctttatcgcgatgggcaagactcgatgggctggcatcaagacaatgagccagaattaggctctaatccggtaattgcctccctctctttaggagagagtcgccgatttctgttgcgccatcacaaggatcatgcgttgcaagtcgaatgcgaattgaatcatggggatttgctgattatggcagggaacactcagcacttctggcaacacgctatccctaaaactcgtcaaaccaagcaaacacggattaatcttactttccgtaatattctttaatacccaaactacttggcgttgcagataggctgagtttattctcatgagcataggtaaactaggtgattgggatgaacgaacctagccaacaccgcggcagcttcaagtaggaaggggatagtaattcaaagtgttgatgccgtatcgcttacgttgtcgataaatgagacgtgttgacacaaactcggattattgacataccactaaccagagcctcacatcgacccagctccgctgcgctagagttttttggtctaaaaatgcgcaaatttgatcggatactgtcatgatgaacaaaactcaaatagcggttgtctctagccttatcacggcactgattcttcccacttttacgagctacgcacaaactcatcctttggaggtaccgcccaaagcccaaaatcgcgcacagaattctctcgaacacttaggccacgacatagcgccatcaccaagcgtagtcgcccccgtttcgtttcaagcaaccgctaacctcattaaacaaacttatgaaagccaactgtttacactgcccggctttaaagaaggtcactatgcactgcgtatgtatcgccaaaccttagatgataaatacgcggcggcgattggtagtgatttatcacgagtcgccagcggtttgaactactttgccgctgaagtgaacacgcctgagcaaattcaacgttacgctcagaagcgtctaaaacgctatcaacacagtgatgacgagcgcactcaacgccgtttcgccgcgacgcaaacgatgccggagtatctctatctcgggatcgatttgctcggcccaatggctcgcgccaacgaatatgggctgcaacataaggaagacgccaagctgcgccaagttttacgtcggtatgacttcacaccctacgccacagacagagcgatgattgaagcttgggcagcacaattagccaatcaggtgtattggttacgtcaactcggtgaacaagacgtggttgagccttttatccaagcctttcgtgatacctatccagatcagcgtgattgtgagctgaatgaccaacaatacggcaataaactgtatggtatgacgcatattatctttgcggactcagaatactaccaacatccggtgagtcagcagcaacatcagtggatttacgactatttccgcgccaacatagacactattttgctgcgcgctaagccagacattgtggccgaagtcggcattgccttcctactcgcagggctagaagatgatcctgtggtactcaaaacccgccagtttattcaagcggccgtcgataaagagcaaggaatgatcccttccacttctggtgatttcaatttatccctcggtgagcaccgtaatgtgttggccattatgctgcttgattggcgttcggtaaacccagccccgctggcaggtaagcactccaaagtctttgctgatctgccttatggcttaatcaaaaaagcacccaatccattaaaaggccaaggatgaaataagcctcgaccagtcatattactaagcggattttaatctggtttttcgctcagttaagcgaggtagaatcccattaatcacagtggtgactatgatcactgccagcccgacttgctgggcgagcgtgtagtcgacatcaaaaaacagcacttgccatagggcgctgaacagcagattcgtaaagataagtggagccagttgcgagcccgatttcgctaagcgataagcttttgcgcgaaatacttgcgtattgacgacgaggatggcgctgagcaataaagccgcgaatgtcacagctcctgagatatcccaactcatccctaaacttgccccaacatcgctactccaaggcaccaacaataacaatgggctgagtaataacgctgcgaccaaaaatgtccagccatgaatttctatcgagcgcatgtcactttgcgctgcacgatacaaacttaactgcgaacccgcattaaataaacctgcgctcagacctgcaagcaattctggtcgccactcaattgagcccgtattacctgccagcataaccactccaacgaagataatgcacacactcagcaccgtgcgccaagccaattgaccaccccataaccacttttccaataaaggaatgaagagtggaccagtactgaatagcacgacgctttccaccagcgaaagggattgcaatgcatagataaaacagagctgactgcccgcaatacaaacggcacggatcaacaaagaaaaccacatgtttctctgcggccaacgaaagtgggtcaacttcattgcaaccagtaaaaatagcgccggaataataaaacgtaaaaatcccaatagggtgatggggataatgtgcgacaaatattgagtcagtaaaccggttaacgacaaactaaaggtagataacaacataaataacactggtaaaacatggtttggcatacaactctccttacattgccgccaattgtaagcagatgaccggataaaaaataacgagtaatattgaccaaacctgttagagatacttacagatcactttatgcgtaaattggcccccttaaaatctctctactcttttgtcgctgtggcagaaacaggcagcatgacacttgcagcagatgcactcaacgtcagtcactcggccatcagccaagcgataaagtcattggaattacaactcggtcagcccctttttcatcgagtaggtcgtcaagttgtccttaatagtgcaggcaaacgctattaccaaaaagtagcgcccgctctggagcaaattgtcgaagcgacggaatctttactcaaacccatgcactccaatcgtatcaccttgaatatgatcaactcgttggctcttcactggtggattccacgcttcagcagttttcaagcctttgcgccagatgttgatgtacgcatttcaaccttaaccggtgctttttctttggaggagcaaggcgtcgatgttgctttaatccacggtcaatggcgcgaatggcaagactactattgtgagcaattagccgatgatgagctggtaatggtcatcagccaaaacatgatttcggcgaacatgcctctcaagcaagcattagctcaatttccagcgatttttgtcaataatccaaggcggcaaaccgattgggatatttggtgtcaagccaatcaagtcacgccaccgccacaacagcgcaatctttctttttcggcatcagcgcaagcgctgcaagccacattgagtggtttaggcgtctttgtcacccacaaactgtttattaaacaagaattggagagtgggattttaaaagaaattggtcagcccgtgactcatcccgatcagggatactatttcgcttgccgacctgaagcattgcgttctgaagcggtattgacactaagaagttggttacgtaatgaattccaaaaaaatcaaaacagacaaaagtagtagattatttttatgtaatttggacaagcatcattatattaaatgaagaatgtagagttgcatatcaaaaagatgaataaaatcacactatttcgttatttttcgccttcaaacaagccaatatcatctaaactttagctaactttaccgaatggatcgaatttggatggatagctttgctggcaaccaattaaaagagatgacagagatgcgttttgctcgtaagcagcatattgtcctgatcagctctggtgttgctaccgctatttttcttgggtttgccctttactactattttaaccatcaacccctgtcatccggtttattgttattaagcggtattgtcaccttattgaatatgatttcgctgaatcgtcaccgcgaattacacactcaagccgatttaattctgtcattaattctgctcacttatgcgctggccttagtcagcaatgctcagcatgaattatcgcatctcttatggttatatccgctcatcaccactttagtcatgattaacccttttcggttaggcttggtttacagtgcagcgatatgcttagcgatgaccgcctctatcctttttaatccggcacaaactggctcgtaccctattgcacagacctattttttagtaagtctatttacgctgacgattatctgtaataccgcttctttctttttctcaaaagcgatcaattatattcataccctataccaagaaggtattgaagagttggcttatcttgatccgttaacgggcttagccaatcgttggagctttgaaacttgggccacagaaaagctcaaagaacaacagagttcgaataccattaccgcgcttgtttttctggatattgataatttcaaacgcattaatgacagttacggccatgatgttggcgatcaggtgttaaaacattttgcacaccgtctacgcaataatattcgtaataaagatcgagccaccaatcaacatgattattccattgctcgatttgctggtgatgagtttgtgctcttgttatatggtgtgcgaaatttgcgtgatctcgataatattctcaaccgtatctgtaatctcttcgtcgaccgctatcctgagacggatatgctcaacaacctcacggtgagtataggggcagctatttatcccaaagatgcgatcactctgccggaactaacccgctgcgcagataaagccatgtatgccgctaaacacggtggaaaaaatcagtaccgctattaccatgatgccgctttccctccggctgtagaaaccgtattaggcagtcagcccgttgaggctcctaacgtaactccactgaaaaaagcgcactaagctcatccaaacatgtacatcagccataaacatactgcgccaaagacggccatccaggctgcatagcgagcggtgttaggcttatcaggcttaggtttaaccacctgtttcaacgccgtccgtttagcgtattgcataaagctaggatcagcctcgcgtatttcttcacgcttatgctgggcagaattcgccgcctgcgtgaaacgctgcaactgctctttggtcagatctttgcttggatcgtaattcggatatcgatcgttatgtttgggcaaaatagccatggcaatccctcccattcatgcgttgtccttcgtcttgagtgtaacggctaatcttaggctgacccgcaccatcactccccaatcattcaaatttctcgaatatgaagctcaacttcccctgctgctcattcatctctggcttatctacaatttccctcatcatcgctcagtctgcaatggagaagtcttatgactaaagaccgcgaaattcgccaaacagttcccgcacaacccacctcagatggtgatggtgtcaaaattcagcgtattgcaggatttcaacgccccaatttctcgccgtttttgatgctcgatgaactcaaagccgattctcaagccgactacatcggtggttttccacctcatccgcatcgcggtattgaaaccttgacttatatgctgcaagggcattttcagcaccgagatcagatgggaaatgtgggcgaattacgatccggcggcgcgcaatggatggcagcaggacatggcgtgatccacagtgaaatgccgattatgcaagaagggcaattgcacggcttccaaatctggattaaccagccggctcgcaacaagatgtcgcctgcgaaatatcaagatttccagcctgaaagtattgttgaacgccatcatccacaacaaggtttactgcgtgtgattgcgggttccgtcgaggtagaggatcaaacgataacaggcccattaaccgatactggtgtgcctgccaccgttgtcgattggcgagcagaagcggggcaagacatcagcatcaacacaccgcctcactttaatgccatgttgtacgtctatcgtgggagcctgaacgttgggaaacagtcggtcaaaacaggacacatggccatgctgacagccggagaacagctcaccctgcgtgcagagcaaccttgcggcagcttgcttttaatggggcaacccatcgatgaacccgttgtgcattatggaccattcgtgatgaacagcatggctgagattgagcaagcgatccgcgattacaatgcagggcattttgagacctactgatgtttcatacccaaacgacttggcgttgcaggtaggccgcaagtcagtgacaaagttgtctggaaccaatatgtacagccatcgactggcctttggtgagagtatgccacacctgtaaaggtgtggcttttttcaacttaagcaggcaaaaattcacacagataagcggtcgcgacttccacttgcagatcaaaagaggaattacccgccacttcaaacgcttcacctgcagtaaaggtaacccagtcagcatcggtgacacgcttaatagtcagcgcacctttgactaccgtcatgcgctctggtgcaccagtaccgaaagtgtattggccaggagccatcacaccaaccgtactctctccatcttgctggctgaagccaagtgactttacgttgccatcaaaatacacgttttccttgatcattttttcttcctgtctgtcatcaatcactacagtcgtttgactgcaaaattcaagcgagagttgtaacccatcacttcactttgtacaagtgccagcaatacgccttttgctaggaggtatatactcataacaagggtgagagcattgactcagtatcggatatgaaacattcctcacgaagcactcattttatttgaggataaaatcacgcttttaccgtatgctttttgcggttagaggtcgcttagcacaagctaggcagcggcataaaccaaggcacgatgccttgtcgccaaatccaacattttgggttatccgatgcccttaacgccatgaactatacccaaacgacttggagttgcaggtaggcggcaagtcagtgaatccccatgagcataggcaaactatgtgattggagtgaacgaacgcagccaacaccgctgcaacttcaagtaggaagggtatcaagttctacactgagcgttgggtgattatttgtttgccataaaccgttgtttgtcataaaccaagtgagaaaatgtcaaaagagctggtctttaaatctgtattctggtcatcactctctattctcggggtggcatttgctatgctgctctacgtgagttatcaagactacgtgaatcctaaacacgttttcggttcttggattgaaatcggtgcaccgaattaccaaaccgaagtgctgcgttttaatgaacaaggtgtctatcgcaatgatcgcttgatcagtaccaactttgaatttgacggagctgccatcaccattcgtactggcaatggcatcttcgtttacgagctctcaggtacctttaactcgccacaattgaaacgaactcaaccgatcaaccctgtgcagcgttttattcgccaagggtttgaacatactgtcagtgatcagggaaataacgccgcgcagcttagacgctcggcgttatccgaacacttcaacgaaaaatagcctcccgtttaacactccgttgcacgagataatctctctttctcccccatttcttgctctcgctgcgccaagtagtacaaacccatcatggctaagcacaaaacaaaacagagcccgtataaccactgtgcgttgagatattcgatcatcatacctccagccagtggagcaatcgcaaaacctaacgaataaagcgctgccgcaccaaaataagagcctcgtaaatgagcgggggctaaacggtcaatctgcacatttagcgtcggaaatgcgatcacctcccccatactcaagacaaaacaagccaaataccaacctaatggaaaagcttcaggggtgaacataaaaccgacttgcgcaagccccatcaaagccattcccaagcgcgtacgtgtaaacaacggcacgctttccaacagtttcaatgtcggaaactggaataaaataatggtcatggtattgaccaatactaacccggccaccaactgagccgcatccgcaatcccagagcgaacaatcacttgcggcaatgaggactcaacctgaccataaacaaacatcatcaggaagttagccagcatcattttaacgaacacattgtctttactgatcacacgtaaagtggcagaaaaattggggagaagtgagcgatctggttgttggaaacgtcctttacgctccaaagtggcgagcaaccataaaccaaacagaaaatacgctatgcccgtgacgataaacagcacttgcggatgagcaagcgcaagggtaattcctattaatgggccaatggctcccccaaggttaagcagaaaataacggacattgagcgccaattcacgatctttttcatcgggtaagttatccccaatcaccgctttgccgggcgcttcaatcatagggcgcattaatccagttaaaacgatcatgatgaaaaattgccagatttgatttgaaagcccgatgccagtgtaagcaaacgtcgcgatcagggtaccgctgaccatcacccatttgcggccaaacttatcagaaagataccctgaatagagccccgttaacgagccgaccagtgccgatgttgccaacatggcccccacttctgtcgctgtcgcgtgataatcttgatacagaaacacgactaaaaatggccaagccataaaaaagctggtgcgcgcaaataaagtgccaataagtactgtccagacaggaaaattgaatcgacccaccctttcccactgaaataaactctcactactttctatgcctttttccttacttttccccatattttcccttcccttaagtcctgacattgttgggcgctggacatcacactttgtttgttatttcttcaatataaagagaaaaaatgggcaaagatagcggaatttcacaaagcaataagaacagaaataaatatcacaatgacttaattaatctcttcctaaacagacagttatcaattctgaagaaaaagaaaaaagccgcaggaacagtattatcctacggctttttcatcgtttattcagcgtttaacacttgattgtatgtggatcgctaaattttcgtttttctttacagcttgaagaaagagagctgcgctttttgcttctccgcaaggtgcgaaagctcattgctggcgctagcactctgactgatacccgtcacgttctgatgtacgagagtcgacatgttcgatacgttacgattgatgtcctgcgtcacgtgagattgctgctccgccgcggtggcaacttgggcattcgaatcattaatatccgagaccgattctgtaatgccgattaaggcgtcattggctttggccgtcagcgctttattttgagtcaacatatccaagcttgtttgcatgctgtcgttcgccattgttgattgagtctgtaactcttcaataatcgcttggatctctttcgtagaggcttgcgtgcgcgcagccaacatacgaacttcatcggcaaccacagcaaaaccacggccagattcacctgcacgagccgcttcaatcgccgcattcaatgccagcaggttggtttgatccgacacaccacggatcacttcaatcacgttgctgatctgctcagattgctctttcaaacgcaggaccacacgcgcagcatcattcagagccagcgccatctgttcactggcttgactgctctctttgaaaatcgcaaggcctgattttgccagctcatcggcttcacgcgctgttgcatccgcagaagaagcattatcgctgacgttatctgccgtgctcgcgagttcattcactgcggaagccacttgctcaatttccatcagttccatctgcgcattggattccgcttgagtcatcaccgcagcaagctctgtcgaagccgatgccacctcttcactaatacgggtcagttgctcaacagtggtgtacagctgtgtgacggtggtattcacatcttggctcaacttggcaatttcattttcaccgtccgcatcggcttttacagagagatcaccttgtgccaacttacgcatcactgattgcaagctattgataggagcaacgatttgccccgatagcagccaagccgcaagtaccgagagcatcaataccgagagcacggtgatcatcgcattgcgcatcacaaccgcattgctttgcgcactctgctccatagacgtagtcgcgtagtggttcactttctgagacaagtcattgatcgcactgatcatacgattccccgtctcgcggaaactctggatgaaaacgttcgcttcttctcgcgtggctaagccttggtctaaacgattaaacagcgcaaccatcttctgtgattcagccacgtagatttcaatagactgtttcaccacaggaacatcacggctaaattgtgcatcttgctctattgaactcagagcagattgcacttccgtcaaaccctctcgcagttcagcgatgaagttattacggcgttcagcatcataaattgcatacacagcgctaattcgcagcggataaatcgtatcgtcgatttgtgcgatggtgtctttataacgtaccaacgcatgagtgttatccgcaatcgcttgttgctcatgagttaagttgaccttagtgatccacagagcaatcaccaaagcaatcatagtaaataaaacagggagtaggacttgtagccgaatggacaagtttttcagcgaaaatggcatgcttaacctctttaaacgcaatgcacgcatccatgcaaatgggagtattcccagcacaaaaaatcgccaaaatattagatcttaatcacaaatttgtccacattaaatagggttatttttcaggtatttatgaataattcaacgtcaaaaatacagaacatgagccaaaaaaatgacaaacgctgcataaatgacaatttgtatttttatatgaaaaagtatgaacacaacttattgttgtgttcatactatgggtaaagagagaggaggcttatttacgtaatgcgttgagtttggcttgagcaagaccaaatacggtgtccaccgggtagctgccatcatcagttgcgacgccagccggtttgccagtgaaaatctcgatcgcttcggtcacatgatcaatcgcccagatatggaattcacctttttccaccgctttcacaacatcagcgcgcagcattaggttatgcatattagagcgtggaatgatcaccccttgggtatctttgcgtcctttgatggtacacacatcaaagaagccttcgatcttctcatttaagccgccaatcggctgcgattcgccaaactggttcatggatccggtaatcgcgatatcttgtcgattcggctgtttcgaaaacgcagaaacaatcgcacagaattccgccatgctcgcactgtcgccatccaccccaccataggactgctcaaaggttatggtagtggtcaacggaatacgtgcggtgcgcccaaacaccgaactgaggtacgccgacaaaatcatcacccctttggagtgaatactgccaccaagatcgacattgcgttcaatatcaatgatctctccctcaccgtatgacgttgtggccgtgattcgatttggcataccaaacgcgtgatcgctggttgccaagaccgacaacgcattcacttgccctatagcaaccccttcagtttgaatcagcgtggtgccattgacgaaggtttccatcatgctctgttgtaggcggttcacgcgcagttcttggttacgcaatgcctcctcaacatggatttgacgaatcaaattcgcattggcctgtttcgccacatagttagattcacgcagcaaattggcaatatgggccgagtgtaacgacagtttggtttgatcgcccgtggtgcgcgaactgtgctcgataatgcgcgcgatggctttacggtcgcaatgcagcatattggcatcatgcacaatactggaaataaagcgcgcatagtgcagctctgaatcggcatcacgcggcatttcatccgcaaagtctgctgtcacgcgaaacagttcactgaattcgggatcataatgcgccagcaattcataggtgcggtagtcaccaaacaggataattttcacatcgagcgggatgggctcgggatcgagcgaaaccgtgccggtgagtgtgacttctttttccaatgaagtgaaactgagctgacgcgaacgcagcgcacgcttcaatccatcccacacataaggctgttcgagtacttttaccgcatccatgagcagcacaccaccattggctttgtgcaaactgccgggacggatcagagagaaatcggtaaacaccgtgcctttgtaggtcgcggtttcaatgtagccaaataaagagtggtagtttgggctctcctcaaccacgatgggaaactcttcagcattgcggctaaccagcacgttcactttataacggcgtggcattttcttatccaaagacgcattcgcaagctcaccttggtcagcgccttcatcaagaaaaatctcgacattttccactatgtctttttgcagctcggtcaaatacgccttgatttctgggtacttactgtaatcaagcttcagttttttaataaagtgggcaatcacatctaaagtgacttcatcattcagctttttgattttctcgctgtatgattcttcccattcggtcaactggcgcaccatattgcgcaaactgacttccaactcatcaatcgtattactgaactgctcttgctcacgtttagagagcgcatcaaacgtctcttccgtgtgcatctcctcaccgtttagagcgacaaattgatactccccttgaggagtcaaggttaaactcactccccgctcttttgcggtgcgagtgatgctttccagttcactttcttgcttttgtgcaagctggttttttaacttttcagcacggctgaagtagatttcattatcgaatgccaatgggatagccgtgaccagcttagtcatgagcttttcaatatcttgacgaaactgaatgcctatcccgcagggtaatttcagcactttaggtacgcgcacatcctcaaaattcgccacataacaccagtcatacagtttattgacatcgtgttgatggcggctgagataacgcaaaatcatggtacgcttgcctagcccattgcggccaatcgcgtagatgttgtatcccttctctttgattgacatcgcaaactcgaccgccttctgcgctcgctcttgtccaacgatctcatcgatcggtgcaagttctttggttgacttacactctagcttttccagttttgcgacttggtagagctgctcaaaactcagatgctgaatcgccatggctccactccttccttcgagattctttacttcatatgtagctcaagtgtagagataaatcattgtctttttagtgacttattcctaattcaagaccaagcggacaaataatagccaaaatcgaccaaacacaaaacggtaattatttgcatttgagaataaattgcatttaaatatccctttcttggcggggagaatggaccatggaattacagcagtgttggaacagttttttgcaggctgaacagttactcaagcaaggacactggtcgcaagcccattacttgttagaagatgttctacactacatgccgcaacatattcacagtgccgcacatgatgagcagacgaaaccatgccagatggcgtgtttgatcactggtctgcgtgatgccgctattgcgcagtctgaaattttcaacaacatcggccagtatcaacgcgcgtttgatgtcctcaatcaagcctatgctctgttgcaatttctatcgattgaagaaattgactcgatgcgccgccttaataccaccctatgccaagtgagcgaatatctgctgcgccatatcaatgccttttgctacgcgcagcgcagtgccgaatggcagttggaatatcaacaagtggagaaagcacacttctactttaaccagttaagaagcagcatggctttacccaccgcatctcccgtgatgaattgaatcgtgatgaattgaataaggaaatacaatgtcacccaatccacttttgcaagttcgtaatttaagcgtgagctttaccaccaatgatggtgttgtcgatgcggtaaaaaacgtcagctttgacattcgccccggagaaacccttgcgattgtcggtgagtccggtagtggtaaatcggtttcgaccaacgccttgatgcaactgctgcctaaaaacgcgcggatccatccagaatcgagcatcatgtttgaaggtgaagagctgctcaataaaacggacacgcagatgcgccgcatccgtggggatcggattggcatgatcttccaagagccgatgacttcactcaatccctatatgcgtgttggcgttcaagttgctgaagctattcgttgccaccgtaatgtcagccagaatcaagcgaaacagcgagtcttggagctgtttcagctcgttcatctgcccgaccccaaaggcgcttaccaaaaattcccgcatgagttttccggcggtcagttacagcgcattatgattgcgatggcactgatcaatgagccggatattttgatcgccgatgaaccgaccacggcgctcgatgtcacagttcaagccgaagtgctccgactcatcaaagagatccaagccaatatgggcatggcgattttgtttatcacccacgatttaggtgtggtgaaatttgttgccgaccgcgtgctggtaatgtgtaaaggggatgtggtagagcaaggctctactgaacagcttttcctgcaacctgagcatgattacacacgcatgctgattaactcgatacccaaaggcagtaaagacccagttgctgtcgatgcagcaccactgctcaaagccgaagatattcgagtcaagtttctggttaaaccgtactttatcagtcgtcgtaatcagtactttgaagcagtgaaagggatttctcttgaactcaagcaaggtgaaactctcggtatcgtaggcgaatctggcagcggaaaatccacattagggcgagctttgattggtttactgccttccacgggtcagattgccttcaaagggcaagactttcgcgctttgagcgagaaacagcgcttagccctgaagaaagacattcagatggtgtttcaagacccttatggctcgctttctccacgtatgaccgttggcgaaatcatcactgaagggcttttggttcaccaacctcacatcagtaagttggaacgtatgcaacgggcgagacgagcgctcgaagaagtgcgattagatccgaattcgattaatcgttacccacatgagttctccggtggtcaacgtcagcggattgcgattgctcgggcgctaattctggaaccttcctttattttattggatgagcccacttcagcgctggatcgctccgtacaactgacggtcattgaactgctaaaagagattcaaaaacgacgcaacatcggctatctgttcatcagccacgatcttgccgtggtaaaagcgttatcggatcgcgtgttggtaatgcaaaaagggcaagtgatggaacaaggcagtgcggaatccatcttccataatccacaacatgaatacaccaaaaaactgatcgctgcttctttcgacattctggaagaaaatgcagcatgattcatattaacttcacgaatgacgtctacacttattagtgaatgaagattatacggatttcaccatggcatagctgccttttcggtttggccgccgacaacaaaaactcgctcaagttgagcgagttttttattctttgttgctgcagttaaacagagataaggtgctatttgataccgtaatcggctaacagtttatcaaatgtgccattggctttaatttccgctaaccctttattaaacgcagccaccagctcttctgaacgtggattggctttaccggaagtcacatgcagtgggttttccgaaatcgcttggttggtgaaggcaaaatccgccaaattcataccagcttcggtaatgatcgatttggccaccagctcatcttcgacagcaagatcaatccgtccagcttgcagtttctgtaaattttgtttgaggtcagtagattctggacggaaaaacgagggatcattcataaactcatcgccatacccataaccacgaacaatcccaactttcttaccgtttaaactggccagtccagcaaattcaaagttatctccggctttcttaataaacttcacttggttagtcagatagttatcggagtaagtgagataggcagttctctcttgggtaaaccatgtcgcgggtagaatatcgattttcccttctttaacatcattcagcgcccgcgaccaaggcatgatagtaaactccaccgtatagccttgagtagcaaacgcggcggtcacaatgtccaccgaaagccctttttgctgcgcattctccatcacaaaaggtggccatggatcttgcgctgcagtaatggtttgagcccaagcggaaaaactacacaatacaacactgattaaagtagcaatggatttcatcataaacactcccgttattgacctaagttctaaacttcgccatgtgttcggcaattaatgcgctgattgcgctgactcgttttgttccttccgcgttttgagcagcgcggtcataaacactgttggccgcctctgaggcttcaacaattgcaaggctaatctcttcaattgcggttctctgctctgcggctgattgatggatttgatcgcttcgttcagaaatcatttccactgacgatttcacatttcgaatcgatgactgcgaatggctaaccttctctgctgttttttccagtagtccggtcatccgcgttaactcttcttccaccgtattagttgcacggttcaaattggtgatattggctttaatttgctctgtggattggctggtcttcacggctagatttcgcacttcgtcggcaaccaccgcaaatccgcgcccttgttcaccagcacgtgctgcctcaatcgccgcgtttaaggccagtaagttcgtctgctctgaaatatcattaatcacattcagtactgtggtgattttctccccttcaatcagcagtttgctcatctcttgattgactcgtaccatttcattacacatgttggagatatcggacgtcgctgaaccaatttcatgaacaacattatcggttaaccgtgtcgcattcagcgcttgttcagccgtttcattcacagtttgtgcgacggttgcgaccgagtggttcagttctgtggcggctgcagcgatggtttccaactgatgtttttgctggtcaatttgtgcaacgttttcttccgccttttctcggctttgctgggcttgtaagcgcagttcagaagaagcattattcacttccacgactatggtgcgcagcgtggtcgtgaactgattaatgccttgagtcacagcttgaaattctttgtatttaggaacgggtaactgatgggtgaggtctgcatccccactggatagtggtacgggttttatcacccaactcattcagtggtttcaacactgaaaagttcaggataataaacagcatacaagggataagaatcgctaaaatcaatactttgagcagattaaaagacacatactcagccaattgctgatgcataaactcatcggaatagcgaatttcaatcgagccgagcgggttcttcttaccatattcaacaaactctaactctccgctcacagaagctaactcggccaatgcgccttcgttttccactgcgatcgttttgcgtaatcctttatcgtctgttgcctgatctagggtcagatacaaaatggccttacccgtagtatcggtaattttgatcgacgagatttccggcgttttcaactccgcgctgatcgccgatttcactgtctctaagtcaaaatcccatagcggtttaggcaaattgacttgcaaccgcgttaaggtgttactgaccgtcagattgagatcattggtaaaagtattgagtgcttttttgtactcaaataccgttaatgccagcaaaactgcacacaccgcaaacacaatctgcacaattgaggcgactttaatacttctaaacatgtgacctccattaaaccagaaggctcaagagaaaccctcttcaccagcacgcacttcacaggcaagtaaagtggcatggtaggttcctattctcccaagttatttttcccaatctgacattgtgattctgctactttgacaggtagctattcataattttttcgatgtcgatctttttcaaaccttcattaacgatggcttgccatttctgaccctgtgcgtcgttgcgaaatgcgatgtgcagatctttttcaaccaataactgcttattcatctgtagctggtctttatctgccgccaagctgggatcattattcttaaggtagttaaatacgttgctatcaatgaccgcgagaggcacgcggcctttggccactttctgtaagttttgaacatcgctgttaaccgcagaagagagtaattgcccttgggcgatcattgaatcaagttcaggggtattgatgtagtcacgaacgacaccaatggtgtgcggcttgagatcctcaagcacggaccattgaataggattggccacattttccgcaaaacctaatgggcctttgccgatagaatcggagaacaataagctgttgtcttcaaaaaagtactccggaaaataacccgaatacttggcttcacctttagccagatgcactgctcgtgaccaaggataaaactcaaccaccaactcatggcccatcgcttcaacggccgctttaaccaccgcaatcgacgcacctttttcagccaacccttcacctgagtagggcggccaatctagcgaggtcagtatcaaagtgtcagccttaacagaaaaagccgccgataatgataaaagcggaatccaaagccatttgcttagtccatgacgcatttgaggtatccttcattcgtttacacgttattcaaaaggatagacttaggattgaaaatatgcgcaatttgttaccacgccttttttacgggaaatgcctaagaagtgataatcctcataggaagcggccttgatgagtgagtcttttatcttttaaaaataatgtgatatcgctaaataacgggcacgtatgtgctcaatcaacaaacgcactttgttgggcggttggcgcgtgaatggataaactgcgtagataccaagttttttgccaacctgttctggaaacacgtccaccaattcgccattacgaaaatcgtgatacaccaaacagcgcggtacataagcaatgccatgccctccaagcgcggctttacgcagtgcggtggcattatcggtcgaaaaggtgccggatactttgactatgtagttgccttttgcccctttaaattcccaatcggtcgcccccgtggtttgataggcgtattgcaagcagttgtgtctagctaaatcttctggcttgagtggcttaccgttgcgggcaatgtaagcgggagacgcgcacactacccactgcgagtccaaaatatgccgcgcaatcaaactcgaatcttccaaataaccggtgcggataaccaagtcatagccgccttcaacaagatctacgaagcgattatccagcgacatatccaccgtcagccccggatgcaggttacaaaactcggcgaccgcatcggccaaaatcaagtcccccgagatggtcggcaccgacattttgatgtgaccgctgacgttttcgccaaatcccaccaccgcatccagtgcttcttgagtggcttgcttcacatttttagcaccgtgcaacaatgccttgcctgcctcagtcaaggtcaatttacgcgttgttcgatacaatagctgcacgccaagttcttcttccaatcgcgccaatcttttgctaaccaccgaatttgtaaggccattttgctctgcaaccttactgaaactccccaattcaatcacttgataaaacaaaattaagtcatcggcacgcatctgattttgttatttttggaaataatgaatttcattatttccctatatccacaaaaaataaagcagtaaattcacgccaacttaacaaccccatcacaactataaaaaatcaacaaccgaactcttactggttagccgtaccctacattctgtgcgcgttagctcatcccgattgatggagagttcaaggacgaggaagtactccatgaatgaaacactgctcgcgctggtggccttttcacccatagtggtggccgctattttactggtcggcctcaactggccagccaagaaagccatgcctgtggctttcgcccttaccgttgcgattgccctgatattttgggatatgtcggctaaccgcgtgatcgcctccgtattgcaaggtttgggcatcacggtctctgtgttatggattgtgtttggtgcgattttcctgctcaacacgctcaaatacacaggtgcgattaccacgattcgtaacggctttaccaacatttcaccggatcgccgcgtgcaggccatcatcatcgcttggtgttttggctcctttattgaaggggcttctggcttcggaacgcctgcggcgattgccgccccactgctggttgcgattggtttcccctcccttgcggcggtgttaatgggtatgatgatccaatcgacgcccgtttcatttggtgcggttggtacgccaatcattgttggcgtcaacaaaggtctggacacccacaatatcacggaagcgctgctggctaacggttcaaactgggatgtgtatctgcagcaaatcaccaccagtgtggcgctgatccacgcttcagtcggcacactgatgcccattttgatggcgatgatgttgacccgtttcttcggtaaaaaccgcagttggacggaaggtttggacattctgcctttcgcgattttttcaggccttgcctttactgttccttacgcgctgaccggcgtgttcctcggccctgagtttccctcactcatgggcggtctcgttggccttgcgattgtggtaacggcggcgaaaaaaggcttcttggtacccaaaacccaatgggattttcgtcctgaaaacgaatggcctgcggaatggttaggctcgctgaaaatggatctggatgacgtcaaagccaagccgatgagccttgctctcgcatgggcaccttatgtgctgctcgcggtgattctcgtcgctagccgtgtgagtgcggatttcaaagcgttgctactgggtatcaaggtttcctttagccatattttaggtgaaaccggcatcagcactgccattgagccgctttatctacctggtggcattctggtgtttgtggccttgattgcggttctcactcaagctcgcagcttagcaccgatggtcaaagcgtttggtgaatcgaccaaaaccttgattggcgcaggctttgtactggtatttaccatcccgatggtgcggattttcattaactctggagttaacggcgcagatttagccagtatgccagtgactactgccaactttgctgcaggcttggtgggtgaagctttcccaatgctaagtgcgaccgtcggtgcactgggggctttcattgccggctctaacacagtctccaacatgatgttcagccaattccaatttgaagtggcacaaacgctgaccatctctagcgtagtgatcatcgccctgcaagccgttggtgcagccgccggtaacatgattgccatccataacgtggtcgcggcatccgcgacggttggcctgctgggtcgtgaaggtgcgacactgcgcaaaaccgttttgccaaccctctactatcttgttttgaccggcatcatcggcatgacagtgatttacggcttcaacatgaccgatgctttaatgaaccgctaaaactttaatcagtaccgagagcgagcgtctcgctctcattgctcaaactcaccttgcacctcgtgtatggacttgagcaaaaaagaaacattcacagaataggcccagaataggattgcattatgatcatttccgcttcgaccgattaccgcgcggcagccaaagccaaactcccgccctttttgttccactacatcgatggcggctcgtatggagaacacacgctcagacgcaataccgatgatctggccgacattgccctgcgccagcgcgtgctgagtgatatgtctgagctgagtttagaaaccgagctgtttggcgaaaaaatggcgctgccgatcgccctttctcctgtgggtttaaccggtatgtatgcccgccgtggcgaagtgcaagccgcgcaagctgcggaagcgaaaggcattccttttactctttccacggtttcggtctgcccgattgaagaagtggcgccttcgattcatcgtcctatctggttccagctttacgttttaaaagatcgcggctttatgaaaaacgtgttggagcgtgccaaagccgctggcgtgaaaaatctggtgttcaccgtggatatgccagtaccgggcgcccgttaccgcgatatgcattctggtatgagcggtcctaacgctgcgatgcgccgtgtattgcaagccatggcacacccgagctgggcatgggatgtgggtttgcttggtaagccgcatgatttgggcaacatctccaaatatcgtggttcaccgaccaaactggaagactacatcggctggctgggcgcgaactttgacccttccatttcatggaaagacttagagtggatccgtgatttctgggacggcccaatgatcatcaagggcattttggatacggaagatgcaaaagatgcggtgcgttttggcgcagacggcattgtggtgtctaaccacggtggtcgccagttagatggggtgctttctaccgtgcaagcgctacccgcgattgccgatgcggtgaaaggcgacctgaaaattctggtcgattcaggtatccgcaccggtctagacgtggtacgcatgctggcactcggcgcagattgcaccatgctcggccgctcgtttatttacgctctagcagcgcaagggcgcgctggggtagaaaacctgctcgacctgtatgaaaaagagatgcgggttgccatgacactgacaggcgcaaagagcattgccgaactgtcacgcgattcattagtcaaaagataataaaagtatcccctaaccttaaacgacttggagttgcagctcacccctgcaacttcaggtaaaaagtgaattgagggaacacacgaggaagcacaatatgaccccaccgatcgccgatagtctctatctgcagctcgaacagattttagcgagccgaattgatccgcagcgcattattactcaagaagcgaaacggctcgcctacggtaccgatgccagcttttatcggttgatccccaagatcgtgttacgcctcaaatcactcgatgaagtgatttttgctattcagagttgcggccaactgggtatccattttacttttcgcgcggcaggcaccagcttatcgggtcaagccgtttccgactcggtactgatcaccttaaccgacgattggcgcgggcatgaagtgcaaaaccaaggcttgaaaattcgcctgcaaccgggagtgattggtgcggatgccaacaagtaccttgccccgtttcagcgcaaaatcggccccgatcccgcctccatcaacacctgtaaaatcggcggtattgccgcgaataacgccagcggcatgtgctgcggtacggcgcaaaactcttatcgcaccgtcgatggtatgcaaattgtatttgccgacgggtatgtgctcgatacacgcgaccctgacagtgtggctcgttttaaacaagagcgtgccgacttggtggaaggcattcacgcgctgtgccaagagacccttgccaattctgaactcaccgagcgcattcgccacaaataccgcctaaaaaacaccacaggttatgcgctgaacgccttggttgatttctctgacccaatcgaagtgctgacccatttgatgattggctcagaaggcacactcggctttatcgccgacatcacctatcacaccgtgattgaacacgcacacaaagcctctgcgctactggtgtttgccgatattgaacaagccagccaagccgtgaccacgctttccaaaacgccagtggcagcggtagaaatgatggatggacgcgcgctacgctcggtggccgacaaaaaaggcatgcccgaatttatcgccaagctcgatttagaagccgcggcgctgctgattgaatcccacgccagtgacgcgcaaaccttacacgctcagtgtgagcaagtgatgagcgcgctgcaacgctaccacattattgaatcggttccgtttacttccgagagcaaaaccgtggcgaccttatggggtattcgtaaaggcatgttccctgcggtgggagccgtgcgcgaagtgggtactacggtcatcattgaagatgtggcctttccggtagaaaaactcgcggctggcgtgcgtgatttgcaagccctgtttgataaataccactacaacgaagcgatcatctttggtcacgcccttgaaggcaacctgcactttgtgttcactcaaggctttgataagcaaagtgaaatcgaacgttacggcgcgtttatggatgatgtagccgaactggtcgccgtgaaataccaaggctcactgaaagccgaacacggtacaggacgcaacatggccccttacgttgagctggaatggggtaaagagggctacgccttgatgcagaaaatcaaagcgctttttgatccgaatcgcctgcttaaccccggcgttatcatcaacgaagataagcattcgcacatcagcaatctcaaacctatgcctgcggccgataacttggtggatcgctgtatcgaatgtggtttctgtgagccggtctgcccatcacgcaccctcactttgtcaccacgccaacgcattgtgttgtaccgcgaattgcaacgtcgccgcgcagcgggtgaaaacgtggcttccagcgagctagagcaagtgtttgaataccaagggttagatacctgcgccgcgactggattgtgcgccgaacgttgccccgtcggcatcaataccggcgatctggtcaaaaaactgcgcatcgccaaataccaaaaattcaccccgattgcgcgttggacagcagagcactttagcgcgaccaccacactcgctcgcggcggcttaaaagccaaccaactggcgacccaagtgctcggagagaaatcggtggattccatggttaatgggctgcgccggatcagcaaaggcaaaacccctttgtggatgccggaaatgccgcaagcaaacactcactcgctggaactcgctgtcgaaaatctgccgcgcagtgacaaaaaagtggtttacctgccctcttgtgccagccgcaacatggggcaacaagcaagcgcgaccgatcaacgcccactgacggaagtcaccctctccctgctcaataaagctggttttgaggttattttgcctgcagagctcagcagccagtgctgcggtatgccttatgacagcaaagggatgactgagattgcgcagagcaaagcccagcagctcgaacacgctttatggcaagctagccaagaagggcgttatccgatcttgatggacaccagcccgtgcgccaaacgcagcattgagcaattcaccaaaccgatggaaattctggagccaacggggttggtaagtcgttacttactggatcacctcacactcgcgccgaagcaagaaaccatcatgctgcatatcacttgcagctcgcgccgccttggcttagaaggcgatatgctgaaactggccaaagcctgcgccagtgaggtgattgtgcctgagcacattcagtgctgtggctgggcgggtgacaaaggctttactacgcctgagctgaatgccgccgctgtccattcgctcaaagagcaagtgccagcgcactgcagccgtgggtttagtaacagccgcacgtgtgaaatcggcttatcacaccacagcggcattccttatcaatccatcttgtatctggtggatgaagtcgcgagaccaaggttggcaacgcaagagagtacagagcagccaagcgagtacgcataaaaaatacttttccaagccgataatttgggaaaagagaaggggcgcttgcgccccttctcaaaattcccttatcaaaatagaaattagaataaacgacgttttaagcctgttcgttcaaggatccgggtggaaatttcctccaccgacaaagaggacgtattgatgtacgaaatcgcctctcggcgaaatagcgcttccacggtggcaagttcctgttggcactgctggttgctggcgtattcgctgccggctaagcggttttcgcgaatttcagtcaaacgctccgcattgatggtaagaccaaacagtttatgacgatgaaactcaaactcaggcaacaggcgcatcgcatgcatatcttcggcgataaaggggtagttcaccacgcgcaggccaaactgcatcgccatgtacaaactggtgggcgtttttccgctgcgcgatacgccaagcaaaatgatgtctgcgcgatcgaggtctttaagcgaaacgccatcatcatgtgccaaggtgtattcaatggcagcgatccggtcaaaataggtgtccgagtccttgccgacactgcgcgagcgttgcaacttaggcgcaggctccatctcaatatccagactcacccgctgcactatgctctccaacacatcgtaaaaatgcgcgggcgcttgcagcaaacgggtacgcatttcggggatcaccatggagaaaaacaccaaaggttttaccccgtgcaattgataagaacgttggatctgcttgagcagttcactcaatttttcgtcactttccacaaacggaaaggttttttcattgggttgcacagcaaactgacccagtacaacgtgccccaacgtttcacaagtgatggccgttccgtcagaaacatagaacacatcacggcgttgcgattccatttgcatcttctatttaatctttcaaaaatttttgattaggataagcaccataatacgcataataaaacccggcattccagcgcctctcccacagctttgaaaattccttcgcgaatttttttgccaagagaagcaaacgattgccaaccctacaagctgcaatgtttctggagaaagacatgcaaaagaacaccctctggtttgatagcctatccatgcaagatgtggataaagtcggcgggaaaaatgcctcgctcggcgaaatggtttctaaccttgccaacgctggcgtttccgtgcccaatggctttgccaccaccgcgtatgccttcaaccaattcctcgattttgaaggactcgatgaacgcattcaccaattgctcgacgagttggatgttgacgatgtcgacgcgctgcgtaaaaccggtgccacgattcgtcaatggattttacaagcccccttcccagccgagctggaacaagagatccgcaccaattacaaccaactgattgatggcaacagcgaattgtcggttgcggtgcgctcatccgccactgcagaggacttgcctgatgcctcgtttgcgggtcagcaagagacgtttcttaacgtcaaaggcattgatgccgtactggaagcgaccaagcatgtatacgcttcactgtttaacgatcgcgctatttcttatcgtgttcaccaaggtttcgaccatcgcggcattgcgctctcggcaggcattcagcgcatggtacgttcggataaagcggcctctggcgtgatgtttacgctcgataccgaatctggcttcgacaaagtggtatttatcactgcagcttggggcttaggtgaaatggtggtacaaggcgcggttaacccagatgagttttacgtgcacaagccgctgctcgaagcgggctatcctgcgattgtcaaaaagacgtttggctccaagctgagcaaaatgatctacgccaacagccaagtgattggcaagcaagtggaagtcgtcgatacctccgcacacgagcgtaaccagttctcactgaccgatgccgaaatccaagagctggctaaacaagcgttgatcattgaaaagcactaccaacgtccgatggatattgagtgggcgaaagatggcatcgacggcaagctctacatagttcaagctcgcccagaaaccgtctgttcacagagcgaacagaacgtgattgagcgctatgagctgagccataaggcctctgtgctactcgaaggccgcgcgattggtcagcgcattggcagcggtaccgtacgtttggtcgattctctggatcaaatgtcgctcgtgcagcaaggcgatgtactcgtcaccgatatgacggaccccgattgggaaccagtgatgaagaaagcagccgcgattgttactaaccgtggcggacggacttgtcacgcggcgatcatcgctcgtgaattgggaattcctgcgattgtcggttgtggtgatgccacgcgtcgcctgagcgatggcgcgcaagtcaccgtttcctgcgcagaaggggaaaccggttatgtgtatgcaggccagttggatttcgcggtgcgccgctcttcagtagatgagctgccgatgctgcccaccaaagtgatgatgaacgtaggtaaccccgatcgcgcctttgatttcgcgcagatcccgaacgaaggcgtggggctggctcgcttagagttcatcatcaataagatgattggtatccacccaaaagcgctgctcaatttcgatacgcaaagtgccgaattgcaaacgcagatccttgatcgcattcgcggctatcgtgacccaatcgatttctacgtcagcaagctgaccgaagggatcgccaccatcgcggcagcattctggccaaaacgcgtgattgtgcgtatgtccgatttcaaatcgaatgagtacagcaacttactgggcggcagtgagttcgaaccccacgaagagaacccgatgcttggtttccgtggtgcatcgcgttacatctctccggtgtttgaagactgttttgagctggagacgcaagccatcaaacgtgtccgccatgaaatggggttgaaaaacgtcgaagtgatgatcccatttgtgcgcaccacaggtgaagccgaagcggtgatcgatctgctcgcgaaatttggtttacgccgtggcgaacaaggtttgaaagtgatcatgatgtgcgagctgccttccaacgcagttctcgccgatgagtttttgaaattctttgatggtttctccatcggatcgaacgatatgactcagctcactttaggactggatcgtgattctggcgatgtagctcatctgtttgatgaacgcaatcctgcggtaaaaatcatgctgaaaatggcgattgatgcggcaacgcgcgctggaaaatacgtgggtatttgtggtcaggggccatcggatcacgatgaccttgcacagtggctcatggaacaaggtatcagctctgtttctctcaacccagacacggtaattgatacttggctgaagctgggcgctgtgtctaaatgttaacctaaggcataccaaacctacttgaagagaggcagagtttttactctgcctctcttcacataaaatttcgctttcctcacttgcttcgcgacataaccccacctatacgttaaagacaacgataatcacaatcacaacgcacagcatttggcgcaacaggaactattgaatggagctcttttatgcgcaataaccaacctgttactcaaaaggaagtcacctatccacctcacttcaatcttctttcgaccaccactctcagcagtcatatcaaatacgccagtaaagagttttgtgatgtcgccggttacacgcttgatgagctcgtaaaccaaccacataacatggttcgtcaccccgatatgccgcctgaagcgtttaaagacatgtgggaacacctcaaagcgggcaaatcttggatgggaatggtgaagaatcgctgcaaaaatggcgaccattattgggtggatgcctttgcttcaccgattaaagaaaatggcaaggtagtggaataccagtcggttcgtttatgtccgagtcggcagcatgtcgataatgcggataagctctacaaagagatcaaagcaggcaaaacaccttggcagttaaaaatgccacgcactcgcctatggcagcgtttagggctcggttttatcgtagcggcaggcgtcagttttgcggcggatcgattcttcgctggtgcaggtttaccattgatgcttgtgttaaccatcctcatggcctatcaatttactcgccgcttagaaaccctttcacaagaagcgcgcaaagtcttcgataacccactgatggaactggtttacaacggtcgagtcgatgatttatctgagatccaactcgcgatgaaaatgcgccaatccgaactcaatgcagtagtaggtcgtattcaagattccagcattcaaattggtgaggcagccaaaatgtcgtcccaaaacagtgcaacgacagcagataatcttgatgctcaaactcgcgagaccgagcagttagccaccgcgatcactcagatgaatatcaccgccactgagattgcgcacaatgcacaagccgcctcggatgccactgtccatgcaaaaaatgccgctcgagacgggatgcatgcggtcgagcaaaccgtcgatgcgataggtgaaatggcaagccagatgaaaactgcgtcttctgtgattgagcagctctcttcacaaagtgcgatgattggtcaagtcatggaagtgattcagagtattgctgagcaaaccaacttgttagcactgaatgcggccattgaagcggcgcgtgctggcgatcaaggacgcggttttgctgtggttgccgatgaagttcgtaaactcgctcagcgcagcaccgaatcgacgaaagagatccaagaagtcatcacctcaattcaaaccagtacccgcaatgctgtagagacgattgagcaaggtaataagctctctgtatcttgtgtagacaatgcacatttatcaggagacaagctgacagctctactctcacaagtttcagatattacgatgcgtaatgagcaaatcgcgaccgccatcgaagaaatggccaatgtaacggaagatatgaaccgtagtgtgcaatccattagcgatgtctcaacggaaactctaggattagccgaaaacacccaaaatgagtgtcgtcaattggcacacaaccttgcccagcaaaccagcttggttgcacagttccgccgagtataaacaaagcgcaagagctgtttaatccgctcgctgggtagactcaaacgacttggcattacagcctcaagtcagaagggtatgtaagtgatagaaaaactcgccccaagatcgcttggggcgagttttttaaacgcgaactctcttgatgaaaacgtaacattttcgtgacaattgcactttccttcttgtgaaaagccatttcaccccaacataaggtctatgcccaaacgatttggagttgcaggtagacggtcagtgagctcatccccatgagcatagcgacactctatgcttgaggtgtactcgggtaaccactgcggctccacaaataagggggattatccccattaagcgcgagtgtatatgcaaacttcaacgtcttctttagccaagcagttatttcagatgacttggcctatgctgtttggcgtcctgtcactgatgagctttcagctagttgacagcgcttttatcggccagctcggggttctacctcttgcggctcaaggctttaccatgccgattcagatggtgatcatcggtattcaagtcggtttaggtatcgccaccacagcggtgatttctcgagccatcggtgcaggaaaaaccgaatacgctaaacagttaggcggtttggtgatcgtcatcggtggtattggcgtagcgctgatagcccttgtgctttacctattacgccaacctttgcttggcctgctcggcgcaccggaaaccgtctttgccatcatagatcactactggctctggtggcttgccagtgcatggacaggcgctatgctctacttctattacagtgtctgccgtgccaatggcaatactctactgccaggcactttgatgatggtgaccagtgtgctcaacctcatcctcgacccgatttttatctttaccttcgaccttgggattgatggtgcagcgatcgcgaccattattgcttttggtgtcggtatcgctatcgtcgcacctaaggttgcccagcgccaatggacgagttatcagtggcaagacctcaatatctcgcaaagcctcactgcgcttggccatatcatggggccggcgatgttaagccaactgttacccccgctctcttcgatgtttgccaccaaattactggcaagttttggtactgccgccgtcgccgcatgggcacttggctcacgctttgagtttttcgccttagtggccgtgttagctatgaccatgtcactgccgcctatgattggtcgcatgttaggggctaaagagattacccatattcgacaattggtacggatcgcctgtcaatttgtgttaggttttcaactgctgatcgctctggtgacgtatgtttttgccacaccgttagctgagctgatgaccagcgaaaccgaagtgagccaaatactgaatttacacttggtgattgtcccgataagcctcggcgcactcgggatctgtatgttgatggtgtctgtcgctaacgcgcttgggaagtcttacgtggccctgactatttcagcgctgcgcttatttgctttttacttaccttgtttgtggctcggtgcccatttctacgggatcgaggggctttttattggtgcgttagtcggcaatattattgctggttgggcagcatggctcgcttatcaaaaagctttacgtcagctcgaaggagcgcatcacacctccgcttaggtttaatgtgtaaaaaactgccttctaagaaggcagttttaatatcaattccctaccaatattgcctactcgattgacttacgtccgcgacttaccctgaaactgcttaacgctctttttattctgtgtgcgacggttggcctgtttatcgcgcggagcacgtttgctttcacccgttgatggctgatcggtcactgggaaaccttccagattctgcacgggcaattcacgttgggttagggtgcgagtggcattcagtgcatccatttctccgtgacacactaacgagagcgcaatgccatgctgtccagccctggcggtgcggccaacacggtgcacgtacgtttcagcatgcatcggcaactcaaagttgatcacaacgggaagcagctcaatatgaatgccgcgcgcgagtagatcggtggcaatcaacacttgggttgtgccgtttttaaactctgccagtgccgcttcacgttccgattggcttttatcaccatgcagaacagtggccactattcccgctttgttgagttttttggtcaaactatcggcattctcttttgcgccgataaacaccagcacttgcggccattggtgctgctttaaaagggctaccaaggcttgcgttttactgcctttgttcaccaaatacagcgtttcttgcactgcttggttgatgctgttttcaggattggcggaaacttgggttggcgcacgcatcaattgctgcgctttaagtttcaaatcatcagagaaggtcgcagaacacatcacggtttggcgcacaccggcggtttgactggctaacgcttgcacttgcggccaaaagcccatgtcgagcagacgatcggcttcgtctaacacgagcgttgttacgcggttcaacctcaatccactttgggttaaatcgaacaaacgtcccgtggttgccaccagaatattcgggttctcagccagcgcattttgctgctcagtcttatctaccccaccgcacaagcagagtgtgttcagccctaatgctgtaccaacgtgagtgagcacttcgctcacctgcatagctaattcacgcgtgggtaccaacactaaggcttgctgctcagggctagtttttaaacgctcaagcagaggcagaccgtaagccaacgttttaccacttcccgtattcgccaacgcaaacacatctttgcccgttaacatagcagggatcaccaaagtttgaatggcggagggctcggtgatcgctttaggcagagcttggattagatcggcgcttaacgcgagagaagaaaatgacatgggttggatacctgaatattcaaaaaacaatgtggggcgaattatcgcaggcgtggactttatcacaagccgatttacaagatatggctcttttcactgtagcctaggcatcaacagaacctttagattttcttctctctttttactgatctcactactattggtttcctaagcggaatgcacactgctcaatcaaaaagtcgataaacaatcgcaggcgtttgggctggtattggcggctgagataaagcacattcaaatccgcccctgaagcagaagtggaggcgttaaaattcttcatgtaaccatcgagaacagtgaccaaccgctgctgattgagatcgtcctgcacatcgaggatcgatttcaacgcgatccccattcccgctaaagcccactggcgaatcacttcgccatcatctgcaaaactcttgggtactaccgtgatcactttgtgctgctcattctcttggaagtgccaggttttcatctcttcattgctgcgaaccatggccaaacagtcatgctgtgcaagatcttgcggcgttttcggtattcctttacgcgctaaataagccggagaagcgcacaacactcggcgactcgtcgccagcttgcgtgaaattagactgctgtcggccagttcaccgtagcggatcaccacatccaaacctgattccgccaaattcgagatgttgtcattgaggtagagatagggcaccacttccggatattgctcagtgaaagcggcaagaatcggagcgatatgttgcttcccgatgtcacgcggagcagagacttttagcgttccccggacttctttgctgcctgtttgcagcaaattttctgtttcacgcacgctattaagaatctcaaggcaagcttgatgatacaaaacgccagattcggttaaggagagatggcgagtgctgcgattgagcaatttgactccatagcgatcttccagtgcttgtagccttgccgttactgttgcgggcgataaactcaactctcggccagcggccgccaaaccttggtttttgactatgctggcaaataacaccatatctgcaaacttatccataacacctccctaaaccctgattattcaatataaccgaacaatcaattcagtttctcgccaattatcaatttttatatgagaaatatactgcctcaatctcaactggattaggaaatcaccatgaaactctatatttatgaacactgtcctttcagtgcacgcgtgcgctacgtggcaggtatgttgaacattccacttgatgtgatcacccttgattacgacgacgaccaaaccaccaatcagatcattggtagcaaacaagtgcctttgctgatcaaagaaagtggcgaagcactggcagaaagtctcgacatcattcaattcttgctcgaatcggtgaactcaagtgaaaccgcacaacctgcacaagccacgttggattggcagcgcagcgcattcttgcctttgcaaaaaatcggctatccacgctggtcgaacatgaatttacctgagtttaaaaccgcatccgctcaacaagcatggcgtgtaaaaaaagagaccactgaacttcattttgaatccctactgaaagacacgtcgcaaattgccctgcaagtgcaagcctgtattgatgcggttaaaccgctgctaaaactccattcctatcagcacgttgctcttattgatgaagcgatcattttctcaatcctacgaggatttttcagcgcgcctgagatccaatgggacagcgaagtcagagattggatggtatcggtcagccagaaaacccaagtccgcttgttgcaagaaccgttgcaaatcacatcgcagaaataaggaggcaaaatgagcagattatttgaaccaaccgatttaaaacaactcacgctgcaaaaccgtgtggtgatggctccgatgactcgcgcacgcagtagccaaccggggaatattcccaacccaatgatggcaacctattaccaacagcgcgccagtgcagggttaatcatttccgaagcgacccagatctccgatgatgcgcaaggctattcattcactcccggcgtttataccgatgagcaaacctcaggttggaaaaccgtaactcaagcggtcaaacaacaaggtgcagcgatgttttgccaactttggcatgtcggacgagtttcccaccctgtttttcaaaaagggcagttgccgattgccccgtcagccctcaaaccggttgaaactcaagtttggatcgccgatgaacaaggtaatggccagatggtggattgcgttgaaccccgcgctatgactcaagccgatattgatagagtggtgaacgacttcgctcaggcggcaaaatgtgccattgaagcaggatttgatggtgtagaaatccacggtgggaatggttatctcatcgatcagtttttgcgtaccaactcgaatcatcgtaccgatagttatggtggtagccgtgaaaatcggatgcgatttttgctcgaagtggtggatgcggtcagtcaagcgattggtgccagccgagtaggcgttcgcttagcgccgtttattactttcaaagacatggactgccccgacatagtgccaacaattttggaggcatcgaagcagttgcaagcacgagatattgcgtatctgcacttatcagaagcggattgggatgatgctcctaccattccagaaagctttcgcattgagctacgcaagcatttcactaacgcgattatcgtcgctggtcgctacacccttgagcgcgcggaagaggtgctacaaaaaggctatgccgatttagtcgcattcgggcgtccttttgtcgccaaccccgatctggtttctcgcctcaagcaccagcaaccgctggcgcaactggatggtaaaaccctgtttggtggcggtgagcaaggctataccgattaccccaaaatccctgaacagccaatctagcccgatcggatttgctcaatcctcgtcactttacgccgctatttggcctagcgaagtaaagtgacgcagggatactttaaagggagagcccctcatctccctttgttttgctgattcaccttacgcttgttttggtaaaaacaactcagccaacatacagcgcacactgccaccgccgatggtttctatggtcggcaccgcaaaaggcagcaacttaccgtgagtggcaagttgattgagttgcgtaagcgtaaaggcttcataagcggattgcgacatcgcgattactttctggccgtcagcggtttcgagttgcaggatattgccgcagaagtggttcatctgctcaatcgaaatcgaaattacctgtttatctttagccagcgatttcacgacaaatcggcgctcatattcggggatcgcttcatcgcaaattacgcagaaatgctcacctatcgccatcatcacattggtgtgataaatcggcgagccagagggcaatcgagtttggaacgacaccacgcgcgaatagccgatctgttcggcatacacttccaacacttcacgatcacagcgctgtgaaagccccgcataaatggtgcgattagggtgatccattaccatcacgccggtgctttccaaaaacgcttgctgctcagtaaacgccagtaaagagtgctgttttttcacagcaaagccttgcttttgtaaggtatcaatcaaagcttcagggcgcacttccaaacgtcgattcgcacacgccattggaaacaaaaacagctcgcccgcctcagtggtgctaaaccagttattcgggaacaccgcatccggtgtttcaccttggcctagggggtaatcaaatatcacaacgtcaacacccgcttggcgaagaccgtttaccatggcgttaaactcgctcatagcgcgctgcaaaatggtttcagcgctgagtgccaacgggttttgaaaggcattatcttgcgcagtttgcgcattaaagccgaactcttttggcggcaccataacgacagcgcgagccgtttgcgcagcagagcgcggaatcaacatattgggttgtagatgaacattcataataggcactcatcaccgatttcaccccaaaagtgtaaacagaatgttaactaaagatttgctgattttgatgaatttcaatcgataaattttatctttttactgaaaaaatggtccatcacagtcaaatttgctggcgttatggatgacatcggctggattcgcttagaaataacacgccaagcggattggctcgcacaaccgaaaccaaacgacttggcgttgcaggtcgcaagggtataacttcaagtcaccaatggataacgttatactgcttccgttttaacagaaaatcacattttggcggacgctcgcacgcgtgctctctccctcactgccgccctatcacagcaaggatcttgttcatgtttaagctatttgaaggtttcaccgacccttttcccaaaggtgaaccccaacgcccacccaacactttgtgggccttttgtcgccactacactcgcgggtttgaaaaaccattgatcgtgatggcgttactcagcacggcgatcgcgattatcgaggtctctctgtttggctttatgggccaactggtggactggctttccactagctcgccagacacatttttaaccgaaaaccagagcactttgattgggttaggcttattggtattggtcggtatgccgctactgatcgccttctattcactactgatccaccaatctttgctcggtaactacccgatgtcgatccgttggttggcgcaccgctatctgctcaagcaaagcgtgtcgttttatcaagacgagtttgcagggcgcatctcaaccaaagtgatgcaaacggcgctcgcggtacgtgaaaccgtgatgaaaagtctcgatgtgtttgtgtatgtgatggtttatttcaccgcgattgtagtgattttggcgcaggctgattggcgcttaatgatcccgatgctgatttggctggcgatttacgttacggtgcaaatgtattacgtgcctaagctgaaaaaagtcgcttccgagcaagccgatgcccgctcactgatgagcggccgtatcgtcgatagctacaccaacattatgactgtaaagctgttttcgcacagtcaacgtgaaacgcaatacgccgaagaaggcatgcaagattttctgggcaccgtccatcgccaaatgcgtttggtgaccggttttaatatttgggttgaaatggccaactacttattggtgtttaccattgctgccctgtcgatttatctgtggatcactagcgccatcagcgtcggtgccattgcggttgcggtcagtttatccttgcgtatcaacggcatgtctaagtggatcatgtgggaagtcagcgccctgtttgaaaacatcggtaccgttgtggatggcatgaccatgctgggcaaacccatcaccgtcaccgacaaacctgacgcgaaacccttggtggttaagcatggtggcattacctttgatgatgtgagcttccactacggtgaaaacaaaggcgtgatcaaccatctcaatctcaacattaaaccgggtgaaaaagtcggtttagtggggcgctctggagccggtaaatcgaccttggtgaacctgttactgcgttttcatgatgtagagagcggccgaattctcattgatggtcaacccatttcggaagtgacccaagaatcgctgcgcagcaaaatcggcatggtgacacaagatacgtcactgctgcaccgctccattcgcgacaacattttgtacggcaatccgaacgccaccgaggagcagcttttgaaagcaacggcgcaagcccacgctcatgagttcatcctcggtttgaccgatccgcacggcaacagtggttacgacgcacaggtcggtgaacgtggcgtcaaactctctggtggacaacgtcagcggattgcgatctctcgcgtactgctcaaagatgcgccactgttggtgctggatgaagcgacttccgcgctcgattctgaagtggaagcggcgattcaagagagcctcaatgagctgatgcagggcaaaaccgtgattgcgattgcccaccgtctgtcgaccatcgcagcgatggatcgcctgatcgtgctcgataaaggccaaattgttgagcaaggtactcaccaagagttgattgcgcaaaacggcatttatgctcacctgtgggcgcatcaaaccggtggctttatcggctgtgatgaagacgaagtagaagaagccatactggcataattccaatcagcacagaataagcccgcggccattcgcgggctttcctctttatgggcttttgacttagaatttcgctactttttccatgcattaaccgagaagcacttggccgctatgccaaggtaagactttgagtaacttagagaacactatgaataaaagccttattaccaatgtagtggcgctggcactgatgggtgtcggctattttctgcctaaccactatgccttttacgcggggctgtttgccttttctggcgcgataaccaactggctcgccatccatatgctgtttgaaaaagtgccgggactgtatggctccggcgtgattcccgcacgttttgaagatttcaaagccgccatcaaaaatctgatgatggagcagttttttaccgatgccaatatcgaccgcttcctcaataaagagatgaatggcgcgttgaaccttgatttgcaaccggtgatcgccaaagtcgatttcaacccgacctttgattcgctcgtcgaagtgataagccaatcctccttcggtggcatgctggcgatgtttggcggcgcgaccgcgcttgagccactgaaacagccctttgtggagaagatgcaaacagcgcttgtcgagatgagccaaagcgagtcggtacgtgaagctctaaaggggcaattggaatcccccgcgatgctggatgaaatcaaagccaatatcgaaggcatcatagatcagcgcttaaatgagctgacaccgcaattggtcaaagagatcgtgcagaagatgatcaaagagcatctaggctggcttgtgatttggggcggtgtgtttggtggtttgattggccttgtttccgcggctttagtttaactttggtttaaacatccgcactgtaaacctaaaaaatcagccccaataatggggctgattttatcaataaagaaaggtgaaataacgagttagtaaagctccgttaacatcgaatcttggtacgcttttagctcttcacccttttgaacgcgggcgatgtaatctgggttagcaataaatggacgaccaatcgcgagcagatcaaactcattattttcaatcgcagtagcacccgtttctgcgctaaaaccaccgacacccatcagcgtttttgagtagtgctgacgcaagtaagtcgacactcgaccacctaagaaatcaaaggtcacgctgtcatcaaacatcccttcatgcagataggccaaattgcgtttttccaactcaggcagtaaataatcaaacacttcacgatcacgcgggtccgctttgatgttgaaatacgcccccggagacacacgcagcgcagtgcgctctgcgccaatacgagcgatcaccgcatccactacttccaaagcaaaacgcgccatattggccggcgtttcaccgtactcatcgctgcgttggttagaatcaaaatgcaggaactggtcgatgagatagccgttcgcgccatgaatctcgactccatcaaaacccgccaagcgtgcattttccgccgcttgtgcgtaatcggccaccagttgcttgatctccgcttggctcgccgctttcggcactgtgtactgcaattcgcggcggcgtggcacgctgccttcgacaccgagagctgaaggcgctagaacgtattcacccgcaaaaaaggcagggtgagccacgcgtccggtatgccataactgagcgaaaatcttaccgccattggcatgcacggcgtccgttacttttttccagccggcaatttgcgcttgcgtaaacagccccggagtgttcgggtagccttgagcatcggggcgaataatggtggcttcggaaatgatcagcccagcatcggcacggcgtgcgtaatacgccaccatggcatcggtcggcaccaaatcgtcatcagccatgcagcgcgtcagtggcgccatcgcaattcggttgtttaaggtaatcacatcgttgagcgcgtatggctgaaaaagaatatcggtcatttgagttgtcctgtggttgtctgttgcgcttatgctagatcattcttgaacaatcgttcaagaacttttttgaatgaacgttcaagatactttgtcatcgactcggtttagcgctagaatcgcgccatgttcgatgaagagagtgtgttgtgcgagtagctgaatttgaccgtgagcaggtgttgcgatccgcgatggatgaatttatgtccaaaggattcaacaaaaccagtatgcaagatttaaaacgcgtgaccggtttacaccccggctcgatttactgcgcgtttgaaaataagcgcggtttgctgattgccgcccttgagcaatacaccaaacaacgcgtctcggaatttaatgcgattttcgccgcacatcccaccatcttagcgggattagagcagtacatggcgatggtcgttgatgagtgtgaacgcgatgagatcaaagattgcttgctgcaaaaagcgctcaatgaactctcttgtcaggatgaagaagtcgaaacgctgatccgcgcaactgtcggtacttggaagcaaggcatgcttgcgcaattacaagaagcacagcagcgcggtgagataaacccagatagtgactgcgtgctactcaccgaatatttggtgatgggcatttatggtttgcgctcgtttgcccacactcggccggaaaagggcttactcaaaaagctcgccgataaactgttggacgcgattcgctgatccgccagtgttggtaattcctacaaaaaagccacagatgcggtctgtggcttttcacttttttggcgatatcacacaaaatcgctgagcatccagagcgctagcagcaaaaacaccgcgcccatcactttgtgctggtaagtgcgaaaacgctgattgtcgactagcgagcgaccaaacacaccaatcaaagccactagcagcagattaaacagcaagccgcacacattcagcaccatacccagcgcgaacatctgttcggcggagctggctgcgatattggttgaaacaaactgcggcaaaaacagcacaaagaacaccaaggctttggggttcagcaaattgctcactaaagcgcgttggtaaaaggtttttgctaccgcttgtgcctcatccaaggtgggcgcttgcgctgcatcggcgcgcaggcaatcccacgccattttgagcaggtatgctccccccaacaaatgcagcacattgagcgccaacgggttcatcgcaatcagtgcggaaaccccgagcgccgcgagtaaggttaaaatcatccctgatgtggcattgcccaagctggcaaacaaaccgactcggcgtccgtagctcatactagagctcgcaatcagcagcatatctggccctgggatcagcaacagcgccaataccgcggtgagataaaccggtaataccgaaacatcaatcatgttgaaaatcttgttaaagctggaaagcggcggattttataggagacataccgccatttccatatgaaagataatccaaataaactcatttctagccagagataaaatagtgtggatttcgattagtacagaagcgcaattttgtacaaaaactttcctgcactttgcagtagactcattagggaaaaacacaaggaagcgtgatgagcgactcagccggcaaaattaaagagcaagcaaaatttcagattgccgaagaatttggcggccttgagctgcttgatgcgcaatacgaaacacagaatttttctcgccacagccatgaagggtataccgtgggtgtgattgagcgcggtgcacaatctttctaccgcaccggcggcaatcatattgcgccgcaagacagcattattttggtcaacgccgatgaagtgcacaccggacactccgccgtcgaaggtggttgggcgtataaagccatgtacccgctgcccgagcaatttgccacggtcgccaaagagatcggtgccaataccggcgcgccttattttccacaagcggtggtatatgatcccgagctcgcgagccaactgcgcttagtgtttgaaacccttgagaaatcgactaaccgcttgctacgtgaaaccctgatttacgccagcttagtcaagctgatgacacgccacggccgcacagcgccacaggctgatcaaccgctatctgcactacgcccattattgctagttaaagagtttctggatgattttccgcaggccgatgtttcactcgaagagctggcacaactggcgggattaagtccttttcatctggtgcggacgtttcaaaaacagtttggtttgccaccccacgcttatcaaatccaagcccgcttgcgcctcgcgaaaaccctgttaaagcaaggcgtaagtatctcggaaaccgcgcaagagtgtggctttcacgatcaaagccatctgcatcgccactttaaaaaagcgctcggcatcaccccaaaacagtacgcaagaccttagataattagcactcgtcacctgaacgctaccgcgcaagattatccaagcttatcggcttatccctgtgttctgataaccctgacgatacccaaacctcttggagtttcaggtaggaagggtataaggttttcttctataaattggaaagagtatgaatagccaagtgttaaccattgatgattcacctacccccacccggctgttttggcagggcacaatcgctatgctgccattgagcattgcggtattaccttggggtttactggccggctcgtttgcgattgaagcggggttatcggtcatcgagagccaagccctatccgccgtgctgtatgctggtgcagcgcaactggtcgccattggtatgtttaaaacgggggcggggttactgagtttgttgatagccactttttttattacctcacgccattttctgtacagcgtatcaatgcgcagcaaaatcagcccattacccttgcgctggcggctgacactgggctttttgctcaccgatgagctgtttgcgatttgcggcgcgcagtctgacaagcagtttaatcgctggtatgcgttaggcgcagggctgagtttttatctgatttggaatttagccagcttggtcggcattgtcgcaggcagctatctgcccgatctcaatcagtggggactggaattcgcggtcgccgccactttcatcgcgattgtgatcccgaatatcaaaagctggcctgtgctgatttcggtactgaccgccttggtgttatcagtattactcaccgtgatggggattgaaggcagcctaatgttcgccagtattggcgccatgctcgccggctacggtactgaacgtttattaggagctcgcccatgatcatgctttcgatattcgcgatgacggcactggtatttctcagccgttatctgtttcttgaacctaagctgccactgcgtttgagccccacgttgcaacgcttacttagctactctgggcctgcggtgctcaccgcgatttgggcgccaattgtgtttatgccagaaaaaaccttgtggctagagtggcacaacccctatcttctcgccgcactgctttccggtttactggcttggttaagcaaaaatgtcctgctgacgaccgtcgtggggatggggagtttcttactgctcaagctggtggtattggcctaagcccgtaagaaacgggcttagtgtatgttgggagagagggtgaaagttcggttattcagccaaccattccacttcaatcaaggtctgttcaccacatttcaggcggcccacaaaacggtcgccttgatgtacttctccaacgccttgtggtgtaccagtcatcaccacatcaccatcttccaaagtcagatagcttttgagctcttgcaataccgcttgaggcgagtaaagcatttggctgacatggcctttttgcacccgcacactgttgatcagcagttccaaattgagatcgtcggcatccaacccgtcaagcgcaacaaatcggctcaatacggctgcgccatcaaacgctttagcgcgctcccaaggcaagcctttggacttgagataactctgcatttggcgcttggtcaaatctaggccaattcccaccgcgacatattgtcccttttcgaccagaaaacagatctctgcttcataatgcaaaggctcttgatggaaggcgcgcagctgcgatgtaaccgctgatgaaggcttatgaaacagcaccatctgttctggaatgctattgtgcagttcctgaatatgctcaacatagttacgcccgacacacagcactttaccgacagataggtttcggttggcaaattggatatgactcatctctcttccttgaccagacacaaagccgcgattctaaactaaccgctgataaactactcagaaatcaatcacacaatgatggaaaatgcgtacttcagcccattcattgccaaactcagtcgagagtatggagaattttctcgcacagcgtttttaggctaatcagctcctctaagctgagatcaaatttacacagcatttcattcggtactgaacgagcctgttcttgcaacgcaaaacccgctggcgtcaaaaatagctcacgaactcgttcatcactgctgctgcgtcgccgttccacaattcctttcgcttccaatcttttcagtagtggagtcaacgtgccggaatccaaatgcagcttaataccgagatctttcacatttatcccgttttgctgccacagcaccagcagcaccagatattgcgaataagtgatatccagttgttcaagcagcggacgataagcacggatcaccgcattcgatgcactgtagagtggaaaacagacctgattttccagaagtaatggatcatgagtcggcgtttggcagctcacttgtggagaaggcatgatgtatcctcaaaaaataaattgcgcacaatatacttgcaaacaacaaaagactcgatataagattgcaagcaattaaattgcacacaacttaaattgaggaataaaaacatgagtacgatttatcaaacttccgcgaccgcttctgcaggacgcaatggagtagtcagcaccgaagacaaactgcttgagctcaatctcagctacccaaaagagatgggtggaagcggtacggcaaccaacccagagcaactgtttgcagtcggctatgctgcttgcttttcgaacgcgattctgcacgtcgctcgtgaagcaaaagtcgccttaaaagaagcgcctgtgaccgccactgtcggtatcggacccaacggtcaaggcggctttgcgctaagtgtcgccctcgccgcacacatcgctttagaagatgaacaagccagacagttggtgaccgttgcccatcaagtctgtccttactccaatgcggtgcgtggcaacattgatgtgcaagtcagcgtcaatggcttagccctgtaatttcgattcctcatcactcaccacggcgaagcgcttttttcactctagagagcatacttgaaagctcaacaggaggtacgtgctccgccgtgtgattaaggcctgtcatcatttttccttatctctgccatccccgcgccataaaaattcaatcaaaacgtcaccaaatagaaacgcattattcattttcaatcagtaccttagcggcatcacaagtcgggcagtaaagcccaatcaaactaatagggtagaaaaatgaaaaaagcagcaatcgcagtagcagttctttccgcagtggtatctggctcaaccttagccgcaaccgtttatgatgcagaaggcacttcactcaaagtggggggtcgtctggagttccgtggtgatttcaatggcaacgataagggcgaagaaattgaaggcacaatgctcaacaagagccgtgtgcgtttgaatgtggcaggtgaaaccgacattggtgctggcatgaaaggctttggcttctgggaagcagagcaaggcgtaaaatcgtccgcaggaacgtcaacagagcaagaaacgacgttcaaacaacgttatatgtacgtgggtatgaaaggcgattttggtagcctctcctttggccgccaaaacaccgctggcgtgcaaatttctgacatgtctgatatcggtacctttactggcgatcaaaaagccttcgtcagtgcaggtaacgagcagatcaacaacactatcgcgtatggttatgacttcgaaagcttcaagctaaaagcaagctacattgctgatgatcagaaaaatgctgatggctatggcctgtcaggcatctactcagcgccatttggtttggatatcggtttaggttatgccgcgaatgatctgggtacagataaaggttcagcggatcaaatcattgcgggtttgggttacaccatgggtgacctctacttcggggccacttacaccacgggtgataaagatgacaaagcagacacggaatttaccggtatcgaagtctctgcacagtacaaaatcaccaaagaatttcgcctgatcgcggcttaccaaaaccaagaagaagagaccaagaatgtcactaaagacaaagcggatttctttgaactcactggtcgctacgatttcacgaaaaacttccgctcttacctcgcttacaaagcgaacggactggatgacaaagacgcaggctacaaagtcgaagacaccatccgcctaggtctacgttacgatttttaatcacactgccttaaactcctgaatattgtccttctttggccaagcgattgcttggccttttttgttgcagaatttcgaacgtcatgagcaaccacagcgattggttttctcactattaccacgtatgattcagcccactttttgactacctctttgattcatgagcattaaacatcacccattgcaaggtgcgctttggatgctgacggctggcctcgcgttcgccatcgtcaatagcgtcgcacaatacgccagcattcaatttggccttccttccaccaccgttgccttagtgcagtacgcgattgcgattgtggttatcctgccttatctcaaaaccttgggcattcgtcagtcgctgcggactcagcagtttggctggcatctcctgcgcgtctttctggccgtgattggcattcagctctggttgtgggctctcgcgtatccggtgccgatttggcaaggtattgcgctactgatgacttctcccctttttgccaccattggctctggcctatggctacgcgaaaaagtgggcatggcgcgctgggtagctaccctcaccggatttatcggtgcgatgatcatcctcgagccttgggcggatgattttaatctcgcttcattgctccctgtcggcgcagcctttttctgggcgagttactccttgatggtgaaaaaactctcctctcacgactcgccgtccaccatggtggtctatttactgctgctgatcaccccgtttaacttattgctggcgctacccgattggcagatgccaaacggacaaaccgtatggctgctactgattggtgctggggtaatgacagcgcttgctcaatgggcgatagccaaagcgtatgcggtagcagatgcttcctttgtccagccgtttgatcacgccaagcttcccttaaacgtgctggctggctggttagtgtttggttgggtaccaccgggcagactctggctaggcgcagcaattatcgtgttatctgtcgcgttcattactcaatgggaaacaaaaaaatcacggcgtgaaagaaacatcgcctaaaacctttcctatcttttaacagaaagatgcgtataaggaaccacttgatgacaacaccgatcaaagtcactctctaccgttgggcaggccattttggcccttttaaagtcaacattccttgcggagaatgtacactcaccaaagatattttggccgatacctttgccaatgaattggctggcgtgccgattgaattagaggtgaaagattggcttagctactggtgggaacctttaaagcttggtgcatggcatgcgccgattgtggtcgtagcaggcaaagtgatcagccaaggagaagccctcaaccgcggtgtattggtgcaatccatcatcaaagagtggactaaacaagacacgttacaaggcaatattgtgtttggcaaagccacctgcccttactgcgtgaaagccaagcagttgcttgatactgcaggaatcgactatcgctaccacgatgtagtgaaagagagtgctgcgctataccgaatgatcccagaagtcaaagcgatcatcggagaaaaaacacccgtcacggtaccgcagatctggttaaatggtcagtatattgggggctgtgatgcgttggaaaaatggctgcaaaataacccgcatgcgctacctaataacgtggtagaaatcgaaactacgcgtgtagctccgtaattcaaattgtttgagcatcgccaagatcagcaaaaaaggcctcgcacagtacgaggccttttctattttagcgaggagattatacccaaactacttggagttgcaggtaggcggcaagtgagttcatccccatgagcatagatacactatgtgattggggtgaacgaacgtagccaacaccgctgcagcttaaagtaggaagggtatagctgattataaaaacaggttcatcacccacatcgcaccaaatgcgttcaatactgaaataccaatcatcactgggatgtagcgcccttcagtaccaatcgggccaagaatacggccgatgtattgcacttgtgaacccatcaaatagatagcgggagccaaaatcgcgatgtgcgtaccgttcaaaatcccttggtcaaacaaggtgatcaccacacccacagcgccgcccatcgacatccatgcaccaatcaacaccgcagccgcttcacccggcaatccaaagaccgccatcacaggagaaaatactgtccccatcagatctaacgcgccagtaatttgcaacgctttgatgatcacaaacgccatcaatacattgggtacagtagacgtcgtcgcaattacccagcctttcttcgccccttcgacaaaaatatccgtcaccattggctttttcatattgacgttactcatcgggtcgcttcctctagttgagtctctgggttagatgattcttctttgccttccgtcagatttagatagagacggaacaggttggcaccgacaattttgaaaataaacatcacaccaaccgcaagaccgatagaagaagtgacggccgcggaaccatccgctaacgtgagcgtaaacagcaccgcacccgatgagaaaaagttaactatggtggcacctgcagagaattggaacatggtaaacacatccgcttcacgcttagtcatatgcccttcatctttgagctgacgagtcatcgccgcacccgcatcagcactttgcaaagaagcaatcagccctaaacctgaattacccggaacgcccatgattggacgaagtagaggagtcagtagcttacgtgccgcatcgagcgcaccgtaatgttccagcacattgatcatgcctaatgcaaacatcacggttggaattaaggtcagtgcgaaaagaaaaccatcacgcgcaccactaccaccttgaccacgcaaagaagtggttgccacttgcaggccgtcggccgtttcactgacgttgtaagcaaccttgccaaaggcaccgtttaacgtggtgaaatcaaatactccataccactggttggattgcagcaagccagaaaaaaagactacggcgaaggctaacgcaatgtagcatccccaagtcacttttcgctcctgcgctgtcgattgactcataattacctctataaagttggaacagattgggcgtcatggtgcacggattgcgtgctagagataatgatcgaggtcaatgagtcgatgaaactcatctcacaatgaaaaataaaattttattttgttaaaacaatacgagaaagcatgatcaattaatttatttcagcctaaagccacaacaaaccacttcacgccaccgatggaataaaacccttttctaatgttaagcaaatcgcacctttctaaaaaatgatgaataaacaaccatttctaagctaagtcacaacttcaaattccgcataggtctactctttctcaggactttctcccatcacaccttaaaacttgaagccgatcttcaagagaaggggatatcaacaggagttttgttatgacgggccggatcgcactactttctcttacgcttttttcaccactcagtttagcgtctaccccagatggacaagctttagatttcacccattcgacgatcggctatgccgcactcctcattttcgccatcgcttataccttggtcatgctggaagagtatttgcaactacgtaaatcgaaaccggtcttgctggctgctgggctgatttgggccatgattggctatgtttaccaacaaacaggctcgaccgaggtagctcgtcaggccttagaacacaatttgcttgaatacgcagagctgctgctgtttttattggtcgccatgacctacatcagtgcgatggaagagcggcgtctgtttgatgcactcaaagcgtggatgatcaacagaggctttaattttcacactctattttggataacgggttggttggcgtttttcatttccccgattgccgataacctcaccacggcgttattgatgtgtgccgtggtcatgaaagtcggtggtgaaaaccctaaattcgtcagtttagcttgcattaatatcgtgattgctgccaacgcgggaggagccttcagtccctttggcgatatcaccactcttatggtgtggcaggctgggcatgttagcttccttgagtttatggatctgtttctcccatccttagccaactatttggtgcctgccttggtcatgtcgctctttgtcccgcatcaaacgccttccagcatccaagaagtggtcgagcttaaacgcggagccaaacgcatcgtcgttctgtttctctttaccatcctctcggccatcggtttccatgcatttttccacttcccgccagtgatcggcatgatgatgggactcgcctatttgcagttttttggctatttcctacgtaaaacgctggcaagatcactggctaagaaaacggcgattgccatggcgaagaatgatgaagccgcacttaaacgtattggttccgtggtgccttttgatgtctttcgcagcatttctcacgccgaatgggacactttactgtttttctatggggtcgtgatgtgtgtcggaggcttgagcttactcggctatctaggtttagtgtcggaaatcctctataccgaatggaaccccatctgggctaacgtactggttgggctgctttcttcggtggtcgataacattcctgtcatgtttgctgtactgtcgatgcagcccgaaatgtctctcggcaactggctactggtcactctcaccgcaggagtcggcggcagtttgctatcgattggctctgcagcaggtgtggcgctcatgggcgcggctcatggcaaatacacgttcttgagccacttgaaatggactcccgtcattctgcttggttatgtggtcagtatcgtgttgcatttgctgctcaatcatcaatcattcacataacatgtctgattgaagctgctacccgcgtcaaatggttccaaagaaaccacctctctacgtttgactcattgagtgttgctggctgacgcattttgcggttctgcgttcagtttgacccagttattactgaggtggaacatggcacaagcgctgcaagtgaggacttcaccttgtccatgaatggtcatgaccaaatcatcacgtttttctttggagttattacggatctggatccgtaatgttttgccatcaacgctaaatgggcgctcccatttttgctgcgccgaatgcatgtacacgacgccctgcctaaactccaacacatctttgttgtgcggattatcatacaggccattaaaggacaaggtttcgcgattcacaaagttttccagctcctcttgaaaacagccgcttaatagcaatacgctcaagatgagaatgatgggtttcaagttggccacgttcataatcttttccttatcttcgtttctccaactccagcaggaaggctttacgttctaaaccacccgcatatccggtcagttggccattttttccaacgactcgatggcagggcacaatgatcgaaatcgggttcttgccattcgcgagtccaacggctcttactgccttagggttgcctattgcttctgccagttgttgatagctccatatttccccataagggatcttgcatagtgcgtgccaaaccgactgctgaaatgccgtgccgctggcggccaacggtagctcgaattgagtgcgctgacctgaaaaatactcatccagttggcgtatcgttttgttaagtataggacattctttcacatagtcgcccaaatgctcaggttgagtcgtttgggtagcaaaccatacgcctaataagccttgagagctcgcttgtaaggtcattggcccgaggggggatgagtagtcagtaaaatggctcatttagtggctccagcaatgaaaagtggcataactgccccaaggggcgaccgattcggcagttaactgaggaaatttcgccagtgcttttttcacgatcaaatctccggttaaaaaacagtggctacgtgattcaccgcgcaattgcgcgtaatcgacagtccaaggaccaatcccgcttagcgataaccacgccattggcgaatccataggatgcaaccggacgtagtccgccaaacgttttaaggtttccttacgcctttccggcatacgtaaaaagcttaagtcgctcatttgcacttgttctggggttgggaaataacgtgttgacccttcgctagccgccagcgtggagactaacaagttcaattgtccaattgcggctttgactgaaacttgttgaccgagcactgcgcgcactcccgcttcccatgcattccataccccggggatacggatcccggtgcgccgtaccaatcccggagctaactgctctaaatgagcctcaatactgatcaggtctgcatcgagatcaaacattcgtcgcagccgagcgactaagtggcgaagatcactcaaacgctccatctcaaactcaatgtctaagtgcgactgtgccatgctcgccttaaaccatcctgtaccttcaccaaggacaaaatgacgttgatagctctgttcatcgatcagctccatgccttcaatcgctcgcagacgataaaaatccaacatatgcgcccagtcaaaagggccgcgaaaagctaagctcagatgatttcgagaaggaagagcggctcgttctcgccgaacttgggtcggcgtcaaccgaaataatttttggaacgcatcattaaaacggcgggtgctctgaaatccactggcgtaagccacttcggtaatcgaaatttggctcgtatgcagtaattgtttggcaaacatgagctgctggatctgcgcatattgtttaggcggcattcctaaatgacgctgaaaaagctggcgcagataacggtcactgatacctaagcgtgaggctaaagtctctaaactgccgtccagctctccctgctcaatcagagtcaaggcacgtagaaatgtggtttcggctcctttccacgcccatgaatggggagcgctttcaggccggcagcgcaaacaaggtcggtagcccgccgataccgctaacgcttgcgaggaaaaatactcaacattctcttctttcggtaggttggctgggcaaatcgggcggcaaaaaatccctgtggttttaaccgcaacaaaaaaacgcccatcaaaccgtggatctcggctcatccgagcgcgttggcacacctctgcggataattcattaagcaatgtcatccaagcctcctgctcgcttttttgttcagtctacccagttccgctgtctagactagccattttcggaacggaatgcagagactaagccgcaaaagtttcttcaataattttgaacaagagcatcagcctaatgggattctctgcgcaaggctcatcccataaacttcatttcatcaaacatacagaccatttgagtcgttcgaaaatttcaacccagtctatcagcgtatagcctgagtcaaccgagaggatttattgatgaatactttattaaaaactgctttaacttcaccaaattcatgggcccccctagcactgcgccttcccctagccatcatttttatggcgcacggtgcacaaaagttgtttggttggttcggcggttacggccttgaaggtacaggtcaatggatggcttcgattggcttagagcctggtgtagcgatggcatttctggccggaagtggggagttttttggcggattagccattttgctaggtctgctgacacgtcctgccgcactggtactctccgtcaccatgctggtcgcgatttttagcgtgcactttagccacggcttattcttaagcaacggcggttacgagtttggcttggctctgttggcaggctctgtttcactgctgatttcaggtgcaggtcgtctgagcctcgataatctgctactaaagcgtctggcataagtcacttcaagcataaagggggaatcgtgttaagcgattccccctttctcgtacctaagacttaatcagtgatcaatcacacggcttccactttgcccaccgtacgcaccacactgaaaggatctaacgttttcatcaacttctccacctgcactatcgcctcaatggaagagctgtttttgcgatagctcagataaagtgggcgctgccaatcattcacctcggacacacgatgtaattgccctgcatccaataagggttgcaccatggtttgcggtaagtaagcgctgccccctttctccaaaatgaaatctaacgcaattcttgccgtcgacgttcttaaaaaaggcgctggcgctttagggtggcggtcggcatgctctgaagcaaaacgtgcgccccaatcgacataaacgtagcgattttcaaacacgctatcggcatcgtcaggcttggtggataccaacacgagaaccaaatcagccacttttttgcattgcaattcttcggctttgatcggatccagagcgaaagccatatccaaagtgcgctctagcaaaccacgattgagttgctctcgccccatcacttccgccaaaaaaccatagccttcaaatgtatcggtgatgcggcttaaacagtgctgtaagtaagcatcccaaatgttaggcgtaccgcctaatgtgagctgcaaagccttaccgctttcaagcgataattcaaatttcgcctgctgcagcgttgcaaccatgacctcagcataccccaccaaacgctcgcctgctgaggtcaatttgatgttgttacggtcacgggtaaacaactgagcatcgaaatgattttcaagttgcttgatgcgcgcactcaccgccgcttgcgtcaaatacagattttcagcagcacgaccaaaatggcgaactttggccagttcaagaaaggtgcgaaagacttttacgtccatatagtttcctctgatgttacccgtgaagattaacaagtaagaagtattatgacgataaaaaatttttgtttttcttttccgaagattacgcctaactttcgccgtgacccacggctacaaggtggttgaacatattcacacgaggttgacatgtctgagacagcatttcgtcaaggaaaaaaacgttttttcgatactaagaagttcccaagaggctttgctaaatctggagactttactctagcagaagaggatatcctaactcggtatggcgacactatgctcggtttggagagtggtgagctacagcccgaaaatgccgatgaagaacattttctaaaagtgctcgcaaacccagagttagcagaaaacaaattagagaaagcttggttgaaatacacccgtctggctcgtggccgcaagcgtttccataccttgaatggccgcaacaagcctgatggcgttgaagattacaccgacgacgaaccaagcttgactgaggaagattaatctttccttcgggctacataaatcatttgtagccctctgacatggatggacgacgattggcgtcctttgggaggaaagatgcccaacccagtttctaacgtttattctcttgaagagatgttatcgctgatccagcgagagcagcctttcgccggagagctagaatccgctggctgttttatcaagatagaagactatctgcctgtggtttgtactgctatccatgcaggaagccgtttacgcgaagatttgctcaaacagtgccaactgagcaaaacggaacgtaatcttgaagaagcaccttataccgatcaatttattgcctcccagcctatcactttgtgtggcctcgattctcgcttcgagtacgatctgaaccgcgcgaaaaccctcagtacccgctataaatctgcctggaatcgccctttgagcgataaacagcgtacagagagccatcgtaagcacagcgagttttatcaactctatgaggcgttaatccgcaaacttgaagcgatgcatggcatggtgattgtgtttgatatgtacgcttacaactataaacagctgggtgataaacccactccagtgtttaacgtgggtaccgcacaaatcgacatgcagcgttggggctccgtggtgaagcgtttctgtgctgaactgagtaaaattcagctaccgcacatcgaaaatagcaccgaaatcaacgcggtatttgaaggccgtggctatttaattgcccataccaacgctcattttgaccgaacgttagtactccccactgaagtaaaaaaagtcttcatggaggaggatactggcactgtctatcccttggtgttaaacgcgctgtgtagcggccttaaaggtgcattgagccaaaccagtgcctattttcagcgtcgtcataatcgtcgccgaataagcaaagcaaaaatgcttggttcatccattgaacccgcgattttgagtattgatgatgcgctgtctaaactgacgcgcaaagttgagacacttaaatacgtcaacccaaccaatatcaatattgagcaaaagcgttttgaagcggcaccgagtcgctacaaacccgagtttcgctacaaacagttacccatcaatgccaatgaatttaaacagcaactgtatcaattgccaatcgagaccatttccgatcctgatttgaaacagttgtacggctcgatggtcgataaactgagcgaaaaaatcgatctgctcaccagcataggtcaggaatccttcctgtataactcgctgcgtttttatggccgaccgaatcgtaccgcgatagaaaacgcgaaatttctactctacgccaagacgttaccggaagagaaaggcgagttgtataacgcggatcaagccgctgaaattatgctgaaaaaagcacaggaatggggtatgcattgccatattacgcccacagcatcactggcagcgcgggcgatggtgagtggcaaaaagcctccaaccttatatctcaatagcaaggtgatgtactcacatgcagagatacagcgcctaattcagcatgaaattggcgttcatctcgccaccacctttaacggccgtatgcaacctttgcgcgtgttttcgattggtttacccggtgcaactgagtcacaagaagggttagccattttggcggaatacaaagcgggttatatgtcgcatgagcgactcaaaaccttggcaacgcgagtgttggcggtcgattccatgcttaaagagcacaatttctaccaaaccttcagctacttaaccgaagagtatggtgtcgatcgagaaagcgcctttgtgaccaccacacgggtgtatcgcggcggaggtttcaccaaagatcacctttatcttgaagggtttatcaataccttgcagcaagcacaaaagcgcagtttagataatctgttggtcgggaaatgcagctatcaatatcttgatttaattgatgagctggtcgagcgcggttggctgattaaaccccgattccgtttcgatgatttaggcagcgagccagagcccaccctcaaatatttgattgagtcgctacgccactaactcattcgataaaataggatctttctcccaaagccctgaagcaggccactgctcagggcttttttagggagatgaatcagcactatatccaaatgacttaaagcatcaggtaaaaaatatcctgcattatttcgccaatatgctcagttttttcaggaaactgtcacgtaagtgctcctgctcataggccaaatggtaggtattgtggaagccaatcttcagctcaacaccgttaccacgcatgaagatgttgtagccatcataatccgcatacgcttcaatcccttcatagatcttgccaaattcagtgggtgagccattttccattaccgtttcatacgccgataagactttgctcggttccagttcatttttcatgatctttttcctcgacatgtgcccataatcagtattggcagttaggcgccagcttgccagtttatgatctgcgtcagcgcaaaaaaacacttaattttggccataaattttttgagacccgttatattggacgaagcttatcttgataggacaaggctctagattgccgaacatccacccgattcaagcctattggttggccgcttttatcaagactataattttttgacctaaaacaatggcagttcaattttacttattttataatgcaaattaacataaacccactctgctttgtttgcactagggcactcagtaggaagggaattgcaaggcatcataaattcaaatctaagggcaatacatgagacttatcccactgaaagcggcagcacaagttggtaaatgggcggctgcacacattgttaagcgtatcaacgagtttcaaccaacagctgaacgtccttttgtattgggactccctactggtggcacaccactcgcgacttataaagcgctgattgaaatgcataaagcgggtgaagtgagcttcaaacacgtcgtcactttcaacatggatgagtatgttggcctagccgcagaccaccctgagtcttaccgctcattcatgtacaacaacttcttcaatcatattgatatccaagaagaaaatatcaatctgctgaacggtaataccgatgatcacgaagcagaatgcaagcgctacgaagacaaaatcaaatcttacggtaagatcaacctgttcatgggtggtgtaggtaacgatggccacatcgcctttaatgaaccagcgtcttctctctcttcacgcactcgtatcaaaaccctgacggaagatactcgtatcgctaactcacgtttctttgatggtgatatcaatcaagtgcctaagtatgcactgactatcggtgtcggcactctgctggatgcacaagagatcatgattctagtcactggccacaacaaggcactggcactacaagcagcggttgaagggagtgtaaaccacctatggactgtctctgcactgcaactacaccctaaagcggtgatcgtgtgtgacgagccatcaacccaagagctgaaagtgaaaaccgttaaatatttcactgagttagaagccaaaaacatcgtaggcttctaagataaatctcaatcaagctaataaaaacgccccgatattcgggggcgtttttattgctatctctcctcaaacgactacgagttgcgacttcaagtaagaagagcctcgatagaagtagagccttttcctcattatcttttgtcaaacgggaggctatcgattgggccttgtgagaaatccagtcgctcactggcaacatgaggcaagtcattgagagcattaggttcaattaaatcaattaaagactcggcttcttgctctgcgagaggatccaccacatctttcgtcggaatcgggatctggcgtttatacagtttattcagcgcacgaatcatcgaatgtttagtcaccgaactggtggctaatttacgttgcaacggtttggccaaggcttgtaaaccgacaatcgattccactccgagcttaccccccaccaaatcacgcagatttttcgcaggctcataccccatagaagccgaaaggaacaaccaaatatacgcaattgctttaccgtgagcaccacggtcaatccacgcttcaccggcatgatacatggcttcagggtgccctttttctgaggcacgctctaaccaataacacgccatcggaaaatcactggcgccaccaataccatgtagcaagttttgccctaatctcatcatgccttcggcactgcccatacgagcggccttttcataccaaaacgtcgaatctgaaggcgtcggagcaatgttatctttcgacacgcaccatccgcccataaacaaaatcgcatcaatgaaattggcttctgccgcttcttgaattagcccaataccacgcgaaacgttaacttccaccccacgaccgtatagccatgccatgccagtttcaaatttggcagccagatcgccttcaacaccacgcacacaggtttgccaaaatttggccttctctttcgcaatcacatcttctcggatccgctgacaaacccgcacaatgccgtacatggcggggatattgtcgagatgggcggctttttcataccaaaacaaggcttcttttaaactgttgcgttccgcctctttggctaaaaacaaaatggttggaatgtgtccggattcggctttaaacaatctttctttgcgctcttgctctcggttacgctctaacgctttgcgatacgcctcttctctggctctacgttcttcctctaaccgcttacgtctgacggatagcacaatcatccagacaaaaatcaggataagtgttagcccggtagcgccaatcgcaattccgataatattcatagtttctctaactaggtcactgcctttgcctgcgcagtttgaaggctggcaaaactaaacgatggttgaattgtactttacatccaacgtagaaactatgtgcgataaaaaatgggtggagatcctccacccattttcgtcggtcggtttcattatttgcgagcattaaccgctttcacaaacacttcttgcgcaccttcaattcccagtgctttcgcttcatctaatagactcagcgccttaggtaaatcattcgcttgcacagctcgctctatggaggagaagtaataggtttgcgtatctggttgaacctgaatttgagttttcgcagcatccgttgatgttgtagtttggcgatcttcactgcgtacaaaggataagaaagaaggaccagagacatccagctcaatcgttccggttaaggtgtgaggtactggaatatctttcacttccggcagatagtttccccgtgcctcagcatcaatcctcgcaggatgcgcaacatacgtgacaccttttaagtcttgctgtttggtgtaaaccaaaacaaacaacgatttgtaaccttgcggtggatagaaatccaactctgcgactaagcgattacctaaatgcaaacgcggtttacggtactcaaaagtcacctcttcataggattccacgacttgaccttgcgcatcgacaatcatcacatgcgggtaaaataccgaatcgctaatctcactggtgatcgtcaatgtcatttggccacgatccgcggggatctcaaacaatgcgacagggcttgcaatcacctgattgcgcaaatactgcgtttccttggtcaacgccaccttagtcgtgctaggtaatttcaccttggtcgcttgcaattgcccaatctgctgaacctcctgccctgtattaggctttacttgctcaacaacagctgtactctgacaacccgctaatgcaatacatcccccaagtaataaagctctaagcaccataacgactcctttttatcatttttttaaagactctcatcaaacctgttggcaagaaaccataagcgcacaaatttgtgcgttacccccaaactagggtgtcttatggcttcacatattgaatatgatatgagccttgaaaaaaatagccgatctgcatcggctatttgaattatggacaataaacgttaaaggtcagtgggttaattaccaccaagcttcaacttggatacccactacaaactcagtatcatcatcgccaaacgctttgtcattttcagtatctagaagataagtaccgtagacacgcagttcaggacgtgcccagaagctgtctcccatagcccaagcttgtgctactgtgaatttagcattgccaaaatcttccgtagctaaaccaccgttagaaattttctcaccagcattgtatcccgcttcaaacacagtgcgcatggtgtcattccacttatacattggacgtactactacagaatattgatcaatatcgaagctcttacctgtataagtatttttattagcgccatcaccgccaaactgaccaccaatatcactacctgctaagtaagctaattgatgtcccatttcccaattttcgcctaggttaattacaccccagtttaataaacggaaacctgacgcatcattaaatgcctcggttcctcgtgcatagtaagaaccagcaccccaaaaattagcagcttgagcgccataacccgctgtaccatattggaatacagtttggttaaaaccattgctcaggccttgatgtaaaatagccgaaactagaacaccatcatcagcgacttcatttttactgtctttctcagtggcaaagttgtaggccattgccagttcaagagatgcgttttcccatagaccaatattcgctagacgagcatcaaagatgtaacctgaagaattcgtattatcgccatcttgaaccaaagcaacagagagtttttgattacccacagaaaggttttcaataccaccaccagtgcccgatgtgtttaggaagtagaagtcagtaatgtgaatgtctttacgttggtagtagcgtttacccgcccacattactgcttcttggtcagaagcaagtaagcctttagcctgaacgttgaactgtgctacgttaaaatcgccatcttcccaaccatttgcgccgctattgccttgcgcaatcattgactcgactttccacgtctgttcaccggttttcagttcttcagcaaacccaaactcatagtagttgtcgttttcgttaccaagacgacctgttcctgctttgtttacagcctggtcagcattaccgttaccactaattccagtaccagcgcggaagtagccattgaaatcgacagcgaaagcagaaccagctgcgagcgtcgcggccactgcggcagcaattacacttacttttttcatcgttaactccatttagggtttttattttggattcttgaccctcttttctgtcgagcccccaaaggcagaaagttggcagcataaaaagagaggtaagacgggaacgagtccccagttgtttcaactgtggtgagattacgtgaggaggataaaaggcacttcctccaccccatttttatttgggggggaggagaaaggatgagaaaaattacagtatgttgtttttaaaacttagatcacgttatttagggggagtaggttagccactttctaaataaaccaatacaaagtgtatggaggatcactatttagccccattctcgtcattaatatgaaataaaattacagataaatatttgtgaccgcgcgcttgacctaagacaagcaaagccttttacttaataacgtggtgcgctaaaaaacgattaaaaatgaaaatgaacctgtcaacgcctttcccattaggagcaacactcgatgcagagggttgtaactttgcgatttatgctccagccaatcgagatattctcttggctctctttcatgctgacggtagctatgaaacacatcagcttgaacatgaatatgcaggggtcaaacatacgcatatttctggcattcatgctgggcagaaatacggttatttaatccagctcaatgatgaattgcattatatttctgacccttacgctcgagcgttagaagggccgctgcattatgctccgccatttgacagccataaaagttttgatctgccaaaatgtgtagtcacagatacccactttgattggcaaaacgtggctaagccgcgtatcgcccgagatgagatggtgttatttgaaacccatgtcaaagggttaacccaattaaatccggatgtagaaaaagccctacgtggcaaatatttagggttggtgagccaacctatgctggatttttatcgccagcaaaatattaatactctgcagctactcccaattgcagcttgtatgcatgagccccatctcttggaaagtggcaaggtcaattattggggttataacccttatgtatttatggcccccgatccacgttacgcaagtaaagacgccgtcaatgaactaaaaaccaccatccgtgagctgcatcgcaacggcatccaagtcattttggatgtggtgtataaccacactgcagaaggtggaaccaatggaccggtgttcaacctcaaagcccttgatccaaactactatctgcaccatggcgatcactacgccaactacacgggatgtggcaacacggtcgatctctccaaccaagcggctctgaatttagtgatggacacgcttcgctgttgggtaacagaatatcagattgacggttttcgtttcgatttagccgccaccctcggccgacgtggtgatgagttcagcaaagaagcggcctttttcaaagccgttgcacaagatccggtgctgcgcgaagtaaagctgattgccgaaccttgggacattggccccaatggctaccaagtgggtaactttccttttggttggaatgaaaccaacgacaaactacgcgatattacccgtagcttctggcgtggcgacctaggctttttgaaggagtttgcaacacgcctcatgggttcacgcgacctctacagcgcggctaactggccttacaaactgaccgtcaactacatcacctatcacgatgggtttacgctgcaagatttagtgtcttataaacacaaacacaacgaagcgaatggcgaacaaaaccgcgatggccatggtgataaccgctcagacaactacggttttgaaggtgacaccgacagtatcgtgatccgcgcgactcgtgagcggcagaaacgtaactttatggctagcctgctgtttgctttcggtattccacacattctcaccgccgatgtgctctcacacactcaaaaaggcaacaataacgcttactgtcaagacaacgacatcagctggttaaactgggaaaacaacgaaaccaaacaagattttcgtgaatggcttgccggtatggtagcagcaagacaaacctacatggtgccctttattcgcgcatttagtggcgaaaaccgtaacaataaccgtattgcttggcgtagggtggatggcaaacctatggaaatggatgactggaatcgcctctcctcggtcgccttgcatatcggcatcggtagtgatggccctgaaatgttgtatttgattaatcaaaccaacgcgccagcgcgctttgtgctccctaaagataggcagcaggattggcgtttgatttgcgataccaatatgcgccatgctcagcatggtcatgctgaaggtgaagtgttgcaactgcctgtttcaatgtcgattctgcactatcaaccaaagaaaaaatcggcttaaaagtagcgaagagagcagcaagctgcgacaatggcaacctttagagcggcaccgtctcgtgccgttcacaccaacagaagcaacgttctcgttgctttcgcgttacagagctatagaaaaacagaggaaattgaatgaaccccattctagcgatgctgaaagaaaacaatatcagtaacgagcagatcaacgagttgtttcaaactctgacccaaaacccgcttgccgccatggccacgctggcgcaactcggtcttcctcaagacaaaatgcaaatggtactggcgcaagtaatgcaaaatccggcgctgatcaaacaagccgttgaagagctgggactcgacttcgcaaaagtagaagcagcgaaagccaagctccaacaataggccactacctttatacccaaacgacttggagttgcagatagacggtgaatgagtgaatcctcataagtatagagacactctgtgattgggatgagcgaatgcaaccaacaccgctgcagcttcaactagcaagaggatagcaaaaggctatgatgaatagcggttcatacatagcctgatcctagtgtcattttttcaccacaactcacgcccaaaattctcatagcgctcaatgtctgttcacccgtgtttacaccttatcgtcataaaatctcttcacaatccgacataaaatgcgatagatcgcacataatttcgttttattaatgcaatcggtgttatactccgctgcaattcttcaccagcgttatgcaacttcgctcgtgaaccgcaacttggacagcgcattcaacatatggacgtgaccaacccgctttaccacgaggtcacagactctttatggctttcttcaaaaatttagcgataggcaaaaaaatcgcagtcgcgtttggcgtgattgccttaatcaacttagcttttggtggctacctttataactcccttcataccattaaaagcgacgtactcaatctgactgacgataccttaccttcgatgatgttggtgaacggtatcaagtacaatatgtcctccgtgcgtagagcgcaaatcagcttactttcctcaaccgatgaagcagaaatcgccgaagacatccgctggatgaacgatcactatcaacaaatcgcccaagatctgagccgctatgagcgcagcatttggaccgatcacgaacgtagcatcttcatgccagtgaaaaacttatggaacgagtacttacgccagctcggttcatttaacaacgacatcctacaaaaagagatgatcaaagcgcagcaagatctgcaacgctctctacctacgtttgaaaagttggaaacagcgattgacgaactgctgaaactcaacctctcttatgtggataataaccgcagtgagctgaccgagcttattgataacattagcgaattttctgtcgcaagcattgttgccctcctcgcctttatgagtgcggtgacgtggctgctcaccaatcttatctgcagtccactgatgcaagtcgtcactcaagcgaatgcgattgccgaaggtaacttagcgcaccgcttagatcgcaaaaccatcggtcacgacgaattaggtgaactggcagatgcctgcagcaaaatgcaaaataacctgcgcctgatggtcgaagagatcattactagcgcgactcaactggcgcatgcggtggatgaagtgagcgcggtgtccgagcaaacatcacaaggcatgcagatccagcaagaagaagtgatgcaaattgcaacagccatggccgagatgaaatcgaccgtagcagaagtcgctcgtaatactgaagtcgcttcagatgcatcacgcgacagcagccaacacgccaacgtgggttcacaacaaatgcgcgccgtcaatgactcgattcaacatgtgaatcaagagatcggccgcacagaacagcgtgtgctggagctagaaagccaagcgcaacaaatcaacatggtggttgatgtgatcagtaacatcgcggaacagacgaacctactcgcactgaacgcagcgattgaagccgcgcgcgctggcgaacaaggccgtggctttgcggtagtcgccgacgaagtacgttcgctggcaggtaaaacccagcagtccactggcgatatcgttgagatcattcaaaacttgcaagcctgcgcacaaaaagcacgcgaaaccaccaacaacagtcgtgagttgatcaaccactgtgtagagcaaagccaagaaacacagcaagcgattgagcaaattcgtcaccaaagtagccaaattgccgatatgacaattcaaattgccagcgcctgtggtgagcaagattcggtgagtgaagaactcagccgtaacattgagcgaatcaacgagtcagccaagcaagtcgcacagggctcctctagcgctgctcaatcttgcgcagaactcagccagctagcgagccagttgcaagatacggtacagcgctttcgtttgtaatagttcgaacgaataggtatttgatagggcgatgatattcatcgcccttttttatctctaagtggaatgccgaacttatgattcaagccactctcacagcacatcaatccagattcagttccaatcacattcaatagttcttatcgctgccgcatcctcgtcaaagcaaacataggcggatttagcttggtgagcgtcaaagctaacgtatcctgccttgagatcctcttttctaaatgaaagttgagttgcttcaacttctcgcccattaattaatgtcgctttaagccgtttagtgagccaaacggccactttttgctgatgttgagatagcgtcaaggaaatttcggcgcagcgcaatggtgggtttggtgatatggtcttactgccgtcatgttcaaagacttggtagccccgatccacatcctgcagttgatttattgtcacctcacaaatcggtgctcccattgcgttcaaggacaccatacccagtaaaactgctgtgcgttttctccacaccattccatttctccatcacaattttgtgctgagagtaacccgaacgcttccagaacgctgtcaaaaaatagtgaattgccgtttagctaaacaaaacatctgcccactattcccgccccttccctgtcgtgtttcaaaacatatcgggcgagaaataaatcaagcggcataacggttgccgcttgatttctaactaggctctccactttaagctgtcgtagttttacctacctgcaatgccatatggtttgaacacattgagtcgataacttattccgacaatattgtggcctccgttgggggtacaggatcgcttgcaacgacaggagcaatatcaacaacaggaagtgtatttaggcgcgtcgtcggagatatgggctcaacacattgacactcttgttctttcgctttacgagtttgatggggagcgtaccagcgttttaaaccttgctctaggcgctctgccgcagcggttggtgtcattttgccaaccaataccgcttggctcacttcggcaagctcatcacctaacttaggttgaccacgcgaaagaatttgcgttgcgacccgaatggttgagtcacattgatcgcgccactccatcatttcacgcgccgcaggattggtgacgtcaaagaagtggttagacaacgagaaaaaccccggtagcgaattggtatacaactcagcaaactctggtgtggttaaccattgtaaaaaggccatcgctgcttgcggatttttgctggccgggttcatccccataccgatgtcagtgtggtcagtaaagaaacagccatccccttgctttgcgacaggagggcgcataacgccaaaatcgactttatcggtaaatggtgcaatttcccacgaacccgccacataaagcgcggctttacccgaggtaaagagctcattactggtgccataatccctcagctcaccgtcctcacctaaataggctcgccaacgcgctagctcttcaaacaccttcacgtactgtgaatcgtccaaatgctcttggccattaatcaaagccaaacgaccatcttcccctttccaataattggggccgatattttgatagcccaattcagatgcgacccagctttcagaaccactcatcgataaggggatataacgtccatccgctttcactttatcgagaacggtaaaaaactgttcacgggtttgcggcacactcaaccctaactcattgaaaattttcttattatagaaaaaaccatgtatcactgaagccatagggacacagaaggtttgtgccccagaatcggtttgccaaggcgcttgggcaaagctcgggaaattttccatcccagccatttcggtgatttctgccaagtgcccggctttgaaaagtgccaaagaatcatcaaacgggcggcaagtgatcaaatctcccgcttttccagcttttaagttttcccacaacgttggcgtatagttcacattcggcactgggttaaatttcactttgatgccaggattcgcagcttcaaaagcggggatgattttttgctcccacagcgccttatcatcggcgcgccaactttcaatcaccaattcgctggccatcaactgacccgatagtaggagacctagagctccaatccacttgttcgtcataagccctcctagaccttaaagtgtgcaatgagttgttgctgcttagctgcaagatcagccaacacttcactgctgctggcggattcacgcgcttcacgctccgtttcatgggcaacttctgcaatcccagttacatggtgcgcaacactttgactgactacgatttgctcttgcgccgcatgggcaacttgatcggccatctctttaatcgctcccatacgatcagcgatcgattgcagcgcagaatccatttcccttgtctgctcaacacaagcacgagtttgctcttggctgcgccccatcacttcgaccacttgcttactcgactcctgcaagttctcaatcatatgttggatctcttcggtcgaggtttgagtgcgcgtagccaaagcacgaacttcatccgccaccaccgcaaaaccgcgtccggcatctccggcacgcgcggcttcaatcgccgcattgagtgccaacaaattggtttgctcggcgataccgcggatcacatccaaaatactgccaatgttattactaaactcgcccagtttatgggtaatgcccacggccgattccatatcactcgctaactgctcggtaatacgacgtgtcgtggcgaccttttgacgcccttgttttgcttctgcatccgcgcgatccacctcgtctttcgcaccatcggttgaacgcgctacttcggtggcactgacttcaagctctgtaatggccgctgccacttggtcggtttggctcttttgttcttgcacccgcgccatagcgcgttcactgatctccgctgagcggcttgcttcattcaccagatggcgtgaaccggcgttgatttgtgacagcagctcaccggttttgtccgccagaatgtcaattgaacgagaaagcgccccaaactcgcaacgagttgggtagttaatgcgccgtgtcatatcgcctcgagccatataagccagctcgtgattaattttttgcaacggcttttgaatactgcgcgccgtggtgtaaccaatcactaacgcaacagcagcagaaatcgccgagaccgccataatccagaaattcgcactgctcaccgcagcatccgccagcatacgactttgctgagcaattgagccggcatatttcgccatgtcatccagtttcgctaagctactggcaagactggcatcgacctgttggttttgaatgagcagagcattttccaactgctgcgctttacgcatggttgccagcaaaccattttggcccaaagcgagctcttgtaggcggttgaggtttgcgatgtagcgcgcttttacatcgtcaggaaccaatacacgatcgagtcgttttctcgccatttcgatgtctttactcagaactttttccagttcatttaaatctgtcttggcatccgctcggcgaatattttttaaatcgcgggcaattccagacgtgatcagctcagctttgttacgcatcgaacgttgacccgagctctgttgtaataacaaatcggcggcccattgataggtatcctctaagcgaataaaggcaatttctaatttgcgacgctgcgccagcgcattcacccattcactatgttgagtcagtacttgatccgcttggctataaaactgattggtggcctgtaacacatcttggaactgcttttggctctcggttgaatccgtcaatgcgttcatttgctgactcaattgtcgaaagcgtgcttgctgatctttgaacttgttcgacagttgggggagctcaccagcctcttcactagtgcgaaattccagcacccaacggttgctctcttgtaacgcttccttaagacccgcaaccgccatcactaaaggtgtggctcgatctgacacttctgataacccatcgttaataccgcggattttcaaagtactaatgacacctaataggattaacaacaggagcatcaatacgaagccagcgataatgcgctgcacgatagataaacccatgaacctatcctcatgattcaatgaaaagatacgttaaacatagacagattaaataaaagccgcgagttggacatcacgatttgtgacacgcgcttttcgcggttgtttaaattaggaaggcttggtatgggatattggcctacttgaaccctacgcacgctctgtctacaatggcgcacttttatcgagtcaggtcacatacaatgaacaacactacagcaaaacccaccctacccgatcgcttatctggtaattcacgcagcccattctttatcaaagagtgctttgagcaccaaatcggtatccgttttaacggtaaagagcgtaccgatgtagaagagtactgcatcagcgaaggctggattaaaattccatcaccaaaagcgaaagatcgctacggcaaccctatgctgatccaattgaaaggcacggttgaagcttattacgtgtaagtattcactttcgtacaaaggcatatttttattgcttgagtcgtaaaaaaaccgcctctagaaatagaaaggcggttttttattttcgttcgcttatcgctgacgacgcgcttcaatcgcagcagccagttggcgaagtactgtttcggtgtcttcccagccaatacacgcatccgtgatggattgaccgtaagtcagattacaacctggggtcagatcctgacgtccctcaacgagatgcgattcaatcatcaccccgaagatagcatgctcgccttgcgcaatctgcgccgcaacatcttccgccactaccatttgacgtttgaactgcttagagctgttcgcgtgactgaaatcgatcatcactttctgtggtaagccagccacttccagctcttgcttgatattgctcacgtgcgccgcgctgtagttgggttctttaccgccacgcagaataatgtggcaatctgggttacctgcggtttcgacaatcgccgaatgaccaaacttggtaacagacaagaagtggtgagaggcaccagcagagcgaatcgcatcagacgcgattttaatgttgccatcggtaccgtttttgaaacctacagggcaagacaaccccgaagccaattcacgatgcacttgtgattcagtggtgcgtgctccgatcgcgccccaactgatcaaatccgccacgtactgcggcgtgatcatgtcgagaaactcactcgcggtcggcatccccatgtcggtcagatccagcagcaatttacgccccatgcgtaggccatcattgatctcataagtgtcattgagatacggatcgttgatcagacctttccaacccactgtggtacgtggcttctcaaaatatacgcgcatcacgatttctaactgaccactgagctcatcacgcagtgcttttaggcgctgaccatattcaatcgctgctttcgggtcatgaatagagcatggaccaatcaccaccaacaagcgatcgtctttatcttgcagcatgttatgaatcgcttcgcgcgcttgaaacgtcgtggacgacgccgtttcggtcgctgggaatttctctaacaccgcgactggtggcagtagctctttaatcttcttaatttttacatcatcagtttgaaacatcgttacttcttcctttactttctggttaccttgccagtcaacggctccagccttggtaatcactgcacctgtcgtttcttcgggtaacttatcggcacttgaaaaatatcgcaagcactatttttaaataaaggcaagattccacttttctttacaggaaaaacaagatgtaaataataaattacaccctattgagtaagccttagccactcaaaaaacggctcagtaaaaccgaatcaattaatgcattgtgagttttatgttgctaaggtagggcaataagaatcacaaagataacaagatgaaagtgatagagtttcaccaagtcagcaaatggtacggtcaatttcaagcgctcaaatcgatttctcttacggtcaataaaggagagattgtggtgatttgtggtccttccggctccggaaaatcaaccctaatccgcaccgtaaatggcttagaaagtattgatagcggtgaaattatcgttttacccgaattggatgaacgcacgcgacgcagcggtaagatcggcatggtgtttcagcatttcaacctgtttccacatctaaccgtattggaaaatctcaccctcgcgcccatccgcacgctcaagctctctgcgcaagaagccaaggagcgtgcttatcattttctgcaacgggtgaagatcaccgatcaaacacataagtacccgattcaactctctggcggccagcaacaacgggtagcgattgctcgctccctgtgcatgcaaccggagattttgctgtttgatgaacctacgtccgcgctcgatcctgaaaccattaacgaggtactcgaagtgatggtcgacctcgcgcaagatggcattaccatgatgtgcgtgactcatgaaatgggctttgcgcgtaaagtcgcgcaccgcgtgatgttcatggatgaaggggaaattctcgaagtgggttcacccgaacagttgttccaaaacccaacgcatccacgtacccaacaatttctcaatcagatcctgagccattgatgataaaacgctttttccgccctctgctgtttgccgccctgcaaatgatgttagtgtttgccggattggtctggctactcgattccggcgcagaggcgatgggctatacatggcagtggcatcgcgtgcctgagtatgtgttgatttttgaagacggcgaatggtgggcaggtgatttactgcacggcctgttggtcacattgcagctcactgggatcagtttgattttcactttggctttgggtttaaccaccgctttgctgcgtcagtcacgttcactggtcgggcgagctttaggcaccggatacatcgcggtagttcgcaacacgccgcttttggtgcaaatttacctcctctactttgtgtttggccccgtcattgggctcgaccgctttgccaccgcggtgcttgccctcgctctgtttcaaggagcgtataccgcagaggtatttcgcggcgggttaaacagcattccgcaaggccagtatgaagcggcacgctcgctaggcttatcgcgcttttttaccttttacgatgtgatcctaccgcaacttctgcaacgtacattacctccactgaccaatgagatggtgtcgctgattaaaaactcgtctattgtcagtgtgatggcgatttttgatctcaccactcagggacgaaatatcgtctcggaaaccgcgatgccgtttgagatctggttcagcgtcgcggcgatctatctgttgttaaccctgactctatcagcgttatcagcttggctagaacataaactgggcgcgcagtggcgctcaccataacgcgaaaaaatgcgcgaaataaaaagggaactcttatgcaattattcggacaacgtttaggtcgattcagcgttaaaaccttacttacgggcttgttgggtctggctttcactttgccagcagtggcgagcgacacacccaatcttgatgcgattaaagagcgtggcacgctgcgcgtgggtatgtcgacctttgtgccttgggcaatgcgcgataagcagggtgagctgattggctttgagattgatgtcgctaaacgcttagccgccgactcaggttggcaagtggaatttgtgccgaccgcatgggatggcattattcccgctctgctggccaaaaaatttgatgtgatcattggcggaatgtcggtcacgcctgagcgttcaaaaagtgtgctgtttactgcaccctactcacactctggtgtgcaactcgctgccaataaaaagctcgcggaaggttttactcagctcgaagactttaataagcgcaacgtaaaaatcgcggctcgccgaggtgcttttaccgtgcaagtggcgcgtgaaaccttcccgaaagccagcgtgctgcaatttgatgacgatgcccaagctttccaagaagtaatcaacggcaacgcgcatgcggtgattgcttcaagcccaaaacccgagcatgaaagcatcaaacacagtgattcgctgttccttcctttcagtgagcgtttaagtaaaggcaatgaagcgtttgcagtgcgtttaggggaagaagataagaaagccttttttgatcaatggattgcggaccgcactgctgatggctggctgcaagcgcgttacgaatactggttctccactttagattggcaggatcagatcgcctcaggtcagtaaatgaataactatggcgcaaaatcctcctcgggctatcgttttactttgctggatggcggattactgctcgcaatcgccagcctcatcggctggctctattaccgttcggaagtaggcattcactatcagtggcattggcgtgaagcgtggacgctaattttcacgccgcgtgccgatggcagcttgccctacttcttacaaggcttaggcgcaacgttacgtttaagcttgtggggcatggtactggctttagtgttagggtcactgatcggcatcgcgcgcagccaaaaggcgtggtttgtgcgtttacccgctaacgcatttgtacagctagtacgcaatattccaccactggtgtttgtgtttatcttctattttttcatctccaatcaactcatcccgctactgggtttggatgagttactgcgctaccacacagcggaagttcacccgctgatcacttggctgtttggccctgcccgcttgtgggaaaacttgttgtccggcgtgttgtgtatcgggttgctctcttctgcttatattgctgaaatcgtacgagcggggctcgccaacatcccacagggacaatgggaggccgcggattcgcttggcttgccaacgtggggcaaataccgctatgtgattgccccacaagtgctgaccgccattaccccagcgctggctgggcagacaatatccctcatcaaagacacgtcgatcatctcgctgatttcgattcaagaactgacctttgtcggcagcgaaatcgccaactcatctggactaatttttgagatttggctgattgtcggcgcagcctatctggtgctttgcctcacgctgtctatgctgtttaagcaagtagagaagcgcagcttacgccatttaagccgttgaacgatgaaagacggtatcgaagcaaagccagtttagcgattgcttcgatatttttgagaataaatatcaattagactgaaacttcaaaacctcaatagacaaaggtgaccccatgaattcacaagtcacacactggttggccagagatccggatcctaagactcgtcaagaactgcaacagttgatcgatactcagcaagacgcgcagattgccgagcgctttcaatcacgccttgaatttggtactgcgggtttgcgtggcaaagtcggctgtggccctaaccgaatgaaccgtttagtgatccaagaaacggcggcgggtctggggcattacttgattgctcaattacccgatgccaaaagccgcggcgtagtgattggttacgatggccgcccagattcaaagcagtttgctcacgataccgcaagcgtgctgacttcactcggcatcaaaacctatttgacctaccaagtcgcggcgacccctatcgtggctttcggcgtacgccatttcaatgcggccgccgcagttgtagtaaccgcaagccacaacccgccggaatacaacggatttaaagtgtattgggaaaacggcgcgcaaattattccgccgcatgatgcaggtattgcggcttgtattgaccaagcggcgcagcaagcgatcccttacctcgcccttgaacaggctgagcaacaaggcctgctgcattggctgcgtgatgagtattaccaaacttaccgtaaaacgattggtgcaagcccactcttgcagcatcacactaagccgcaagcgctaagcttggcttacaccgcgatgcatggcgtgggtgccaatatggcagaaaccttactcgccgatgtcggttttactcacgtcagcagcgtgaaggaacagcgcgagccggatggcacattcccaaccgtcaacttcccgaaccctgaagaagcgggcgcgatggatatggtgatggcactggccaaaaaagtcggcgctcagcttgcttgtgcgaatgatcccgatgcggatcgctttgcggttgccgcgcgtaaagccgatggcgaatatcaaatgctgaccggcgatcaagtcggctcactgtttggtcactatctgctctcgcaaaccgatgctcatcgtcaactggtcggcaacactatcgtctcttccagcttgctcagcaaaatcgccgcagctcatggcgcgcgttattaccaaaccctcactggtttcaaatggttgaccaacgtggcgatgcaagagcaaaccgagcagcaccaattcctgttcgcttatgaagaagccttgggatacaccattggtagcacagtgtgggataaggatggcttgtctgctctggttgcgtttgctcaactggcggcagagctgaatgcgcaaggcaaaacggtatgggatcagcttgaagccctgtatcgccagcatggcctgcacgtgaatgcgcagcgcagcattgcgctggatccgaactcgccaccggtgggtgataaattgcgtgccacgccaccaaaggacattgcaggacgtaaagtgctcatcgtggaagattttaaactggcacgccgcacctttgccgatgacaaaaccgaaacgattaccctgccaaccagtgatgtgctcatttaccatctggacggtggcgctcgcgtgattgtgcgcccatcgggtactgaacctaagctcaagtgctactacgaggtagtgacgccgtttgcggctggggaagattttgtgagcgcgcaagagcgggccgatgagcagatgtcgctgctgattgcagagcatcaaaccagcttgtaatctcccaatagatatatgcactaagtaaacaaagagagatttatctctctttgtttacttaattttcaatggcaactttggtctctggaaattcaaccacttgatgctgatgtaaagagtttatatcacctgtaaaacgaccgcctggctcgatactcaaatcatcactacacaaagtgccgttaacacaacccttgctgaaaatctgtattttttctgcgtgggcggttccttcaaagaagccattaatgattagatgttcggcaaacacttctccatgtatcgtgccactttcactgacaacaagagtcttatcgacatgtaatttaccttcaactaaaccatcaacttgaatgcagttttctacctttaactctccggaaaaatggcttccttttgcgatgagagttgtagctgagagctgactctttgctcggcgttgtttactaaatattcccatcttattcctcttactttagtaaatatagtttcaaaattattgatttcccaatcgacaaaaggcctcggatctaatggcctaccaataaaacgaatctcataatgtaaatgagggcctgacgacaacccactattgccagagtaagccaataagtcaccttttttcacaaaatcaccatttttcacaacaaatttatgtaaatgtgaatacgaactactgaatccatacgcatgtaacaagcgaataaaattacctgatccagttttgcttatacgagttacttctaccacgccatctgcagtagcataaatgggggtacctatattgaccgcaaaatcttgccctcggtgtatttttagttgacccgttactggatgtatacgcttaccgtagccggaagaagtgcgcgcccccagtaccggagaaccacttggaatttgtgccaacattaatattcgtagtgaggaagtaagtgctgcataatctaaacgagattccagttctgaatcggtttcatttacaccaagcactttctctaaatcaccgaggcgctcagatactatctggctcctctcttcgtgtaccgctaaatcactttcaaggttttcttttagctcactaagtgaagaaacctcttccagtaaaaacactgactgactttccagctctttctgtttgagtttggcaaaatcaacttggttttttagataaaaaattacgccaatagtagtaccccccccactaatatgatgtaccccatacttttgagagcgaagcgaaatacttttcctaaataaaaatgctgagttccacggatagaggaaacagaaacaatcattctttctttcataccaattcatttcttcatctggatcgcaaagttgtgcgtatgacattatccatgtctatttgtatgaaagtcatttaagttaaaaacaaccttcatctgtactatgtgtaggtcttcctacttacgtatagtgtacgttcataggtaaaaaaaccatttctgtagcttaattacaaatcgaataaaaatggaaggggagatggataatgccgatcaccaagaaatcaaaaagagtgataaatatcaattatttttaatttaaattaaaaataacaccgaaacatgacacaggtcacactatggcccgtgtaaaaaataacaaaaacgagatttacatcaacttaaaaattattgacaaaataaaaaataataatttaccaaaaggacgcgtgaaaaaagttgaaatagatcaccataaacctgtgaataagtacaaattttagcgacgtaagtcacaaaaaacccgttggtgattccattcgaaatttgtgtggtagagtgattgtgtactaagcaatcaacggtttttgccgaaccgttactacgattaaattcaaacggaacatccaacgggggacgcgatgatatcatcagacgccaaggtcaagatacaaaattttggccgtttcttatcaaacatggttatgccgaatattggcgcttttattgcgtggggctttattactgcgctttttattccaacaggctgggtacccaatgagacgttagcctctttggttgggcctatgattacctacttattgccactgttgatcggttataccggcggtaaactggcaggtggcgagcgcggtgcggtagtgggtgccatcaccacgatgggcgtgattgtcggtaccgacattcccatgttcatgggcgcgatgatcgtcggtcctatgggtggctgggcaattaaggcgttcgataaaaaaatcgatggtaaagtgcgcagtggctttgaaatgttggtcaacaatttttctgccggcattatcggtatgctatgtgccatcatcgctttcttcctgatcggcccatttgtgaaagtgctgtcaggcgcattagcggctggagttaacttcctcgtgaccgctcacctactccctctgacgtccatttttgttgagccagccaaaattttgttcctcaacaacgcgattaaccacggtattttctcaccgctgggcattcagcaagccagtgaaacaggtcaatctattttcttcttaattgaggccaacccaggtcctggccttggtattttgctggcgtacatggtgtttggtaaggggacagctcgccaaaccgcgggtggcgcgaccatcattcacttctttggtggtattcacgaaatctatttcccttacatcctaatgaatccacgcctgattttggcggcgattgcgggcggtatgaccggtgtgtttacgctcaccgtatttaatgctggtctggtatctccagcatctccgggctctattttcgcggtactgctgatgactaataagggctcaatcttaggtgtagtgtgttccatctttgcagcggcagcggtttcttttaccgtcgcagcgctactgatgaaagcacaaacttcaaccgagcaagatggcgataaagacgcgttggtgaaagccacctcgataatgcaagagatgaaagcgggttcaaaaggtcaagcggcaccgacggcgacccaaagcaaaaaaatcgacatggcgaatgtacaaagcattattgtcgcttgtgatgcgggtatgggctctagtgccatgggtgccagcatgctacgtaaaaaaattcaggaagtcggtttgcccgttacggtaacgaatatggccatcaactcactccctgctcatgtggatatggtgatcacccaccaagatttgacggaccgtgcacgtcaacacgcgccgaatgccgagcatatttcactcaataatttcctagatagcgcgttgtacaaccagttagtgactcaacttctggccgcaaagcgccaagcggccaatgatagtcagctgatcaagccttcgattttggccgctaacgatgaccgctatgaagtacagcagccaagcgtattccaactgcaaaaggagaacattcaccttggcctgaacgccaaaaataaagaggaggcgattcgcttcgcgggtaataaactagttgaactgggttacgtccacccagagtacgtcgatgccatgttcgagcgtgaaaagctggtttcaacctaccttggtgagtccattgccgtaccgcacggtactgtggatgccaaagatcgcgtgattaaaaccggcattgtgatttgccaatacccacaaggcgtcgcttttagtgaagacagcggcgatgtcgccaaactcgtgattggtatcgctgccaagaatgatgaacatattcaagtcattaccaccattaccaatgccctcgatgacccaaatgctatcgataaactcacctccaccaaggatgtgagtgatgtattgagcattttggccaccagccaagcggcataacgtttttgctcctgaggcaaaacgaggtcagcaacgccccctatgtggctgacctcacctcaggcggtgagagaaacattcaacattgaggtaggtaaagatgaaaaagaatgcagttcattttggtgctggcaacattggccgtggctttattggcaaacttctggcggatgccgacattgccgtcaccttcgccgatgtcaacgaaccccttgtggatcaactgagtcatcaacaagaatacaaagtcaaagtggtcggtagcgaatgcaaaatggaaaccgttagccacgtcaccgccgtcaacagtgctagtgaagccttgatcgagcggattatcaaaaccgatttagtcaccacggcggttgggccaacagtgctggatatcattgccaaaaccatcgccaagggtttgagcgctcgctttgccgcaggtaatacgcaaccactcaacatcatcgcctgtgagaatatggtgcgcggtacgactcaccttaagcagcaggtgtatcaattcctcactaccgaggaacaacaacaagctgatgctttagtgggctttgtggattccgcagtcgatcgcattgtgccaccgttgcaagcagctaacgacgatccgttggaagtgaccgtagaaagcttcagcgaatggattgtggatgagcagcagtttaaaggcgagatcccacagattgagggaatggagaaaaccgataacctgatggcgtttgtcgaacgcaaactgtttaccctcaacacgggtcactgtgtgacggcttatctgggctgtttaaaaggtcaccgtaccatccgtgaagcgattgaagatccgtgcattcatgcacaggtgaaacaagcgatgcaagagagcggcgaagtgctgatccgccgctatggttttgatcgcgccctgcacagcgcctacatcgagaaaatcctaagccgctttgccaatccttatctggtggatgaagtggatcgcgttggtcgtcagccgctgagaaaacttagcgcaaatgatagattaatcaaacctttactcggtacaattgagtacggcttaccaaacggcatgttattgaaagggattgccgcagcgctgaaatatcgcaatagcagtgatccccaagccgtcgaattacaacaaagtattgaaaaagaaggtgttcgctctacacttgcccgctataccgggttagccgccgaaagtgtggaagcacaacaaattgaagctctctaccaacagatggattgaagtatcaggataaccgtttgaaaaaatgcggttatcggtagtcttaaaatgtcgagagctgtcactcgctctcgacttaactcaacaacagatcagtttatggcagaaaaaattaacgaatccgacattctggagcgcttgaatcagacccacacggtacgaggattcttcattacaacggttgatgtgctaaccgaagccattgatgcactgatgcaacgtattttccgtaaagacaatttcgcggtgaaatccgtagttgaaccactcttgcacgatacaggaccgctgggtgacctaacggttcgcctgaaacttttatttggtttgggcgtgatcccagatgaggttttccacgatattgaacacttaatcaaactgcgcaatcagctcaatcatgatgcaaccgagtaccaattcaccgacccgcaaattctcgcgccaatcaaagcactcaatctggtcaaaaaaatgggcatgttgcatttaaacgtcgtggagccagacgacgatattgacctcagcttttaccacctgcaattgcaacgccaacagcaagtgatcaaatctggtctctctctggccatcattcaaatttgtaatgcactcaacaaagacagcccgttttaacgtttaggtgcacgccgatttcgcgtgttctccgctcaacttccacatccatttttcatcttgtttgcgtatcgtgttagcctgaagcctttctgatgacaaacgagtgaagcatgaaaatcgctatgattggtctgggagatattgcccagaaagcttatcttcccgtattggctcaatggccagatattgaattggtgctctgcacccgaaatccgaaagtattggggactctagcgacgcgttaccgagtcagcgcgacgtgcaccgactaccgtgatgtgttgcagtatggtgtggatgcagtgatgatccatgcggcgaccgatgtacacagcacacttgcggcgttttttctgcatctagggatcccaacttttgtcgataaaccactcgccgcgagcgcgcaagagtgtgaaaacttgtatgagttagcggagaaacatcaccaaccactttatgtcgggtttaaccgacgtcatatcccgctctacaaccaacatttgtccgagctggctcaacaagagtgtggggcgctgcgttcactgcgttgggaaaaacatcgccatgccctgcccggcgatattcgcacctttgtgttcgatgatttcattcatcctctagatagcgtcaacctttcgcgtcagtgcaatttagatgacctccatctcacctatcacatgagtgaaggactcctcgcccgccttgatgttcaatggcaaacgggcgataccttattgcacgcttcgatgaaccgtcagtttgggataaccacagagcatgtcacggccagttatgacaatgtggcttatctgtttgattcctttactcaaggaaaaatgtggcgagataaccaagaaagtcgagtggccttaaaagattggacaccgatgctcgccagtaaaggctttgacgctatggtgcaagattggttgcaagttgcagcagcaggcaaactacccactcatatcattgaacgtaacttagccagtcaccaactggctgaagcgatttgccagcagatcactcaacaggtaaccaagggctaaacgttgtccccaccaacgttgcccccaccatagagagaagcgctaaggtgggggctttgtcattcgttagtatgcttgtgatgacgagatcacgggggacttaccagcttttttcgcccatgttcacttcagcgctaagctgtaagctaccgtcatccggtaagaccggatactgcgcacgcattttctcaatcacttgtgaagagtgcgtcgagctatccaaagcttgttcaaatttcaccaaatactctttcgtgaaagagatggcttgcgtaccttgtgggatttcatgaccataatgaccagggatcacctgttttggtttgagttcgagcatacgatctaaggtttctacccattccatacgtgcttgcttggtttggctatccgcagtccaaacatgcatatcactcattactgcgacaccacccaaaatcgttttctctgcaggcaaccacagataggcttgcggatgattgagctgtttgatctcaattttaccgccattgagcacaaacttagtacgattatcgactttaggtacaatcactttttgcggcgcattttcagcgaggatgggtccccaatactcgattttggcgtctttagtcgcttcaatgtgtttgaccacactttcactggctagaaccggaacgtttggaaaggcttccaccagaggttgtaggccaaaatagtaatccggatcgcccgcgctgatgtaaatagcggtgagctctttgcctgattgcttgatcatgtcgaccagcttagcaccatcattcacaccaaattgagcatcaacgagaatggcttgtttctcgtcactgatgagggttgagctgacggggaaaatgccatgttcacctgggttatacgtttgcagttctaaagccgctaagcttgaaaacgcgggtaatagcagggctgaagtcaaaagggtacgagtaagtttcatgctggggtctccgtggtgcatcaatagagctacagcttattgtgctttaagctgaacaaatagatcgaaacaagaacatcactgattcaaatcagttaactaattgcgcaggattgcctaaagcctcacagttcttggtcgttcttgctgactgacattgagccccttcctcgtcttatgcttgaatggagcacagacacagaggaatttcagtatggccgacaaactttccacctccgccttggcaaaaaagcgccagcaagatgctaaacagctgtttcaggatttgaaaaccgccggttatatccatcgccatgatgagcagtggatattgaccgatctcggcaccaaatttgggggagagtatgcccagcaccctaagtatgggcgttttattgtctggcctgagaatttgctgatcgacttgcacgccacttcaggccaaacactcaccgctacgcaagtcggggaatacttcaaattaaacccgaagaaaatgaatcagttattcagcgaattaggctggatagcgcgcagcgagtcggggtggcacgccacggaaagtggcctacgtgccggagcacagcagcgtgaagagaaaagctcaggtaatggatttgtggtctggcatgaagccatcctgcgtaaccgccacttacgccaatctgtcgtggaatttctcggccaagaagcacaggctcacgcgaccgataaatcttattccagctttcgccagaagtttgctgccaaacaccgtactttagatggacattatgtgcgttcaacgggtgaactgctgattgataactggctgtatctggctggcgtggtacacgcttatcagcgcccactaccgattgaagaggaagtgaccagtgatttttatctgccaagcggcaaggtctatttgcaattttggggaacagatgaaggtgacattgccccgagtgaacaacaaaaaacccgcgcactttatcaagcacacgggttagcactgattgagatccaatctcatgagatcacgcaactggatgacattttgcccgcaaaattgcgtgagttcggtattaaagcgtattaacgagtgcgataacgcgcacgcgcggcctcttcaattggcaccacagttttaccaatcggcgccaatgaaatcaccgccagctttaaatgctgcagggcaaacggaatgccgatgatggtgataaaacaggccaccgcagacaaaatatgccccaccgccaaccaaaaaccggccaaaataaaccaaatgatattgcccaaaacgccgaaaccgctggtaccaatgtcggtttggtcagttaattcatcacgggaaatcgcttcatagccaaacggccagaatgagaaattgccgatcacaaaacaagcgcgtccccacggaatgccaatgatgctaataaacgccagtactcccactagccaccaagccaatcccatcactataccgccacataaaaaccaaataatgttgcctagtgttcttaacattaccttacctcacgttgttgaaggtgtttcatgcgcctaacgctaatgcggcgaccatgaacagaaaatgaatgatcagaaaaatccatgccacaccgcagtcgcaccactcaccaaacagagcgccagcgccgcaaagcgaattttttcttttggcaatgagtgagtggttttacgggctaacacatagcctagccaagccgcagggatcagcggcagagtcagtagcacatggtgccacgttaaaaaacccgtcggccactgcaccatcaaagagatgatcgagctaaacacgaagaaggcagacaaattaccgcgcaattgattagcttcttggtgctgaagcaggagcgccataggaggaccaccgatgccactgctggtaccaaatacgcctgagaaaaagcccgcaatccccattcgagttgggttcggctcaatgcgcagtggcagcaaacttactgccaccgcaaacagcaccaacaagccaagccacagcgccagcgcctgcgtggaaatccacatcagcagcaaaccacccacaatcgatcccggaatgcgcccaattaaggccatttttaagccgccaatcgaaatactctcgcgatgtttcatcgcattgagcaccgaaataaacagcgcgactaagcagatcggtgatggcacatagtccggcgaaataagaaacagcagcggcgatgcaacgaccgcgagcccaaagccgatcgcggtctgcacaaaggaacccatgaaaaccaatagcatggcaatccacgcactcgcgcctaaatattccatttcgttcccttgtactgcgatattttgaatgacacagacggtatcagttcagcaatatttcgcaatagaaacgtttcgcccgaacgggcttaccagaaatttagactcactcaccaataaaaacgaccagcgaccgcttatcttaatggcatccaaatgttgggggggggggcgaagcaagctactcagtgaccaacgtaaaaccttcgtccaaccaaccggtcacacccccaatcattttcttcactgggcgacctaatttggctaagcgaatcgccgctttttcagtgccattacagtgaggccccgcgcaatagaccacaaacagcgtgcccatagggtaatcggctaaggttttttcgttcaagcgtgagtgcggcaagctgatggcacatggcacatgtccttcggcatagagggcttcaccgcgaacatcgagtaacacaaaatcttgtctttcattggtgatcgcgtggtgcacatcccaacaatcggtttcaaactgcaacaacgcttcaaaatgcgccagagcatcggcactggacgctgcgggcacacgagatacggcactagacattcgacttctccttgtcggtttaatgagcatgcagtgtgccacaagctttaaaacgccgaaatagcaaaactcagaaagatgcacgcaccttcctgagttatccaatgattaaaccgcttgtgtggattagtacgctacaccaatgcgttggcgaggatgctcagcgtattccagctcatcaatcagcgcgaccgcataatctgcaaccgaaatacggctgttgccttcgctgtcggtcagcagttgatcgccgcccacccggtattggccttgcttgtcgcctgggaaaatttcggccgctgggcttacgaaagtccagttcacatcgctgttgcttgcgcggaaaacttccaacgcttcgccttgagctagagcttcacctttgtactcttctgggaaacccggaacggtgactaatttcacgcccggagccacttccaaagaacccgcaccaccaacccacaataaacgagcaacgccagcttgtggcaactcattgagtagacgctgcgcggttttcgcgaccatttcatggttgcctgcggcacggccgccgatagaggcaatcacagcatccacgccttctagcacagatttgagtgagctctctgggtttaggatatccagttgctgtaccgctacccctttgagggtgactttggctgggtcacgaacgacagcaaccacttcatgtccgcgcattttcgcttcagccgctaaatggctaccaatccaaccagatgcacctagaattgctactttcattttttaccttcctcttgaatctatttagatgagtgtgttcaacgaggataagtatagtttgtcgcatcgcgagcgataaatgcgcaaaaatgatgtacattgtatctagttagtttgcaaatgagagcacttatggatcgcctaactgccatgcgcagctttattgaagtcgccaataccgccagttttacccaagcagcggataacctaaacctcagccgtttacaggtatcgcgccatgttcaggaaattgaggattggcttaagcagcgcttgctgcatcgcacgacacgccgagtcagcctcaccgcagcgggtgaggaggcactacaacgctgtgagcaaattctccatcagaccatggagctggaaatgcgcgcactggagcagtcaggagcattacgcggcagcattcgaatttctgcaccgataggtctcacgcaaaacatgctgctggatgcggtacaggcctttaccgacctgcatccacaagttcattttgatgtgcttgcctccgatcgtttttcacaattggtcgatgaacgtgtcgatatcgcgctgcgctttacgcagcagcccgatgaaaatttgattgcacgccgcttgcttgaagtcggcatggtggtgtgtgccactcaggaatatctggcacaacatgcgcctatcgaattaccacaagatctgacacaccataactgcttagtgcatatcagtggcaataaatgggatttcgttaaaaataacgagcagtttagcgttttggtcaatggtaatattcgcgccaatgatatgggtaccttatgccgcgccgcattaaatcataaagggatcattcgtctcccctgtgatttggccaatccgctgttgcgagctggacaactgcaagcgttactgccggactattatctgccaagcagttcaatctgggcagtgtatctgtcgcgcagttaccagacacctttggtcagacagtttattgattttctcgccgagcgttggcaagaagatttgctctggccataaaagccaatccccgattttacactcggggatactttgtaaggattaatagcggaactgtcccattcgcttgcttaattccatcgcttcatcggataactcattcacgatggcgttcacttcgccgacttgcaccgtcacagacgcagaaacatccgaaattgaggtgatattggcgttaatttcttcagtaacaccacgctgttgctcagttgcagtcgcgatttggatattcatctcgtttaattcattgagcatatcgacaatctgtttgagcatatcggtattgctatgacaggtagccacaccgcgaaccaccgtattattcgcctcttcgatacagttgacgacagactgagtttctttttgtaagcgatcaattttggtgcggatctcttcagtcgaggtttgcgtttttgcggcaagattacgcacctcatccgcgaccaccgcaaagcctcgcccttgttctccagcgcgagctgcctcaatggcggcattcaacgccagcaagttggtctgctcggcaatcgcttggatcacatcgagtaccgaggcgatagattggctttcatgatttaaccgtgcaatcgcttcaacggccgaggccatttgttggtttattgatgtcatatcgcgcgcaagctcattgcccactgagacaccgccgtggcccttttgattggcttcctgcacaaaagtggctgctcgctgtgcaaattcagacacttcggtaatcgaagcgctcatttcatttaccgccgtgaccaccgaatccgtacgctcatgctgctcagataccgaattacgcgttccggtcatattatgtgtaatggtttgagtgtgagagttgagtttgtcagtcgtatgagcgaactgacaaatcgtatcttgcagatggctcagcatacgattgagcgcttgcgccaactgtcggatctcatcactgccttgctcagataaccgcaccgttaaatcattatctcgactcatccgttgaatttggcttatcgaatcacgaatcggtttagaaattccattccccaccatccatgccgcaagtgtcgcaatgactgcgccgatcacgatggcgatcagcactttcataatcagttcgtcggaaagcttcgcaatatcggctaacgcttcgtctgcctgcatttcagtgactaacgcccagcgtaaccctaatgcatcaagcggtgtgtatgctgatagtaactgcacactggcatgcgtactctccatcattaatccactctcgcctctcaaagccttatccacggcttgcgaactgaccttaagcaaaccaatcgcggattgtttactgcggatctgattgattgccgctcgatcacccgttaatgaattcaatgtcccgatgaaggccgaagcatcttccagcagtaaacggggctgactacgcatcaggtgatcactgcccactaaatagctctggccggtattcccaagcccgttttctttccaacgggaatcgaacgtcataatgctattaatttcatccactggcatttgaaagatcagaacaccaactcgagtactaccgttaaagataggggtcgaaatgaatgaagccgccgcctcataagagggatagtaaggtgcaaaatcgtcaagataatactgattattggctaaggttttggcttgcacataagcccttgctagtccgctctctttgtacggaccgctcagtaaattggtcgcaaaatcaagctctttgaatacggtgtaaaccacatgaccgtcattatcgaccataaacacatcatataaaccgaactgctctagatactgcttaatcccaggatggtacttttgatgcaaagcatcatacgcgttacctagcgaatcactctcccactcatgcttagcgccaagcgggttagggttgctggcaatataacgggcttgtaacgcttccgcggatctggataacaggctcaaacgcgctaaagggttcgcatcttggccgtcgtttaacttctgataattctgaccaaattgagtggtgtaatagtcttttagggcactgagcgaagaagctggcacctgttctacggggtaagcttggtaggcttgggtcaagctttccattgcctccacagtggagaccatattggctaaggtcacaagttgccccgctactcgtgttaaatagcgttcaatctcactttttttggtttcacgaaccgaaaggagttggttcgaggctcgctcatagatcgcttgtttagacagagtggcggcgctccaacccacccacactcctgcaatcacgaccgaaaaaatggacagcaatgtcatagacaatacgattttgttggcaattttcatgcttttcccctgagaaactcagtcagatatagaggtaaagagtcgccaacgatacgtcataaaaccaaaaattctttgttataggagtaaagactcattgcaagcatagtcatcccctattccatctaccaaaaaataccgcagaaattgtcgttacccggccaacccatagtcaacgagttgattatagttcaaaaaaagcgaccctttccggtcgctcaattatgttgttcaaatatacccttcctacttgaagctgcagcggtgctagcaacattcgcccccccattcacataatctatctatgctcatggggattactcatttgcctcctacctgcaacgccaagtagtttgggtataggggcttaatcgcacttttttgatgaactagggctgttgtttggtcggtgccaacgcaatctcacgaatgcacacgctttgtggctgctgataagcaaacagcaccgcacgcgccacatcatccgcggccaacacaccgcccatatccactttccaagcatcgtagccctctttaatttcgtttgatgtggtgtgtgaaagcagctctgtttctaccgctcctggagcaattgtggtcacacgtacattgctcgcagccacttcctcacgcacgttttcagaaatcgcatgtaccgcaaacttagttccacagtaagcagcatgattcgggaaagttttcttacccgcaatagaactgatgttcacgatcgtaccgtagttgcgatctttcatatcggccaacacggcgtgcataccattgagcagacccaacacattcacatcaaacatgcgcttccattcattcgcttcttgagtatcaatctgcccaagcagcatgacaccggcattgttcaccagcagatccgcagggccatacagcgcttcggctttcgcaatcgcagccactaaggtcgcggcctccgtcacatccactttttcacacagtgtgttgggcaggttcagtgcctctaaacgctccacacggcgtgccaccaacagcaatggatgacccgcttcactgaaacggcgtgcaatcgcttcaccaataccagaacttgcacctgtaataacgactaatgatttcatgggattaccttattgattcttagaaaaagtctcctgaacacaggagttcgttgcaatgcgtgcagtctaggcgaaagcagattgttgatatatagtcgacaggttcacaaactgttgccatataatgacaaataaaagagactctcaatgcaacttaaccaactcaatctggccgacattcgcgcctttgtactgattgccaaactcggcaatttcactaaagccgcggaagagctgggggtttctcgctcacatgtttcccgccagctgagccaattggagaacagcatgggcgtcactcttgtcatccgtaccacacgcagcctttcgctcacggatgctggggaactcttctatcgtcaatgtgaacaagccctgagcagtattgaacaagccgtgttagccgctgtagatgatgtgcaagaagcgcgcggtgagctacgcatcaacagtgtgggcgggcatattggggaagagttaattgccgacatttgcagtgcttttatgcaggaaaaccccgatgtgcgtattcaccttgatttcagtagtcatcgcgttgatttgattgaagaaggctttgacgtggcatttcggatgggaaaattagaagatgccagctttgtagcgcgtaagctcaccgaaatccgcatgagcacgctcgcaagccccgcgtactttaccctgtgtggtcaacctcaacatcccaagcaactcgccgatcatcgctgcttaaccggttcggtaaaacgttggagctaccaacacaaagagacgaagcaaactctcgatgtacccgtcgatggagatttacagtgtaaaaacggccgagtgttagttcgagcggcattggcgcataacggcatcattcgcgtacccactttctactgccaccaagagctcgcccgcggcgagctggtcgaagtgtttcaggattggcatatcccgagcgttgagttttccctcatctaccataaagacaaatatcaaccagtacgcttaaagcggtttattgagttcagtaagcgttattttgagcagggcgtcatcgaataaatcggcgagtcatgactctcgcaaaacggcagcataaaagactggtcaagttcggcgcgcttagcgacaataccgcactttgaatgacaacgaatgagaaataccatgcgcagttttatcctccgagctcgctccgcaccgaccgatagccaacgcctactggacgaaattggtggcaaatgccataccgaaattttggcacactgcatgatgaacagcctgtttaccgcgcagtcgcatcgtgaagatgtggtgattcatctggtattggaaagtacgcgcgattattcacgcaccatcaccgtcgaagcgaatgaaatcagtgatgtgggcggattccatgaagcggccttgattgccctgttggtgaaagcgctggatgcctcagttggcatgggcaaagaacaaacgcgtgtggttcagccgggtttaaccgtgcgcaccatcagctttgaagcgctactcggtgagttggcggaacaccactcgttgtacatgatggataaaaaaggtgattcaattcgtgatattaagattggcccgaacccgtgttttattttgaccgatcatatcccgatgccgaaaaagagtggtaactcgatgaaacgtcttggggtagaaaaaatcagccttgggccaaaaatgctgtttgcctctcaatgtgtcacgctaattcataacgagattgatcaccaagaagcagggtggtaatccctcccctcatcaataaccaacagccctgatgaatctgttcgtcagggctgtttttcttcgtttaagccagttttagatcaaactgaatgcggtattgcaccatatcttcaatggtcaatacgggcatattgtgcagtttgccaaactcgatgatttctggcgtttttgccatgctgccatctgggttggtcagttcacacaatacaccggctggctgtaagcccgccatctgcatcaaatcaaccgtaccttcggtatgaccacgacgcgccaataccccacccgcacgagcacgtagtgggaatacatggccgggacgcgccaaatcttctggctttgcttgtgggttggcggcggttttgatggtggtgacgcgatcttgcgccgaaacccccgtggttacgccatgtttggcttcaatcgataccgtaaacgccgtttggttcgcactgttgttgttgaccaccataggcggtagggctaagcgatcggcttgcgcttcagtcagacacaaacagacgatgccgctgcattcacggatcatcaatgccatttgcgctgtagtaagagattctactgcgtagataatatcgccttcgttttcgcgatcttcatcatcgagcagcagcacaccacgcccctcacgtaaggcttgcagtgcgttttctacacgagtaatggggtcgccgaattcggcaagtaatgaggactgattcatggtaatactccaaaaaatgaccagaatcagggcttatgagggatcaaaatccaaaacgaaaagcactgaaaaccaaaagatgtagcaacgccgcaccttgagattcagtgtgtttgtcattctctctcatccggactgtaaccgtcggccctggcttctcaccagatctgctgacctcgacgaatcgagcgctcgtgggctcgccttgcggcataccaccggtggggaatttcgccccgccctgagaatattgttgtgtttcagacgattctgaaacgccgcctagtgtagtcagttcaacgagcggtgaaaagagttacggacaaacttgttttgaatatcaccgcttttgagcaagaaaagtcgatgaaaaagaacatcagacagaaaacagcgcggatagaaaaacagcgcagacttgctgcgctgttgaccttatagcttaagctttaacccgatcaggcgtgtttcagcggggtattttgctgtgagcggtaaatcgcaccgtacagcacccaaccgaagaaggtcgcaatcgaaccgagcatgaccgcggtttcaccggaactgtacagcgcgtagaagctatacatggcaccaataaaggccatcacgttggccactttcgcttggctcaccggtacattgagctgcttttgcatcacgcccagcgcagccatagagaggatgtacggaatgatgttggtcacgaccgccaaattcactaacgcctcaaactgcttattgagtgagggactgatggtcatcaaactcagtacgctttgaatcgagacgatggtcagcatacctagcacaggggcatcggctttggtcactttagagaacaatttagggaagaaaccttcatcggccgaggctttaaacacttgcgcaatggtaaattgccagccaagcagtgaaccggtacaagatactatcgcacacgccatgacaatcgcgcccatggttgggttaaacatctgcgcaaaagccagaccaaacggtgcgttcgagttagccagatcggcgtttggcacaatcccagcaatcacgttggtcgagatgatgtaaattaccgcagcccccaaggtgccgcccatgaccgcaatcggtacgtttttctctgggttttccaccgcatcagcattagcacacgccgattccaaacctaagaatgcccagagcgtcattgcaattgagccgccgagcgcttggaagaatggcaaaccatgtgggttccatgccgcgcggtacaagtcaaaatcaaaccagtaccaaccgatgatggataccccaatcaccggaatgatgatgccccaaacggtgacactcgagacttggccagtaatgcgcgcaccaccaaagttagccacggtggcgacccacaataccaaaatagtcgcgatacaggtttcaatcggagtgagatgaaaaccaaacagcacatcggcatagccaacagcggaaatggcaatcgccacgttggcaattaacaaggaaaccgcataggtatagttggccataaagttgccgctgcggccaaacgcgtattcggcgtaaccacccataccgccggattttttactgaacataccgcattttgcaaaagcaaacgccaaggccgttgagcctgcggcagtgactaaccaagataagatagaaatggtgccgacttgggcaagctgagtcgggagcataatgatgcccgatcccatcatgttaacgatagtcagaatagtgagttgcactacaccaattttgttattggatttactcatgatattccccttctatgggtcttttcgtgttgtcatcggggtagaaacctctgccccgatgccccgattaacgtttcagtacatagcccatggcttgcactcgtccctcgcctgtcggctccaaatacaccccttgcaattcaggcgcaaaacccggcagcaagttaatgccttcttctagagcgaggaagtaacgctgtactgaaccgccccatatttctcccggaaccacacacaacacacccggagggtaaggcagtgcgccttcagcggcgatacggccttccacttcacgcagtgggactagctcaacctgaccacgtacaaaggccaagttcgcttcttgtgggttcattaccgcacgtgggaaataacgcgcgcggaacatctctttttgcagctgtttcacatcatggctgacatacagatcgtgcatttcctgacacaactgacggatggtgtagcctttgtagcgttcgcgattcgcgcggtacacgttcggcaatacttcgctcagtggtgcatcttcttcaatcaagcgttcaaaacgagcaatttgtgccactaaatgctgcatcttcgccatatcttcggctggggtgagcaggaagaggatagagttcaaatcgcacttctctgggatgatgttgttctcacgcaggaagttggccagtatggtggccggaataccaaagtgctcgtattcgccagtttctgggtcaatccccggtgtggtcagcaggaacttacaagggtcaacgaaatactgaccatgctcgtaaccttcaaacgcatgccatttctggcccggctcaaattcaaagaaacgtaaatcatcggcaatttgctcggtggggtgagactgccaaggtttaccttcgatcattggtggaatgaacggcttgatgtatttgcattttttcattagaagcttacgggcttcgataccggtttttaccgcttcacgccataggtagcggccactgtccccttcgtgcatcttggcgttcacatcgagcgccgcaaacagcgggtagaatgggctggttgaagcgtgcagcataaaggcattgttaaagcgtttatggttgcagtaacgctcttggcctttgatgtggtgatctttcttgtgaatttgcgaagtttgcgagaaacctgcctgctgtttatgcacggactgagtgacgatgatgcccggatcttcaggctttagatcgagaagaagtggcgagcagtctttcatcatgggaatgaactgttcatagcccacccatgctgagtcaaacaggatgtagtcacacaaatgaccgatgcgatccaccacctgacgcgcgttgtaaatcgtaccgtcgtaagtgccaagctgaatgatggcaagacggaatgggcgtttcgcttccgcgcggcttgggtcgacattacgtaccgcatcacgtaggtaagattcgttaaagcagtgcgtatcaatcccaccgataaaaccgaatgggttacgcgccgtttctaagtaaaccggtgtcgcacccgcttgaattaacgcaccgtggtggttggatttatggttgttgcgatcaaacagcaccagatctcccggtgtcagcagggcgttacacaccactttgttggaagctgaagtcccgttaagtacgaagtaggttttatccgcgttgtacactttcgcggcgtaagcctgtgcatcatgcggtgcaccttcatggatcagcaagtcgcccaaacgtacgtccgcgttacacatatcagagcggaacaaggtttcaccaaagaaatcaaaaaactggcgaccaaccgggtgcttacggaagaactgaccaccttgatggcctgggcaagcaaaagtggagttacccatgtccacgtattttttcaatgtaccaaagaaaggtggcaacaaactttcttgataacgacgcacggcagtttccacttgcttaccgtagaactcgactttggcatcacacagctcaaataccccggtgatatcggcgcaaaaatcatctgggaattggtcttcgcagcacacagcaacaaagatcggcagtttcaaaccggtcgcattcattttatctatgatgccgttttgtacgtcttcgacggaaaccaccgccgcaccaatgtcacagaagtcggttttcagtacatccaccacttcacgttgggttgtgaagcaagagcgaaccgataaactcgtagcaatttttaatgaattcatatttagcctttcttatttttttgagtaaacgaattccaagccaaattatttttagcgtgcaggaaatcgctcagcaaaataaatattgccgtcacaaaggctgagatagaaataatggagagccccagcctaagaacgggtgaatattcttttgcttaataatgatttttcttgggcatacctagagattcactcagtttcggtaggagcaggcaaaaccaacatgatttcacatcacgccaaagggcgtaaaaatccatgaatatgccttaatacctcaacatgaggaaagcaggtataggacgaacctttagctgacaagcagcctaaagctctcgttacagatgagatgtcgattgggtaaagaaagagtagtcaaagtagtcacggtgagacggcatcatgatgtgccgagtcctgcgaatgtgtgccatgatttttgatttctttttcatatacaactccgttacaaataatcaagaaaccagtttacgtcgttttgcttagaaagcaggcgcattctataccccaaggaaaaattaaaatttgaccattatcacaccttaatacgcatagatatatattttagatttatttaccaacaagaataggtattaccatatatatcctaggaattgagcaaaactataagaaaataatatagcggagaacaaaataaacagaacaacgcactatcaaacactcgtaatccaaccggataaaatgcaacattaacaacaaatgccacatatttaatgacattcaataacactgctgtttttcaatttgacgtgagatcctgctatacccaaactacttggagttgcaggtaggtggcaagtgagttcatccccatcaacatacacaggcttatgattggaatgcacgagcgtagccaacaccgcggctgcttcaagtaggaatgggatcgcatcaagccagacgctggctggcttgatatagtgagcgacatcagaaagattagcgcccaaaaaaacgagtgaggacgcgtaacatcgattgacgataagtcagcagccaaccactacgtggcaaccacgcggctgaacgcagcaccgtcttactgtgcgaaaaagtcttaaagccttcgattccgtggtaatgcccctgccctgattcaccaatgccgccaaatggcgcatcatccgccgcaacatgcattaaggtatcgttcacacacgcaccaccactgtgggtacgctgcaaaatatgattagccagatggctctctttggtcatcacgtacagcgccaatggccgtgggccttgattgactcgctcaatcgcttcttcaatattgcgataaccgatcaccggcaggatcgggccaaagatctcttgttgcatcaccaacatgtcatcactgacttcggttaacagatgcggcagcatctgccttgcttcaagttctactgttttgcccactacagtattgagtttggcacctttttgctgtgcatcatccaaacagtgttgtaatcggtcaaactgcgcttggttaatgatttgtgtcacatccatacgaccatgacggataaaacggcgcgcaaaacgctgcaaataaagctcaacgaaggtcgcgactttcgcttgcggcagcatgacgtaatccggtgcgacacagatctgcccggcattggtggttttacccagcatgatgttatccacgctacgcgcgagatccgcatcgtcagcaatgatcactggagatttgccccccaactctaacgtcacaggtgttaaatttttcgcggccgcttgcgccactaacttgcctacggcggttgaacccgtaaacagcagatgatcaaatcgcaaggcactaaaagccgcagcaaccttcgcatcaccttgcacgcaaaccgcgatatcgcctaacgcggcaatcacacgcgctagtacctgattggtggcaggtgtgtactcgctcaatttcaccatcacctgattccccgcagcaacagcggtgatcagtggtgcaatactaagcaaaataggaaaattccaaggtaccattacccccaccacacccaagggctgaaattgcacttcaacacgcgaaggcagcagcatccatcctgcatgtcgccgctgcggcttcatccactttttcagttgcttagccgtgtaattgagatgatttaacgttggcagtaaatcgcacagaccgctatcaaaacgactacggaaaccataatcttgattgactgcggcaatcagggcttcgttttcacgcaataaagcctgtttgagctgggttaaacgttgcaaacggtgggtcaaactcggataaggcgtattggcatactgcctttttaggcgcgtaaattcagcctgcaaagcttcgattgctgacgagatttctggtgactcagcacgagacaccacagagagttgaaccatagtaaactccgcagaaataaaatatataaactacttggagttgcaggtaggaggaaagtgagttcatccccatgagcatagatacactatgtgattgaggtgaacaaacgtagccaacgccgctgcagcttcaagtaggaaggggataagcccccctcgggcgtagagtatcttaacttggcaagctgtaaatcagctcagggttgataccaaaactggttttgtgctcttcaatcacaaactcactacgggtttgaatcacgccgggtaaagagcccaacttgcccgacataaacgcttgatacgctttcatgtctttgacgcgcactttaatcatggtgtcaaaatcaccagagagcgagtaacaggcttcgatttctgggatatccgcaacagcatgagcaaaacgttcaaaaattgagaagctgctttgatcaagccgaatatggataaagacctgcacatccaagcctaactttcccggatcgagatccgcgtggtaaccgcgaatgtatccctctttttctaaacgttttacccgctctgaacagggcgatgtcgtgagattcaccaacttggccagctcaacgaccggtaaacgccctttggcatgtaagatccgcaaaatatcgcggtcaactcgatccagactcatacagcaacatcctttgactgtttagacccgaatacaatactgataacccccaatcggcagaaatagtgtgcggcaaggcgtgatgtacctcacgcaaaagggcatcttacgatgcccttggttttctccttgcgactgaagcggctaccgtgtccgcccagttccagtcaaatcacgcgatgttgcaccgctgtagcttatagcttaaagcgtgaaatctccttattcagctcttgtgccatcgcatgcagtgatttcgcctgctgcacggattgctgagcttcttcggctaactggtcgctcacttcacggacggattcagtattcacattgatatccgccgtcactaacgattgctcttccgccgctgaagcgatttgcgtcgccatatcgctgatctgctgaatcgcttcactgatcgcttgcaagcttgctccggtttggttgacatccgcgacactggtttccaccaacttatggctttcggtcattaccgataccgcagtggtggtgactttctgcaagccagcaatcttagtctggatctcttccgtcgatgcgtgggtgcgctgtgacagcacacgaacttcatccgcaaccaccgcaaaaccgcgtccttgctctccggcacgcgccgcttcaatcgcggcgttcaatgccagcaaattggtctgttcagcgatgccacgaatggtcgacaagatggtggaaatttcattggcatgcacttcaagctcgctgatgatgcgcaccgcgccagttaactcttgggcaagctggtcaatcgactgtttactttgttgcatttgcgcaaagccatcttcgcccaattgcaccgattgagtggcgttcttcgccgtattttcggcattgctggcgatctcagctgtcgccgacgccatttccgtcaccgctgtcgcgaccatagtgatttcatcttgctgggtgcgaatgcgtttgctggcttgagtcgccgaggcggccgcgtggtcagccccttgagtcagcgccaccgacacttcacgcacatttttcaccatttgatgcaagcgatcgacgaatttgttgaacttatccgccagcaaacccacttcgtcttggctacgaacatccaaacgacgagtcaaatcgccatccccttcggcgatatccgccagagcattagcgatattaccgagctcattaagctgacgagccacaaaccaagacgtaagcagtgccatcacaagcaagatacccagcccaatcccgatctgcaccatcaacatgtcattcagtggctgctccagaacccctttatccatcaccatgaccagtaaccaatcggtattcgccacttcctcagccatcaagaccttatctcgcccgtccatactcagttggaagagcgaatggtctttggccgcgatattgagcttagaaatagtcagttgagccgacatctcttccgtcggttttaggatcaaatcttgagttgggtgagcaacgattttgcctttttggttcaccagaatcgcgtaaccttttccgggcacttcaatcgctaacacatctttaatcagcttatctaacgcaaggttggaggcggccacccctatcaattgaccttgatagcgaacaggctccgccaaggtcacaactaaggtttgcatggtgacgctcacgtaaggttcggtcgtgatcggtttacccgccgcttttgcttctttgtaccaaccacggactcgagggtcataatctgcggtattgagtgacggatcttgacggaacatttcgccctgctcattaccgtagtaactcaatccaaaagagccagactgcagtgtctgtcttaaatgagggactaactctaactgcggattgcgttcaatttcttcacgtagccctttaagcgcgagctgcttgcccaaaaaccagtcaccaatccctttggcatgcgcttgtaaagtgttgcgactttcactttcaatcgcccgccaactgtccttctcaaaggtctgataccctgcggcgactaacgccgccgccgtcacagcaatcgccacgaccacagagaaaaccatttttctctttaaactcaatctcatgaacaacactccattcatatcaaattgcactgatatgggagcaagttatcgaaatgacgaagaattaccttgcgaaaactcccacaatcgtaatgagtgataacaaggaatgactaaagtgtgagcttctgtccataatggtgcacaaaagccactagctggcctcatcagtaagtattggacttaaaggaaaatagaaatgcattcccatccaatatcatgaatatgccgcggttgagatgccatatgccgatacaatttgaagtggccggtaggcagccagcgagtgaaaggtgacgctaaaaccgatttgcacagccgcaagctcgtcttaggagagcccaatcatgacgcaaaaatcatgcgcttgcgaataaatcacgctgcgccgctcgctcattctgctggttacagactcggcagaaatagcgttgctccatctgataatagtgttggccttgcatcagcatggtgagaaattgttggaaaccttgccagccttcaggttgtgactgcacacgtttcatcaccattttgtgtgcagtgtgtttaccacaactacgacaatacgctttaggcatgacggagatctcctatccgattggtcactattgacagttgacgcattttgcagcgataggttccgtagacataatttgttgtgcaaatttcgtgacctatatttgaaaattactcaataatgcccagacagagcaaaaagaaagcctcgcaaagcgaggcttgttccgtagagtaaaatgcacttattccagttcaatcaactgctttttgaaggtggcgtgttgcgcttttaccttctcatccggttcaccggtgagcaggctgaccacaacaatcgacagggttgaaaggataattcccggtacgatttcgtacacatcaaaccaaccgccagacagttgtttccaaaccacaatcgtcacaccaccgacaatgatccccgatagcgcaccatgacggttcatacgcggccagtacaggctcaagaccagtgcaggaccaaacgccgcaccaaagccagcccaagcgtaggacaccaaacccagcactgagctatctggcgtcatcgccaaaaacagggcaatcagcgagatcaaaatcaccgcgatgcgaccaacgcggacaatgtcttcggagctggcatcggttttgaacacttgcttgtagaaatcttccgcgagtgccgatgaagagaccagcagctgcgaatccgcagtactcatgattgccgccaaaatggcggccagcaaaataccggcgatgactgggtggaacagcgagttcactaatagcatgaagattttttcgccatcatccaggccaatcgtgcctgattgagtaacgaaaattagacccgttaaaccgaccagaatcgcgccagccattgaaagcccagtccacactactgcgatacggcgcgccgtgatcagatctttattggaacgtgaggctttgaaacgcgccagaatgtgcggctgaccaaaatagcccaagccccacgccaccagcgagataatcgcaatcgccgacagaggttcgcctttcgcgtcattccacaaggtcagcagttcagggttaatcgccgccaaatcgtgattaagctgagtaaagccaccattcattgccgcaatcggcacgatcatcagtgccgctgccatgagcaagccttgcaccaagtccgtccaagagaccgctaagaagccaccaaacagggtgtacgacaccacacaaaccgtaccgatgatcaccgcggtggagtaatccaagccgaatacggtttcaaacagtttaccgcctgccaccaaacccgaactggtatagaagaggaagaacagcagaataaagaacgcagaaatggtctggatgagttttgagttatcgttaaaacggcgtgacaaaaactcaggtaaagtcagagagtccgtggtgatgctgtaggtgcgcagacgcttagcattcactaaccagttagcccaagtaccgacgagcaagccgccagccaaccagaatgattcaatgccggcggcatacgcgtaacccggcagaccgagcagtaaccagccactcatatcggatgcgccagcagagagtgctgcaggccatggccctaatgaacggccacccagaaagtaatcggctgagtttttcgttcgctgataagcgtaaaccccaatcgccaacatcaaaatgaggtagacgataaaggtggttgtaatagcgaagctattttccattgtgttttgtcctctttttcaagatcgcctttcataccccctcttatccaaagggggcaaacgcagaaaggactaatgagtatccacacctagctctaagagcgtcgcgtttccacccactgctgttatatttattgtgcgtgtgcgctcggtaataaagcgcagtgataaatgtggatcatgtgccaccggcaaggtaagcagatccgtttctgaaacgagactgacaatcgcgcctgtacgtttcgcgagctgacggttgatcgtggcctcaaccgacggggttccgacatatccaacgcatctcacatctgattcgatcagttggtgatacgcatcgaaagaagcaaactgcaacaaatttgccggaagggatgactgctggtaagcagccactaacgcagaactcaactctttatcgtcactgcaaaaaacgacactgttccccgctacgagtgcagcagtcagttgagccactacggcttgtttggcttgaataccgttatcctcttggatgatcagggcaacaccacgccctgcggtataaagctcattggtttctccggtaggcccaatcagttggtgcgtatgcgccaacaaagttgatgcctgttgaagatggtaggaaatcacttttgccacaccgggcatgctgttttccaataaagatttcaacgcgagtaaacactcacatttcgagtcaaagtcagtcagattccaattttcccaagcagaaaaggcgtctgaaaaacgggttacttgatgcaccatgatacgtctccttgctgtgggttattggtattgcacttgagtaaagcggtaaagatagtgaggcccgcccgctttcggccccgttcctgacaagccttgtccgccaaacggttgtacccccaccacagccccgacttgatcgcggttgatatagcagttgcccactcgagcatgtttttcaatccagcgatacgtggtttcgttacggctatgaatgcccatggttaaaccaaaaccagtttggttgattttgtcgacgatctgcgccaattcgcgcgctttaaaccgaacaatgtgcaagatcgggccaaactgctcttcactcagcgcggcaatgtcatcaatttcaaaggcggttggcgcaacaaagtcgccatgttggcaagcgtcatccaaagtaagctgagcgattttcttctgggtttggctcatgtgttcaatgtgcgccaacagtttctgtttggctttttcatcaatcactggaccgacatcggtttgatgcagatgtggcacactgactttcagctcttgcatcgcgccctgaatcaaagtaatcacgcgatcggcaatatcctgctgtacaaacagcacacgcagtgccgaacagcgttggccagcagaggcaaaagcggaacgcagcacatcacgcaccacttgctctggcagcgcggtactgtcgacaatcatggcgttttgaccgccagtttctgcaataaatggtaccggagccgcttcacgttgcgctaacgtttggttaatgcgctgcgccgtggcggtcgagccagtaaacgccacacccgcgatggccggatgagaagtgagtgcgctgccgatatcggcaccgcgtcccggcaaaagttggatggttccagcagggaaacccgcttcttgcatcagctcaaccgcgcgatacgcgatcaaactggtttgctcggcaggtttggcaatcacggtatttccggccaccaaggcggcactgatttggccaaggaaaatcgccagcgggaagttccacggactaatacacacaaacactccgcgaccttggcggctgacacgacgtgttgatccatcaaagctttcgacactgaactcgcccagcacatcgacttgtttgccgtagtaacggcaaaaatcgaccgcttcacgcacttcatcaatactgtcgtgaatggttttgcccgcttcttggtgacacaaggccaccaactcaggcatatgcagttcaagcagatccgccagcgcatccaatttactcgcacgctctttggcatcgagcgcattccaagttgcaaaagcttgttgagcagagtcgatcgctgcggaaacatgatcaaggttagcgtgaaacacctgaccgatttgaatacgacgatcgtaaggcgcagtgacgggctctgcactgtgatcagccttgatcatgctttcgtaataagagtgcccgccaatgatcggtgccgcttgccacgtcttatctaaccaagcgtggatctgagcttcaaacggcttcgcttcactctcaatatcaatgttgatccccaatgagtttttgcgctcggcaaaaatctccgttggcagtgggatcttacggttatttaaggtttcaaacgcaagcagcatatcgactggatgctgagtcaacgcaccaacagggcaacgagaatccaccaagcgatgtacgaacgaactgtttgcaccattttccaataatcgacgcaccagatagggcagcagatctttatggctgcccacgggggcataaatccgtaccgactgctgataagtggctttcgcatggtgataaagcgcatcccccatgccatgcaggcgctggaattcaaaatctttgtgttgtgccatcaccgcaatcgcggtaacggtttgcgcgttatggctagcaaattgcgggaacagattgccgcgtacactttcactcagtaggaagcgtgcacatgccagataagaaacatcggtcgcttctttgcgcgtataaaccggatagccagtaaaaccgcgttgctgcgacatcttgatttcgctgtcccaatacgcacctttgactaaacgcacaggaatgagatcgccctgctctttcgcgagtgccgtgagccaaaccagtactggcaacgcacgtttggagtaggcttgaaccaccaaaccaaacttaccccaaccacgcagcgtgtcgctgcgatagagcttttcaaacagatgcagtgatagctccaaacgatccgcttcttcggcatcaatcgtgatggcgacatccagctctttcgcgcgttcaagcaattggataagtgtgctgtacagctcggtcatcacgcgatcggcattcgccacttggtagcgaggatgcaaagccgaaagtttgatcgagaccgacggcgcagggctggtctccagaccatatttatcgcggcctaccgcttcaatcgccatcaagtaatctttgaaatacttgtgtgcatcggcagaagtcagcgccgcttcacccaacatatcaaacgaataggtataacccttatcgcgcatcgggcgaccatttttctgcgcttcttcaatggtgcgtccaagcacaaattgatggcccatgatcttcatggcttgatgcatggctttgcggatcacaggttcagtaagcttattcactaagcgattcaccgcttgcactgggcttgcggtatcaccatcagccaggccaatcactttaccagtgagcatcaagccccaagttgaagcattcacgaataccgaatctgaatttttcaggtgggatttccaatccgcaacacccaagcgatctttaataaacgcgtcagccgtttctgcatcaggaatacgcattaacgcttccgccaaacacatcagcaaaataccctcttgggtatccaagctgtattccaaaagcagtgcatcaatcatctgcaccgcttttttatcgctgcggatcgcttcaattaagcgcgtggttttctccgccattgctgctttttcagcatggcttggcgttgcgagaggcaataattgggtcagccattgggattcgtccaccatatacagtggcgagatcagcgaccatagtttatccagcggctgctcgataaacgctgcgttcaacacatcggttgctgtaaacatgtggtttccttcatctcatacctgacagattgagtcaggtttcctgcaatggctggcagtgtattttgagcgtgagaagaaaacttgtcaaaaagtcctagtattttgtcaataactctgagttttaacaaaacaaaaacaagatcacaccaattcaagcaagtttcatcgccaattattttgcaattgttgcaactcaacaacgacaaaaagtgagcaactctacatcaataagcaggcagatgcgtagtcactagggttttgtcatcaagagataaaaggcttgaggattgagtcttcgcgagctcaataagcgaggaattcaaggatcactcaacattatatcgaagaagaaaagcgccgcttatattgcgaaggtgaaataccatgtaaccgagaaaaagtatgcgtgaacgtactttgattggaaaaacccgtcagctccgcaacctgacccaaattaagtcgcccctgttcaatcaacttcttcgccatatcgacgcgtttgttcaacacatattgatgtggggtcaaccccatttgctctttgaacaagacatgaaattggctttcacttaagaacacgcttcctgctaactgtgcaacggaaattcggtgcgctaagtgctgctcgatatagcgatccaccacttccatatcaaagcgagactctttatggacactggccaacgcgctgatgtggcgctgcaaaagtgcaacaaccgtatcgttacaagctcggccaagcagcaagtcgtcagggctggcttgcatctcctgcaccaacatttgaattaaacgttggatctgaccatcgagttgaaaataaacgtcaccaaccgcgagttcattgagtttgcgcagtagtagcggatcatcgtcactcggcactggcatattgagcaccagaatatccgattgccccacgacaccaccaaatgcatgatccgaaccggatgtcaccacacacccctgcccgggcccgacaatattccccataccacggacttcaaattcagcctgccctttcaaaccaatcacaatttgcgtgtaactatgatcatggcaagccatatgcgaaggcaaagtgatcagttctgccggtttaggcgacaaaactttggcaatggaagaagccttgccggcctctggggcatgcgattgagccatttcaacctcatcaggtgggatttgcgcggccatggtatctcaaattgcttcaaaacgaaatcactcccatttagaggctttgatagccaattacgcacatattaataaaagatcttggctgcaattgggttcaattctcatctcggaacaatgatcaagtgcacataaattacggtcaatgtgtactcaatttaaaaaacgttaaagtagatcggaaaactcagcttgcatatttctcgaatctgctcaaaatgaaaatgcttagatctaaagttcaaaaaatcagtcacctagtccacagatttgtgatgatttatgactaagcggaataaaatttgcattaataattcagctatctacaaagctgtcaaaagtttgtctttcccactttatgtggctaaacataaatatgttgcagggacctatgattaaacgtcgcatcccagcgctattgcttgcgctatcccctttatgggtatctgcatcggtgtacgcagaggaggtcactcaggctgaccccgttgcggctatcgatgagaaattgagtaacaaacaaaatgaaatcaacgcgattctcaccgactacgaggtggaaagcggtaaactgcaacaactgaaaaatgagcagagtcgattaaaacgtgaaggcgaagagctagatgctaagcgtaatcgtgctaagtctgagttggacaaacagtatactcgccttcttgaagatccagacaccgacctagtcacctttcaaaaacgctaccaagaggcgtggaatgcgctcaagtcgaatcaatcacaaaaactcgacaacgaacaagcggtgactgaaattgaaatgcgtctgtcgcaaatcaaacagcgacaagcgcgtttggatactgagctgaccaatttggaagaagccaaaattgaggctcgcgttaaacgtttagcggcggaactgcgtgaaagtagcgtgttagaaactaccttcaagacgacctgttcaaccaccatgacattgggtgaatgtgctaatcagggccaatacctgacgaagcagaaagcggtgaaaactttccgtgaaaatctcatcaatgatgtcacggaatccgcgatcgcgaagcaaaacttgaaaggcgttgagttcaatattcacgttcaagaaagccaaatgatccgctcaggttttgaaggtaacaacgaatacttcacccaaatgcaagctcagctacaagccaaaccagaagctgtcgcggcgtgtaaactgctgaatgtggaaacccgttactgtttaaagggtgagtcagaacaagcggctcctaagaaacaagataaacagtgggcgaacgtgacagtacgctctgatcaatacaatgattctgtgaccattaatggcgtcaactatggtagtactcccgttgaactcgtattaccagcgggtaaacaccaagtcaccgtatcgaaagaaggttatgaaacctacaatcgtgtgattacggtcaatggcaatgacacggtgtgggtaaaactcagaccaaacaaagacagctagccgcacaaaaatccaacgatttcttgtcggaattcacaaacctgtcgataaaacgccattttgtcactaagttattgaaagatgacttctgacaaaatggcgttttcgtttagaatgctcataacttagacttaatttcctaacttgaagtagaccaccatgcgacaagggattcccgctttattattagcactttcaccttgcttaatggcagcaccagtgctagcagaagaagtcacctcttctgttcttgccattgacgatgcgctgtttggcaaacataccgagctgcaaaatgccacggatgcaaccaaacttcaaaaagtggccgtcgataaccaacaggccgagctgaatcgcttgactcagcaggcgaaagctttggatgcggcgctaaaaacagccaaaaccaaccttgagcgtgattatcaaaaaatgattgatgagccggatctcgacatccagccatcacaaaacgcgtatcaagccgcatgggctcaggtcaaacagaaccaagtcgcacgtttggatgctgaacaaaaactgcaagagatgcagtcggtattggcacaataccaggtgcaacagcagaccatagagcagagtattgccctactccaacaagacaaaatgcgcgcccgcgtggatagactgcgcgaggagttgcaacgttctggtgaacaaaaagtcagcttcaccaatgtgtgtagttcggacatgacatttgcacaatgtagcaaacaaaccacagatttagcgttgcagaaagcggtcagccaattccaactttggcttatcgatgaaagcagtgagtctaacgcgatcaaaggacaattgagtaatgtctcgctcaatattcatctgctaaaacatgaagtggtcgattctggtttctatgacggcatgcggtttagaagcatagtgaatgctcaacttgaagctcgtcccgcggaaaacgctccttgtaagctcttgaatattgactcgcagtactgtttcgcgcccggtcaaggtgatatgtcgcagcagcaacaagaagtggcttggattaacttagccatccgctccaatcaacatggcgatcgggtgaccattggtggtgtcaattatggcagtactccggttgaagtattgctgcctgttggtaaacatcagataaaaattgaaaaagagggcttccgcacttttgagcaagaagtcaacatcacctccgatcagaccattcgggttaacttgcatgaaaaggcgaaccctttacgtgtcggacaaaaatttgccgattcgggaaaaagtaaagtcagcgcaccagaggtgatcaccattctaccggggcaatatctgttgggcgaaaatgccgccaaacaatataaccttgatcatgctttcgcactcagctcaacgcccgtgacagttagccagtttgaaaacttcgtcactcaaaccaaatacaaaactgatgcggaactcaaaaatctctgtatttcggtgaatgaatcggaaattgctccagtatccgatagcgattggcgcaacccaggtttcaaacagagtaaagattcacccgttgtgtgcgtcagccagaatgatgccaaagcttatgctcgttggctttctaaagaaacgggctttacgtaccgattgcccacggaagaagagtgggaaatcgccgctcgtgcaggcagtaaaaccgattactggtggggcaataaatttggtgctggtaaagccaacacgggatgggcaggaacctcttggtctaacaaaagtacctccccagtcaaagccttcgctcctaacgcattagggttttacgacatggtaggtaatgtttgggaatggactggcgattcgcgcggtttagccaaaggtggcgcttggagcttctcgcctgaaatggcaaaagcctatagcgagctttttgttggcccaacaacggccgccaattatgtcggtttccgagtattgcgcgagctgtaatgttgactcaaacaattatgcataaaggggggatttcccccctttttcatttgtaccgcgttcggtaaagtacaaaccagagcatgagttgcatgactgatgcttggtatcaatatgatacctctgtgtgttcagcagaccctcgctggattcatggaacctcttctacacgtcgacaagatatgtttcttgtatttatgccagcccgtcttcaggctggctttttttcatccaaacagtccccgaataggcaagataagcttacaatcgaccttgctcttggtatcatatcgccgcatttccagtggaggatatggcgtgcctaaccatctgacattagagcagatttctttattcaaacaattacccggttattggggatgcaaggacttaaactcggtttttgtgtatgccaaccaagcctatggcgaattgatcggcttaaagcgcgctgaagattgcatcgggcgcaccgattttgaaatgcctagcccaacagcagcttgtgctgccgaatttcaacagcaagatcgctatgtgattgaaacggggcattccgtcaaagtgctcgatattcatccttaccctgatggccactggcatgcgcatatttttaccaagacaccgtggcgtgatagccaaggcaagatccaaggcaccattttcttcgggcaagatttaaccgacactgcgattcttgaagttggtcattgggtctgccgagcaactgggttatccacctccaccacatttaaatcggtcgccgatcgcgataccttgaaactgaccgcgcgtgaatcagaagtcctatttctgctcttatacggtaaaaaaccgcagcacattgcacgagtaatggggatttcgattaaaacggtggaagggtatgaggccaaactacgcagtaaatttggggcattgagcaaagaccaactgattgaccttgctttagatcggggattcggctcagtcatcccgaaaaccttgcttagaaaacaactttccgttgtgctgagcgatcacacgatccccaaaaaagttgacgttgtcgcccagtaagcaacaacgtcaagctgattgattgggcttatggcgccagtctatcgactgtccaattgtcatcttgccgcgaatacaagaagcgatcatgcagacgatgttcaccaccctgccaaaattccagactttccggcctgatgcggtaaccgccccagaagctaggcacaggaatttcaccgtttgcaaacttctgcttaagctcaagatacttgccttccaatactccacgagcagagattcggctactttggtggctagcgattgctgctatctggctctctttcgggcgcgacatgaaatacttcatgttttccatggcggtcagtttttccgccacacctgtgatgtgcacttgacgttctagcggatgccaagggaaatggaggctaattttgttattgtgcgcaatatgctgcgctttgcggctgcccaagttggtgtaaaacacaaaaccggcatcatcgacatttttcagtagcacgatacgctgaaaaggttgcccgtgttcatctaccgtcgcaaccgtcatcgcggttgggtcggacaagttggcgtcaattgcttgctgcaaccaaagattgaactggtcaattgggttggcctgcaaatcttttcttcttagaccaccatgaatgtattcgcggcgaatatctgaaagatccatttctgctcctcactgatttttgcccgattgtgcgcctatcccgctgataactcaagcgagcaaagtgatgccaaggccgacaaaataagatcacaaattctaaaaattaagtaatttattaaaatgctgaataggcctttcgccgcagatagcatatccttaacaattattggcccacgtaataaaatcaaccgactatcaatggtgtgaacaggaaccactcatgagcaatcgcagttataacaagctcaccgccgaagaattagactatgtggacgataaaaccgccgcactgctactcaatacgccgcacagcgcacgaatcattctctgggtcatggtggcattttttattctagcgattgcttgggcgtcatgggcagaaatcgataaagtcacggtcggccaaggtaaagtggttccctcctcacaagtgcaagtgatccaaaacttggaagggggactggtcaagcagatcctcgtccgtgaaggtgagcaagtccaaaaaggccaacagcttatcttgctcgacgacacacgctttcgctccgattttcgcgagcgcgagcagcaagttgcaaacttaaccgccagtgttctacaactttctgcttccatttcaagcgtcattatcgatgagaattttgaagagaagaactgggcaaatagcgtacaacttgattacagcaagcttgctttccctcccgtattgagtgatagccagccagatttggttgaacgccaacgagatcaatatcgccaagatctcgataacctgcgcaaccaattgtccgttctctctcaacaaatcaagcagaaacagcaagatttgattgaagccgaagcgcgaatcatcaaccttcgccaaagttatgattacgcgaaaaaagaactcgacatcactgagcctctcgccaacgaaggcgtagtcccgaaaattgaactgctgaaactacagcgccagttgaatgatactcgccgagagttaacctcaactgagctaaaaattcccgtactcaaatccgcggtccgtgaagcgatgctcagtcgaattaatgccgcgcaaaaattccgaactgagcagcaagataaactcaaccaagcgcaagataagctctcatctctcactgaatcggcggtcggcctcgaggataaagtgaaccgtacggtagtggtttcccccgtaacaggcaccgtaaaaaccctttatgtgaacacggtaggtggggtgattcaaccgggaatgaacatcatcgaaatcgtaccgactgaagacactctattggtcgaggctcaaattgcgccgcaagacatcgtctttctgcgcccagatctgccagctattgtgaaatttagtgcttatgatttcacgcgctatggtggcttagaaggcacgctcgaacacatcagtgcggacactacacaggatgaggaagggaatagtttctatttggttcgcgtacgcactaaagaaaccactctcgggcatgatcaaaatttgccgatcattccgggaatgaccgcttctgtcgacattattaccggtaaaagaactgtattagattatctgctgaaaccgattttaagtgcgcaaagcaatgcgctgagggaatagcccgccctatgaaacgttggattgtgctgtctctggctatctgtgcctcctcactctcgctagcgctcacaagcaaagagcaacagtgggtagatgcggtgaaggcaacgtatggccagcgagcaggcaaacgcgtcgaaacatggcgtcgcaaaatggctgagctcgctcccgcatcagagcaagagcaattaaaagaagtgaatgccttttttaatcagctcaactttgtcaacgatattcacctatggggctcgaaagactactgggcgacccccttagaatttctcggtagcaacgcgggagactgtgaagatttcacaattgcgaagtatttctcgctgttagaactcggtgtatcagataagaaacttcgtctcgtgtatgttaaagccattgaattaaatcaatttcatatggtgttggcgtattactccactccgagtgccgaaccagtgattttggataatatcaacccacaaattaaacctgcgtcgaaacgtaaagatctactgccgatttacagctttaacggtaaaaatttgtggttaatgaaatcgaataacggtcaattggctggggactcttcgagactcagtttatggaatgatttaagagcacgagagcgctcactgaaattaaataaacctctagttagctatgatgagtaggcactatgacgctatacaaacaactagtcgcagggatgattgcggtgtttattctgttgttgatttcggtttttactatcgaattcaacaccactcgcaacagtcttgaacaacaacaacgctctgaagtcaacaacaccataaatacggtgggtttggctttagcgccttatctggagaagaaagacaccattgcggtagagtcagtcatcaatgcgctgtttgatggcagtagttactcgatcgtacgtctgatttttctcgatgacggtacggaaatcctgcgctcataccctatccaacccaataatgtgccggcttggtttactcagttaaatctgtttgagcccatccatgatcggcgtgttgtaaccagtggttggatgcaattggcggaagtggaaatcgtcagccatcctggtgcggcttacgctcaactctggaaagcattaattcgtttaagtatcgcgtttttggcgatcttagtgattggtatgtttgccgtcgccttcattttgaagcgctctctaagaccactacaactcatcgtcaacaaaatggagcaggttgctaacaaccaatttggtgagcctctaccgcgccccaacactcgagatctgatttatgtagtagatggcatcaataagatgtctgaacaggtcgagaaagcgtttaaagcccaagccaaagaggcgcagcaactgcgtgaacgtgcttatcttgacccagtttctcatcttggcaaccgagcatactacatgagccaattgagtggctggctctctgaaagcggcatcggtggtgtagccattctacaagctgaattcatcaaagagctttatgaagagaagggctatgaagccggtgatggcatggtgcgcgaactggcggatcgccttaaaaactccatcaccatcaaggacatctctatcgctcgtatctccacttacgagttcggtatcatcatgcctaacatggatgaaactgagctcaaaatcgtggcagagagcatcatcacttgtgtggacgacattaaccctgatcctactggtatggcgaaagccaatttatcgcttggcgtggtaagcaataagcgtcaatccagcaccacaacgctcttgtccctgctggataatgcgttagctaaagcgaaatccaatcctgagctgaactacggctttattagcagtgatactgataaaatcatcttgggcaaacagcagtggaaaactctggtcgaagaggcaatccataacgactggtttactttccgctaccaagccgccaacagcagttggggaaaaacattccatcgcgaggtcttttctgcgtttgagaaagacggcgtgcgttacacggcaaaccaattcttgtttgcccttgaacagctcaatgctagccatatcttcgatcagtacgtgattgaacgtgtgattcaacagcttgaaaaaggcgaactgaccgatccactcgcgatcaacatcgcacaaggcagtatctctcaaccgagctttatccgttggatcagccaaaccttaagcaagcatctttctgtggccaacttactgcattttgagatcccagaaggctgtttcgtcaatgaaccgcattacactgcgctattttgtaacgcagtacgcaatgcaggggcggactttggggtagacaactacggacgtaacttccaatctctcgactacatcaacgagttccgtcctaaatacgtcaaactggattatctatttactcaccatttggatgatgaacgccagaaatttaccctgacctcaatctcgcgcaccgcgcataacttagggatcaccaccatcgcatcacgggttgaaacacagactcagctcgattttctttcagaacatttcatcgaagtcttccaaggcttcattgttgataagtaaccaaggtcagaggcatgcaagatacgttactcaattcgctggtgtacgtaagccgttattatggtttagcgaattctcctgaagcactgatcaacggcttaccgttggctgacggcaagctcacgccttttctgtttcctcgctcggcggaaagagctgggctgatcgcaaaagaaaaccgcgcgccgttagaccaaattcctcatctggtgtttcctgtggtattgctgctcaaaggcggtgaggcctgcgtactcaatagcatcaatcaggaaacgcaagaggctgaaattgttaccgcagagtcggggttagtccccgtcgcttactcgctcagtgatttagaagcgatgtatattggccgttactttatggtcaaaaagcagtttcgctttgatgaacgctcaccagaagtcctgaaacccagagatgggcactggttttggagcaccatctataaatccaagcatatttatcgcgatgtgttgatagcgtcactgctgattaacttgtttgccgttgcagcgccgatgttttcacggattgtgtacgacaaagtcgtccccaatttggcttttgaaaccttgtgggtgctctctagcggcatcttagtgatctttttgttcgatttcgtatttaaaatgctgcgcagctacttcattgatgtcgcaggaaaaaaatcggacattctgatctcttccaaactgtttagtaaagtgatgggcatccgcatggaggctcgcccaccttcggttggtgcttttgctcgccatttgcaagagtttgaatcgattcgtgaattttttacatccgcgacgatttcttcactgattgatctgccattcgccctgctctttttagtgttgatctggttaatggctggacatttggtgtgggtgcctgtgatcggtgtcctgattttggtgatttactcatttctcattcaaagccgcttaaaacgggcaattgaagaaggctcaagactcgcctcacaaaagtacgccaacctcatcgaaagcttagcaggactagaaacggtgaagctgtttggcgcgcaaggacaattccagtaccgctgggaagaagccgtagcgcacatggcgaattggaacattaaaagtcgccgcatcaccgatagtattcaaaacaccgccggttttgtgcagcaagcagccaatatcggcatgatcattgtcggggtctacctgatttccaacggtgacctgaccatgggtggactgattgccgcaacgatgctcagtggccgtgcgattggccccttagtacagctctcactgctttcaacccgttacaaccaagccaaatcttctatgactatcattgaacaagtgatgtcgatgcctgatgaacaggaggaaggcaaacgctatatccatcgtcccatcattcaaggcaagattgagctggaccgcgtgactttccattatccaaattcacctatcgcctccgtccgtgatttaagtcttaccatccatccgggtgaaaaagtggcgattattggtagaattggttcgggtaaaaccacgcttgagcgcttgatcatgggcctgtacaagccaactgaagggcatgtgcgaattgatgatacggatatctcgcagctgcatcacatcgatattcgccgcaatattggctgtgtaccgcaagacagtgtgctgttttatggctcgatccgcgacaacattacgctcggtcgcccactttccgatgatcgtgaggtaatggatgcggccaaccgagcgggtgttacggtctttactcaacaagatcctgcggggctagaacgtcaagtgggtgaagggggtatgctgctctcgggtggtcaacgtcaatctgtgtcgattgcgcgcgctttccttggccgccctcccgtcttactgatggatgaacccaccagcgcgatggataaccgctcagaaatgcacattaagcaacaacttagccaactcaagccaagtgagacgctgatccttatcacccacaaaacctcgatgctggatgtggttgatcgcgttattgtgatggagaaaggctgcattattgccgatggtccaaagcacgaagtgctgaacgatctgcgccaaggtaatgtacgcgcagtgcaatagtttggtgtctttaaatagacgaacccctcatacggttgagcgatgaaaaagggaacttaacgttccctttttcattattccgcagatttattactccacagacagattgcacgactccgcttccgctagcggacttaaataccaatatcttccgcttccaatagtgaagagagcttaatttcgtattggttaaatttgaaaatcgaggcgccgtgttctcgcttggtcagcactttctcatcaccaaactgaatcgtgacatgggtaaatactttatttttcgcttccaccgtattttccaatagctgctgctcaaactcttcattgagcatatccaaagcaagtttgattttttccatctgggtcgacgcgtctgctttcgcggtttctatttcttgagcttcttcatcgctacgttctgctttcggacgttttttaaactcgatttcacgccgaatcaacgccattgtcgtgtcttgagcttgcttatagagttctttgtgtttgttgattctctctttataactttggtaacgcgcaaaagcctcaacatgagtcgccgtgtcgccctccacaccgagattaaagcagagcactttcccacccactttggcgtttcctgcactgagtgtgccttgggtcattttgctgtcgagcaccgtcaaatcatttccgcaacggataatattgccaatgctgtgtacgccaagatggatagaatccgccgcttgtaactcaacatactgcgcgtagttagcgcgaatactgccgccagatttcaccacgcagctgcgctcttcatcatccgtcaccatgtgtccgatgatgcctttaccgacgtctatatcgccttgtgcttgaacgttagcagattcaataaaaccgccaaccgtaatcgaccccgtcgcgcgaacaatcatgcccggttcaatatccccagcaatcacgacattacctttaaagcggatatgcccagtggccacactgacatgatttaggcaaagcgcactgtccacttctatggtgttctttttaataaggggcatgccagcttgactggcaagcaacaaattggggtcattcggggagatatgggtacctttacccgccaccaaagcggattctttaccaggcttaggtgggataggtttgccctgaacggtgtaacccatctcgcctttggtcgcaggcaaacggcgcatcacaggatcattttcaccaaccgtgatggtttctcctaagttgcgcatatcgagtttattttcacccgctttctgctgagggcgcagcacgcgcttcgagacgtcttccactaatggtacaaattgagtatcacgcccttgaatgggctccttgccacgagcgacaggctgagtaaacacctcaccgggttttaattgaccactcaccagcagtacttttttcaatgccagtttgttaattcctttcagcacgctggcttgtgctagagcatgaaccagttcattaccgcgtagaccgcgtccgccataagctccagtgacgaccatgctggctagcatttctttctcaccaagcacaacagaaaccgtcgcgttacgcacttcagcaatcacgataccttcaaacgcagcgcgcttactttctttcacacaattgataaaacgagtgacttcctcatccaatatgaacagtttacccgctccaatttgtgccaacaccataggcaattcgctgcgattgagctccttagcggcaccttgtgcacctaattttgcaatcactttctgtctatctggcgtgagttcgagtatctctttccacataacgctttatcttttacggtacagaatatccatgaattgagtgtataagaagaatacagatagctaaactacgcagcctgcaaattcaggcttaggtcactctgtaaatcaccaaaaagagtcatttataaactaagcggaagggtgtagatgagaaaacgggcaccttttttcgcccgcgaaatcgtcaacgagccgccgtttacactgtaaaccgtacggcaaaggtcagtaagccatgccaacaaaacaataacgtcagctaggcagagaatagtgcagcgtgtctttgcgagcgaaggagtatactgcagtcactcggcggccttgattcgagtattccaaggactcacacaactgggtcgcaagaagaatacctcgcccatagcttttctgattgcttgcgtcctttaatgcttggcaatcaaaccctttaccactgtgttctaaatcgatttcgatacgctgcttatcaggttgataattgactttgaggattagccaatggtattcgggtaaggttttcaatcgtttatcacgtaactgatagaattcaaaaaaaccgtccggtgtttctttcaacgaggaatcgagctccaataacccgtgctctatagcattggcaaagagttctgaaagtactgaacagagtaagtcgagatcctcgccaccgctgacaatcccggttaaaaatcgacgtacttcattcatcagggaaattttacgcagaacatcggctgggaaatgcaattctgtctgtagggggatgcagctcaataccaccttaggtaaggctttatcgctcgagttactgttggtgatagggaacgtcatggtcaagatagagagatcatcccctttgccccgattagaaaattttttcaccgcatcatacaacgttggaatcaaagcctcggaataggcctttgtgagaacgtgttcaagacgctcttggccaaagtactctccttgttcgttcatcgcttcgataatgccatcggtatagcagaccagcttttggttaggctctagtttgaaatgctgcacatccgcctcaaattcattggaaggcaataccccaagcggcatatggttggagattaaacgactcacaatattcccatgatggtcaagtaaatatgcctcaggtaagccacctccccaccaagaaatttcaaagccattagcgcgaacttcaaacacgctggcagccagcatcattccaacgggcaaaaaacgctctagagagtgattcagctcaatcaccatctctcccagcgataaacccttttgtgcagtggagaagaaagttcgggttgcgggaatcgtcgagatcgccgcaggtaaaccgtgccctgtggcatctgcaatcatcacatagactccgccgtgaggccgattcgcgaccacaatcaaatcgccattaaaaatagtcgatggtgtagagatgtaatggatcccgaaaatgtgctcaacttgatggcacatttcttccatcaaattagtgaaaatcgattctgaaatcgcgtaatcgtactgaacttgctcacggaaatggcgcagctcatcacgttgttccataacctcattgtgcatcttcacaatgcgataatgtgcctgtactttggcaatgagtacgctacgctcaaccggttttaggatgaaatcgtcccccagtgccaaacacttttcaaacgaatcgcgatcgtctaataccgttagaaaaatgatcgggatatggtgcttcacaaacgcttggcggatctctttagcggtaacaaatccgtctttaatcggcatcatcacatcaagcaggatcacatcaggcaggatttccatttcacgcattgcatcaatcgcttgctgcccatcttcaaaagtgtctatgtgtgatgcgatgtgcgccaagataaatcggcacaattcacggttagtaccgtggtcatccactatcattactctcaccgctatctctccttatgagcgatttattcgatatcgaatttcttattaaagcgcgatatcaggaggatttttcttacctgaggtaagacattgacaatccgaatcgcgccgtccgcttgctcaaggtatttctgcatattgagcaacatgccaagcccagcactatcgatatagtcgactttgcgtaaatctatggtgaatcggtgatcatgccgtttggcataacttgcacgaaaatcgtggacaaggttgaagcaaaaagcaccttcaatcgaaatggtaatgtgtttattgtgactatcgatgtccgtatgcacactcatggtgatctcctaaaataactcaacttcgccttcatctatgctgtgctgattagcagccaatcccccacggttacgtgagcgttcttgtaatgcctcaatattttcaataagttgctgtacattacgtgaattagattgtaccgctttcagtaagccggacgcttcttgtaaaaaggtgattgagcccaatgcatactcgccttgttgatagactatgtccgtaaattgcaatgctcgagtaccttcacgaacttgttgagtgagctgttgacctagccgttgaagtttattcacttcttgttctatctcggtattcagttgctggacaccacgcagcatgtagtctactttttctttagattcaatggcttgagtcatatcaaatgaggccatttcacccactgtacggtttgcgatatccaccgtgtcttgggcgactttcatttctgtttcaatctgcgtattcaaattagcggcctgaatagagagattacggacttcttgtgccactacggcaaaaccgcgtcctgcctcgcccgctcgcgccgcttcaatggcggcgttcagcgccagtaaattggtctgctcagacaagctgcgcacttgattcagcagtttaaaaaccatatccagcttttgcgacatatcgtgaatgctgtgtacggcagagatacttttttctgacacatccaccaagatttgcacaaactgctgaatgatcgcttcggtcttcggtaacacctgcatcagatcaaactcactgccttggttggccattaagttgtccactagttgagtggagactgaagattgctcttcactcactctttgcaaaccaaagaaactgttgttgagcgtctccgctgaactattgattataaggcgctgtttttctaaaggttctgcaacacgctgaatgttttcttttaaaacctgctcaagcagactgagagcctgttgttgctctgccgataagcggacatcgtccgttggttgagctgttacgatactcggttgtggagctccccccgccaaccatggcagtaatccaatacagatagcgatcaatcctaaccaccaaatctgcccaaactgaaaaatcaccagcagcaagagtatttgcccaatcagtatcgccgttattttgtgttttctcgttatcatcctaaacctctcgacgtctttctgctcttatgcgtactgatgttatgcgtgcttcttttgtagttgttcaacaatccaagtcgccattgcccctaaaggtttgacgacatccgcagcccccagctcgatcgctactcgcggcatgccccaaaccacgcttgattgctcatcctgcgctgcggtcgccgctccttgttgatgcatcgccaacatgcctttcgcgccatcttgtcccatgccggtcaacaaaatccccatcgctttactgcctacatgctgagcaattgaattaaacattacatccaccgagggtttgtgccgattcaccgcaggtctgtcatctaactcaacataaagtttgccagcccgtttcacgaccacgatatgcttatcgcctggagcgagataggcgcagctactctcaagtgctgtcgttggttgtgtcacctcttgtacatggagagcgctgctgtcatttaatcgtttcgctaaggaggccgtaaactgcgcgccaatatgctgagtcatgacgataggaggtaagccagaaggtaatgctgcgaggacttgtttgacggcttccgtaccaccagtagaagagccgatagcaatcaactggtaatcggtggaaactcgctccgtaatgggcgctgaaaccgtcgcactctgcacaaaccctacattggcttgtgccgccattttgattttgtcattcaccaagtttttataattgagcatttcagccgggttatctgaagaaggtttggggaaataatccacagcgcctaactcaagagccgccaacgttgcttccgcaccgtgctgggttaaggtggagatcatcaccacaggtaatggatgaaggcgcatcagatttttaagaaactgcacaccattcattttgggcatttcaacatctaaggtcaccacatcgggttgatagtgcttaatcagttcacgcgcttggtaaggatcttctgcgctcgccaccacttgcaacgcggggtcgctatcaatcaactgggttaataaagcccgaaataccggagaatcatccacgatcaagactttgatttttttcattgaaacaactccacatcgtcagagggaatttgcttatctatgctgtgttgatagagttcttcatcctgtttaattgcatgcgccgaactaaatccaatgcgttttacccatgcctgcccggtctgtggatcaaacaacaattttcgcggttgagcgcctcccaaatcttgcgccacgacgtttagcttttcacgtttggcatactcaagcacaaactcgacgtttttttccccaaccagcgactggtaccccattaagtgagcgccaccaaacagtttaaacttcaatctctctcgctctgcccccatggacaataaccgattaatcaagacctccattgcataacatccgtagcgagaagagtccgacaataacgcttgtggatgccaatgttggctttcaaattggttattaaaaggcagcaaaaagtggttcatacctcccactttcatctcaatatcccaagcacaagcagacacacaagaacccaatccagtatgaataatttcttgatcggacgtagcatagacgcctcccggcatcactttgacccaatgccgatgatcactagggtggttgaagcgataatattggcctttcgcttcttcctgttttagtttgcgcttagtggcaagtttactgtctgacataaacagtatgtcccagatgatggaaaagcgaactgcaacgaccaacactctctgaatgccctagcatcagtacgccacccggcttgagttgctggtgaaaacgttcaatcaactgttcttgggtcggacgatcaaaatagatcatcacgttgcggcacaagataagatccagcttctgtttaaacggccattcctgaatcagattcaattggtgaaagtcgatatagcgttgcaaactctgtttaatcttcatattgccttgctgatctttgaccccacggacgaaacaacgacgcaaataccgttcaggaatcgagctttgcgattcaatgggataaatccccaaactcgctttctctaacactgccgtatccagatcggttgcccaaattttgatatccggacaaaagttcatgactcccgcatgatctaaaaccgacactaaagtgtaaggctcttcaccggtcgaacatcccgctgaccaaaaacgcagttggcctacccgctctttactccactctggaaccaatactttttcaataaattcaaaatgatggctctcacggaaaaattctgttttgttggtggtcaaggtattaatgaagtgaatgcgctcctgctcatcactttcaatcagctcacgaaattgtgtaaaacggcgtaaacccttacggcgcatctgccgactcaagcggccatacaccatggtacgcttggaatccgggagataaattccgaccgttttatgcataaaccattgaataaatttgaaatctttatctgtgagttcaaattcttgctcattgaccgccaacatacgttatccctagattagaattcttcccattcgtcaccttcttctgccgcccgagctggcattttatgtacggcctgatttatcggtgctttatgcatgctaaccacaggcttggttttgggtggcgttgattggcgaggtttgcgctcaaaagtggtgacattattttcggtgacaaagaaattcatcaaattaagcagctcttttccttcatctttgagtgactgactcgccgctgatgtttcttccaccagtgaagcgttctgctgggtcatttcatccatagcagcaatcgctcggttgatttcatcaatgcccgtggattgctccacactggaagcggcgatctgtgcaatcagatccgagactctcactaccgcttcaacaatttctttaagtgtcgatcccgattcattgactaagcgtgagccttcattcaccttatcgacactatcgttaatcaaacctttaatctctttcgccgctccggcactacgctgcgcgagattacgcacttctccggcaaccacggcaaagccacgcccttgttcaccgacccgcgccgcttctaccgcagcattcagagccaacaagttggtttggaaagcgatttcatcaatcacgctaatgatgtccgcaattttcttactggcggtattgattgcccccatcgcgctgatggcttcaccaaccacttctccgcctcgggcagcttttttcgccgcatcggtcgcaagtagattggcatctttcgcgttatccgcattttgacgcacggttgctgttatctcttccatactggcggcagtttcttccaagttagaagcctgagcttccacacgctggctgagatcgttattgccatccgctatctctgtagaagcggtcgcaactcgagcagaagaaacggtaattttgtcgaccatattgcgtaggttcacaatcgaagcgttgaccgcactggctaatcgaccaaattcgccttggtactcttcagacatgctggtattgagatcgccttcagccactcggctcatcaccgtaatacactggcccaatggttccaccagcgtgttaagcaagttattgatgccatctcccaactcacgcataaaaccgttgtagccactggtattgatccggtcatgcaggtcacctttaatcgctttttggatcaaagactccacttggcgctggccatcacgctgctcggtgatatctacccattgcaacgcaggacctatgtattcgccttttgtatcgcgcatcgcaatacaagtcagattaaactctaaagagcccactttgatcatggaggtgaaaggcaagcgttctgggttactaatgatcgaacgctgatgtgcaggatttttatggaaaatgtcgatatttttccccaccaactccgcggctttaaagccgggaaaggcctgcgcgagttctggttcacggtgggtcaacagttgtaacagtgcggggttaagatattgaataatcccctctttatccgccatcatcaaattcgtcgtcatgccttcgaccgccgaagctaaacgacctatttgctgatcacgcaagagctcttcggtcacatcacgccattccaaggtattgccaatgtaagaaccacgatcatcaataatcgcgcctacaatcagctcgatttttactcctttgatgttgatgacggtggtgtagggtaaatggctcggatccgcgagcatggtgcgctgatggcgagggttaagatgaaaatggtcaatgcagtagccatgtaaaaaatcggcctcggcacgaaaatcaggccagacgctacgaaacaacgtttcgtgttgttttagcagcttgagcgtttgattattgaagtaggtgatccgaaagtcgcgatctatcatcatcagtgctgtttgtgccgcattgagtgcggaaagcaattgatagttagataaaccgctttgggtctccgactcgtcaaattcgctcgtggcgctctccttggctggctcaacaaactggggcacaacctgttgtttacgattccaaaatgccatgtgtcttccctcgttatatgctttcggcagtggtgcttaagcgcagcgcctcaacgtcgaacagcgcatcaatatcaataagaacaagatgtttgcttttcactgccgcaattcctttcacgtattggttgccgatcacagtggaaatactgggcgcatgtttgatctcttgctcagacaaggcatacacctcagcgaccgcatccacaatcagccccaacggctgctgattcgccgcattaatcaccaccaccactgtggtggcgttaatttcaaccggtactaagcctaagcgacgcttcagatcgacaatcggaatgtactcgccacgaatatccaacaagccaatcacaaacggtggcgcattaggcaggatgcgcacaggactccatccacgcacttcacgcacttccagaatcgggatgccgtactcttcatcatctaaaacgaaactgagaaattcacgctgcatcatgcttgtccctcattaaggattcggtccatatccagcaatgcatcactgtctagcaaagacatcacctcatccccgacattcaaaatgccacttaaaaaaggcaccaccatgctctcaccgattgccggatgcagcggcatatcgccttggccaatcacatcgctgacggaatcaaccactaaacccatcaggcgtttttgctcttgttcgcgagcactcaagatcaagacaaccgttgttggcaaatactcgtattgggtgagtccaaagcgttgacgtaaatcgataatgggaacaatcatgccgcgcaggttaatcacgcctttaacaaaatgcggcgctctcgggatcggcgtaggtttttcccaaacgcggatctcttcgacatgagataaggtcaccccgtaaagctcagttccgagcataaaacttaaaaaatctgcgcccccagtcagccccatatccatcgacaagattggctcaagagcggcactggatgatgtggtcaaattcgctgaattcatacctgctcctatgccgctttgcctttggtcgtggaagatgaactgcgcttcataaagtgggcgatcaagccaggaatatcgaggatcaaagagacggagccgtcacccaaaatcgtggctcctgagatcccagccactttcgcataattggattctaggcttttgatcaccacttgctgctgatcaagcagatcatccaccagcaaacctaccctatgtcctgctgattcgacaaaacagatcaagcgcttctctaaactgccactgcgccccatcgcaagctcatcttgcaaacgtaaaatcgggatattttcttcgcgcaatcggtagagttcgatcccgcctgccgcatgtttgacactggcagtgttgatctgaatcgattcgacaatcgtcagtagcgggatgacgtagacctgatcggccactttgaccatccaaaatcgccagtgtcagaggcagactgatggtaaaacggcttcctcgacctaattctgaatcgacttcaatctgtccaccgagctcttcaatgttgcgtctcaccacatccataccgacaccacggcctgagatgtctgagacttgctcggcggtagaaaacccgggcgcaaaaattaaattgatgatctgtttatcggtcagatcactacgttgggtctgaggctctaacacccccttttccaccgctttgcgccaaagcttgtcgcaatcaatccctgccccatcgtcactgatttcgacaatgatcgagccaccttgatgaaaggcttttaacgtgatcactcccgtttcaggcttacctttggcaaggcggacatccggcatttcaacaccatgatcgataccgttgcgcaccaaatgcacgagaggatccacaatccgttcgagcacagttttatccagctccgtttgttcaccttggatttgtaaatcgacttttttccccaaacgaccacacaaatcccgaactaaacggggaaaacgactaaacgcaaaactcatcggtagcatgcgaatattgagtacgttttcttgcagatctttactgttttgcagcagctgcgctaaaccggcttttaacttgtccaatttgtccattgaaaagtcattaccgagttcggtgagcatggattgggtaatcactaactcgccgaccaaattaatcaggttatcgactttctcgatatcgacgcggatagaggagacacttgagtcggttttcgcaggcttgttagtcgcggactctttggggttagcgatgacaggagcgacagttgcaaccggcggttctaccgcaggtaagtcaacgatggcaacaggctcgacctgagtttggggattgctttgaagcgtcgctgcaggagcagcctgctcatcctctacatgagcgctagcctcgtcactgagtattggggcgatgtgcaaatcacactcatcttcaacccagtcgaacagctcacgcacatcgttttccgacacatctcctgttaaccggatcgtccaactcagataacagagttcaggatcgatttcagctaactctggtagagcttgatggtctagctctatttgatattcagaacctaactcacgcagctcacgtaagatacgcagcgggtcattaccgctataaaacagtgtttcatgaggaacaaaacggatgcgccagccttgtgccgtcgcatctgggattgcaatagcatcggcgtgcatattcgatgtgtgcgtattggatgatacgggctgcgcttgactcattaccctatcggctccctgatccgctaacaaggcttgcagttcagccccgacttgctgtttcaaggcttcgtcaatcgctgtctcttgttcccgactatccaacatgttgcgtatgacatcgcagcttttgagcaaagtatcaacaccttgtgcggtgagctgctttttctggttgcggattaaatcgaggtaggtttcgaccgcatgggtaaattcgctgatctcatgcaaattgaaggtgccggctccccctttgatcgagtgagccgcacgaaaaatcgtattgagtacctcaagatcgacctgagaaggatccagttgcaacagttccccttccaaagtctcaagattttcacggcattcaacatgaaaaatcttgcgcagttgttccatatctaaagccataactcacccgcccactgactagttttgattcttttagagttcagctttttacaaaacgcgctgcaaagtttttagcagggtttctgggttgaagggtttgactagccatcctgttgcaccgactgctttgccctcttgttttttttctgggctggtttcggtggttaacatcaaaatgggagtaaacttatactggctttgcatacgcaccgcttttacaaactcaaaacctgtcatcactggcatgttgacatcagagatgatgacgtcaaaacgcgccttctgcgctttggctaaagcttcacgcccgtcggctgccgtttcaacctcataacccgcgtcttgcaaagtatgagaaaccatttgtcgaatcgaaattgaatcatctactgccaaaacttttgccatagtgtttccctcattcactctttagctgcatcaggtctgccatccccagcagggcaagtccttcagctaacacgtcagataattgttcaaaatggatctgctgcccattgtgctgtgcggtgataaataaggaagccaatagttgaacacccgcggcatccacccgagcaacggcgctaccatcaatcactatcggtgcttcttggctcatccacggcaaaagctgctgcttgcactcttgtacatgcgcaatgtccagaacttcattcagtatcaacatggaaatccaaacctttaagatgaaatgaatagtcaaccattttcctacttcccatttttgagtttaggagggattagccaattatcaaatgcagcaagaatatctctcaccaaagtcgtcgtgtgctctgcctgcagtaatcgacaaataccagtggatcccgagtttcaagattgtttattttttcaaccagacacatatagacatgatttttattctcatgctttaattaattgttatgttataacattttaattaaggacattttgatgaaaaaaaggttgttcggtttgattttagcgctaggaggtgcagggatttggttgacgaaaacggagcctgcaccgagttcgctggagatttcaggcccctttgagtttaacagccaagatttagccaaggacggattcctgttttcgcgtctacaagtggttgaatccttggttggcatcaatgagaactcacaaccataccctttgctggcaaaaagctggacggtaagtgatgatggattagtgtggcgtttccaaatacgtcctgaagtacaatttcacgatggcagccaattgacggcacaagcggcggcgacggctcttaatcatgcgctaggtaagccgggagtaataaaacaagtaccgatcaaggcgattaccgcgcaaaacgatcaagtggtgattgaacttaacactgtctatcgcccgctcgcagcggtgcttgctcactactcgctcgcgattgcctcccccagctcttatgatgccagtggtaacgtgattcggctcttaggcacggggccttatcaaatcgcacagttgcaagcgcctcataaagccagtgttatccgctttaacgcttattggggtaaacccgccagtatcgaaaccatcaattatctggcaggccatcgctcagaaagccgcgctttgttagcacaaactgggcaagccgatctggtctacacccttgaccctattagcattccgagtttacaacagagccacaatctggatctctacattgagtcgatgccgcgtacagttctgatcaaactcaataacgaacaccctttgcttaatcacgccgatgttcgtcaagcaatcagtttggcaatcaatcgtgaaggtattgctcaatcggtacttaagttaccgggatcagaagcgcatcaactcttttctcccgcactcggagcttggcacttagcagacaaaacacagccgcagcgtcatttagcgaccgcgcaaaccctgctagccaatcaaggctggacgctcaatgaccaaggtttactggagcgagaaggccaagcgttccgagttcaattgctgacttatgctgatcgccctgaactacctttgatcgccaccgcgctacaagcccagctcaaagagattggtattcaagtggatattgcgatcgataactcaagtgccatccccgccaaacatcatgatggcaccctagaaatggccttgattgcccgcaacttcggtactattgccgatcctctgccactgcttttgagtgattttgcaacgcatcaaggatcggattggggcccaaccaattggtcatcacctcagtttagccaactgctggctgagctttcgaccgaatcagacaatgcgcgttatcagcaattggccgcccaagcctctcaattactggccgatgagatgccgctcatccctgtgacttattaccgccagattgtgtcggtcaataaacgagtcgctggattttcgtttgatccctttgaaattaactaccgcgtcgcgcagatgagtttcaatgactaagattcttgttcaccgtttttaccaggccctctttgtggcctggtccgtcggcacactgacctttattttgatgcgctttattccgggtgatgtggcttatcgcattgcagcaggtcgctatggctatgattatgtcaatgccgacgccgcacttgcagtgcgtgctgagctagggctggatcgctccgcttttgagctttacttgcaatggctatgggatttactgcatcttaatttaggccattctctggtcagcagtgaacccgtcattcatgcgattatgcataatctcggacacagcctttacttgcaggcgctgcaacactgctctcgctgtttatcgcgatcccaattggggtctattgcggtaaacgtaccgatcggtgggcagataaccttgccctgctcacctcaatcatgattaaagcgcagccagtatttttgattggtctggggcttgtcatcctgtttgctttacaactgaattggttgcctgttgctggatttggtcatcccaaattccttattctgcctgcgctggctttagcgctgggtatggcagcgatgtcgagtcgcatgatccgtaatgccactgctcaagtgttgcaatccccctattacgctttcgcgcgtttgaaaggtttgaatcacgagcaagcctttacgcgccacgcacagcgtaatatcgcccttcctgttatggcgtttgtcggcattcaggcggtgagcttagtagaagggatagtgatgattgaatcgctgttctcttggcccggtgtgggacatgccttgtcacatgcgattttccaacgcgatattccaatgatccaaggctctgcactggtgatgggattattgtttgtcgcgctcaatacgctggtcgacttagtccaatacgcattagaccctcgcctacgtttaagccgacatgttcaaccagaggcctaacatgaaactgcacttatcgaaaccacaatggcttggggtgagcctgctgattttgctcgtgatgctcgtgctgatcgaacatctgctgtatggcggcgatccggccaaacaagatctcaatcgcgctttagccgcccccagttggggtgaaccgctgggtaccgatcactatgggcgcagtaacttcgcacgtttaagctctgcaattgcgacctcgttaaccatggccgtcgcttgcgtaagcagttccgcgttactggggttagtcactggcgtggtcgcagcatggaaacgcggttggtgggatagaggcttttcttggctactcaacatgttgctggccatgcccggtttaatcttggtgttactgtttggcgctatggtaccgggctcttttttcatcctctatctcgctattgccttaatgttatgggtggaatttttccgcgtagtgcgcagcaaaaccctctcattacttgaacagccacaaattgaagcctcacgattgtatggcttcaatgcttggtatctatttcgccgacatctttggcctgagctaagggaagatctcttcacgctggcctgttttggtgcgggtaacgcgattttagcgctcgcctccatcggctttctttatgttggacttaagccaccccaagcggaattaggcatgatgatggtggagctctttcgctactatcaccaagccctttgggtactcgcccaacccatcttagtggtatttattttagtgttaagttttcaaatgctggccaaaggaaaaatatcgtgaccgcgctcctctctgtacaacaactcgcgatttctactgcgcaagaaaccttagttgaaagcttgtcctttgaactgcatgctcaccaagcgctgacgatattaggtgaaacgggatcaggcaaaagcttgttggcgaacgcgattattggcaatttgcccgctgggctgcgtagccaaggtaagattgcgttatttggccaatatcaacatcagcgaactcaagcagaacgtgaagcgctatggggaaaacaacttgccgtcttgccccaagagccttggcatgcactcaacccaatcatgcgcgcgggcgaacaagtggcggaggtgcatcgcttggtgatgggcaatcacgccgctagcgcagcattaaccgactccgcttttcagcaagtggcacttcatcaggatctgagcaagtacccacatcagctctctggcggcatggcgcaacgcgtcgcctatttgtgtgccacccaaacgcaggcacctttgcttatcgccgatgaaccaaccaaaggtttagatgccagccgccgcgatcaaatcattgccttattgcaagcacaattaactcgtggtgcgttgttaaccatcactcacgatatcgaagttgccgaaaagctcggtggaaccatcattgtgatgcgcaaaggtgttattcaagagcaagggccagcccaacaagtgctgagtcatcctcaatcagattacaccaaggcgctgattaacgctgaccccagatattggccaaccacaccgcagagtaaaacaggagagcccctgttgaccgtggacaatatcgccatgcatcgcggggagaagtgcttgtttgattcgctgagtttcaccctcagcgccggagaaattcttggcatcagtggtgatagcggctgcgggaaatctactcttgccgatctattactcgggttacttaaacccagccaaggccgtattcatcgcctacaagcgatccctctcggtaaggcactgaaactctatcaagatccgcctagcgccttggcgaaaagcgtcactttacagacactattggaagatgtgtgtcgtcagcattcggtcgaacgcagccaaattcctcgtttactggaacgcctcgctttgtcacccaacttactgtcacgcaaagccaatcaagtttcaggcggagaattacaacgttttgcgattctgcgcgctttactgacgcggccaacactcttagtcgccgatgagcccacctcgagacttgaccccatcacggcagccagtaccttgcagttaatcatcgagttaactcaagagatcggctgcgctttggtcttgatcagtcacgacaagctcgcccttgagaaaacctgccatcgtgtactctctttgtaagacgagtcttgtcattcatggggccgaatggcctcatgaattcgtttgtttcaccctcgtttacagtgtaaatacgattaccccaagcaacttaaagtggctgataagcagcaaataggaagggatacacagtcaatggtgcaggtaaaccgataatccacatggattaaccctttggtttatctcataccgttttcttaagcgagtattaagaaaccccatttataaatggcttaacgttcacagaatttagcgtggtcatcatgccgacattcaacattaagccattctcctatctccaattagtctttttgctggcagcctattttgcgctgccactcaatcttccggtttacgctcaattagcgcatattttcaaccaatctacgtcccttgattggggattcgccctctctattccgttatttttcctgtttgcactgaattttatcttccagattttcagttggccttacttgttcaagcccttttttgctgtgttacttgtgctgtcggccttaatcagcttcgctggctttcaatacggtgtgattgtcgatcaagatatgttagtgaatgtgttggaaaccgaccgcggcgaagcgggatcttatctcacaatctactctgtactttggttgctcgggtttggcctcgtgcctgcgctagctctgctttttaccccaatccgcccagaaaaaagtgccctgcgttttttgatgaaaaaggggctatccatgctggtttccgttgtcgtgattggcgtgatcgctgggctttattatcagaattactcgtccgttggacgcaacaacagctcactcaaaaaaatgatcatcccgacccattttctctacagcagttttgggttagtcaaacagcgctatttcacggaaccaatggtgtatcaggagatcggtcaggatgcgcagcaaaagccaagcgccgttcgtcaggcaacccaaaagccgaccttagtgttttttgtgttaggtgaaactgcacgagtacaaaactaccaatacttgggttatccgcgtgataccaatgcttataccgcccctttccagccgatcttttttaaagatgtggcgagttgcggtacagcaaccgccgtttcagtgccttgtatgttctccaacatgaatcgccaaaattttgatcgctctcgggcggacaaccaagacaatgtgctggatattctgcagcgtgcgggcatcagtctgctctggaaggaaaatgacggtggcgataaaaatgtcgcgaagaatatcccgcttaaagagttagctagagataaccgagaagggatttgcgatggcgacacctgttacgacattgcgatgttagagaatttagatcaggagatcgccacgcagcagggcaaccgaatgattttcatgcatttcatcggtagccacggccccacttactttaaacgttacccaaaagagatggcagtttaccagcctgactgcccaagagcagatattgaaaactgtagcgtcgagcagatcgtaaacacgtatgacaacaccattcgctacagcgactatgtgatgtcgcagctcctcgctaagctcgattcactgcaagaccgatataataccgcgctgatttatatctccgatcatggtgaatcattaggtgaaaatggcctgtttttgcatggtatgccctatagcctagcgcctgagtaccagactcgagtccctctccttatctggatgtcctctgggtttagccaaagtaaagggattgatgttgaatgcctgcgcagcaacagtgaattaccttatgcgcaccagaatctgtttcactcactgctcggcgtgatggatgtatcaaccaaagcgtaccaagccaatttggatctgtttgcgaagtgtagaaccagccaatcttagccatacccaaacaacttagccttaggtagcgggcaaatgagtgcatccccaagagcataggcaagctctatggcttggggtaaacgaacgtagccaacaccgcgacaacgttaagcaggaaggggataaagccacatgataagttaggacgttattcgcaattgcgaaaacgaacaacaaaggtattacgctcatcagtacgtggcagcaagagcacttgaccgccatgaagcgctgcaatatcacgacagatcgacatgccaagccctgcgccatcgcctttttggctgttggcacggtagaagttatcaaacattttttcacgagtcagatcgtcaatcgcggccccagtatccgacacacgcacttcaatctcaccatcgtggtcgctaagctctaccgctatctggctagagtggccggaataacgaatggcattatccagcagatttttaaataaaatgcccaggagtaactcatctccccataaacgcgaactttcgccatgaaaactcagctgctgatcctgcttaaaagcgataggtgctaaatccgctatcacttgtttaatgacgtttgccagctcaaccggctgtttccttaaggtttgtgtactttctactttggccagcattaagagctgatgaatcaatctatcggtgcgctctatacctttgaaaatacgttctaaatcttgctttaactgttcctgattggtgctacgcagggcattttcggcattcactcttaaaacggtcagcggggtttttaactcatgtgccgccattcgagtaaaacgtttctcacgctgccatgcttgctctagctcattgagcagttgattcaacgtctccaccaaaggcaaaagttccaccgtaggtttttcgacataaattcgatctagcttatggatgctgcgcagagcaatcgctgctttcagcgcttggattggctgaaagctacgttcaatcagcaccaccaaaaccacaatcaagcacagaattaaaattaattgcggaagtgcggtggataaggcgatctcattaatcgcttcatcacgaatgctttgcttttctgcaaccaaaacatactgtttacccttttcttgatcagggagactcaactggaaataacgccagctttcgccgttgagcgtgatatcactaaaaccattcgcatcacggccaagactcagcgcaggcaaatgagtatcagagctaaagagaagatcgccctctcgataaaactggaataataaatactgttcatacgggtggccaaagagcgtggcgacatcatcgttggctttggaaaggcgctgaatatgctgcatccacagattgaactgctcatgctgattacgatctgcaaattcattggccgaaacagaagtggcgatcagtaataatttggcggactgcccaagacgggcatcgtacacttctcccacttcatgttgggcgttggaataactgaacccaaacgagaccagcatcaaaccggtactcagcaaaacagaagtcagggtaagtcggcgtttaatggaaaagagaggtttatttttcaatcatgtaccccacacctcgtacatttttaaccagattatccggcaattttttgcgcagattatgaatatgtacttcgattgcgttatcactgctgccttcatcccagccgtgcagtgcttgctgcaaaagctctttactcatcactcttcccgcttgggtcatcaaactggcgaggattttgtactcatttcgcgttaatttcagagcttgctgagcgtagtagatttcttgtttagagagcgaaaggtcaagttccccaacggagatgagctcctctgcgctccctgagctacgacgaatgatcaagcgtaaacgtgcgagcagctcttcgagcgcaaacggcttacctatgtactcatctgcaccgccatccaaccctttgacccgatcactgatatcatcccgtgccgtgagtatcatgacaggcaatgtataacccgctcgccgaatttggcgcaggacttccaagccatccatatctggcaaggtgaggtccaaaatcagtgccgtaaattgctcggttttcagggcggtcacgacgccaccaccccgctccagccagtcaaccgtatagccttgtcggcttaacgctacttgcattgattcaccgagcaacgtgtcatcttcaactaatagtaaacgcataaggttacttgatgctctccaataagtgcgcaatctcttcctgacgtcccgcatccgcaatttctcgtttcggtcttgcgggtgcatgctgagcttgcagtaaatagcgctttgcctctgcgctacggccttcttgtagcaaaaaatctccgtagaaatagttggcatcaatgccattgggattcacggtcaaggcttgtttaagcagctgctctgctttttctttatccccaaaggcgacaggccaacccggcactttatagtatagcgtgcccaaactggtcaacgcggagccttccagagtatttggcgcttgcgcgatgacctcttcaaataaacttttggcctctttcaccagcgataaagcccccaatccgcccctcactcccgctaaagaagattggttgatggccagccacactttcaactcggggttatcgcccgaaatcgttaactccagtcgattacgcgcgatcgtgcgttcaaaacagcgctcttgctccttagcagaagcggtacggtattggcattttgcccaatccgtttgcacttgttctaaaggcgtaatcgcgtaacttgagtgggcatacccgagcaacagtgcgctaagactcatccatttaagcataatgttcataaactcttctccttgaattatcacgctttagcgatttaaaaatgacaataagacgggttgttgctttctaattgcccgagaaaccaagctcggcagtagttggttaagacgcaccagaagtttctccggccaaccgatccacatgacgttttgctccgtttcaatcattttggccacctgcgcagcaaccaaggaaggctcatcactgcgattccccagtgctcgattgagctgttgaacggcctcactgttgagcgaagtattggtggctcgtggcgctaaatagagcactttcattcccgtccccgcgagctctcggttcatcgcttcgctaaaacggtgcaatcccgctttcgcggcacaatagctggcatagcccggataccctatcgccccgagactggaaccaatattgatgaccatctgcggtttacggctccattgcaaaacatggtgcatgatttggattggcgtcattaaattcagagctaactcacgctgcaccgactccatcgaacgacgcgccaacaaacagaactgattggtccctgcattattgatcacgacggcgatgcgctgctgggcgcggtttaattcttccaccaaagcctgcagttgctccattcccgcttcactggttaaatctgcgctcacaacccgatgcagctcaggcttggggagtgattgacgcaatgcttcaagtttttgcgcatcacgcgctaacaagattaaccgcgcaccacgcgccgctaaagtatgggcgataggctcgccaatgccacctgaagcgcccgttaacaacacatattgttgatgaatgtccataaacgcctcctaagctgcctgttgctgggtctggggcagtaattcacgcaacatctgcccatacagataaaacacctgattcgccgagtggataatcgcttgctgatcctcttccgcggtaattttgtccattaaggattcgaagaagcgaatgtggtcttgatccagttcactgtgtgaggtgagatagctcatggctttagcaggtaaattgagctgctgtttgaccaagcgcgctatgttgccgcccacgcccacactcgtcccttcgagcacccagaccataccaaacaacgcgagcggattggcgctatcaatctggtggtaaagataagcgaccatcaattcaatcggtgtactgacttgccccaccccttggttatttcgcaccgcttgagcatcaccaccacaaactcgaatatcattgaggatccattcttggtgacctttctcctcatcgatatagtcggcaatggcaatgcgcacccactcataacgatcactcaatcgtcccccacacgccattaacagtggtacggtatgtttgacgtgatggtaggcttgggtcaaaaagcttaagtacatgtcaagcgtgatctcgccgcgagcacaagctgcaaatactggagcttgtaacatctgttgctgagccgcttgcgtctctttttgtaaacgttgaaaaaatcctgtcatgagagttctcctcatcgtgagcctcaaagaggcccgaacgacttaccgtgaaatgtcgccaataccgctaccgcttcttgccggaaggggatacaggtattgccaattgaggtcgggcgcattacgcactcgacgaaaagtgtgctgcgcgttctcaatcaacgctcgcttgggtcggccattggccgtcaaccaagcctgccatgcgctcggctgattgacgaaaagcagttgttggatctgtgcgtagtcgggtaactgatgatttatttgttgcacacgttgctccagatcgggcattaggcgatcaatcacagccactaaccccacctcatcatcgccgaccaccacgaaacggcattgcggtaaccaaacttgcgcgtgagactcaatccattccggtgcgatgttgcgcccaaacggagtaatgatgagattttttttgcgccctacgatacaaagaaatccctgctcatcgagtgtcgccagatcacccgtggcaagccattcgtcggtcaatggctcgccgatataacccagcgcactattgccacgaacccacaattcaccatcttcagccaattggatttgtagatggctcagcggcttgccacaactaccgggctggtcatgttgcggtgtattcatgctaaccaccgaagcgcattcagaaagtccatagccttcataagcaggaatgcccagagctcgtgcgctatggataagttcagccgcaacgcgcgcgccccctaccgccacccattgcagcgacttcgccaactcgggagcctgtttcaccacctgaatcagcgccatcaataacgctggggtaagaaccaaactggatggctgataaacgctcaatacgttggcaaactgagtgggagaaaattgactagagccagacagccctaccgattcaccaaacagtacgcttgaagtcaccccgagcaacaaaggcacgtaaattcctgtgatattttccagcagcgtggcgagcggcaacatcaccaaatgctgctcaacttgcgcgctcatctgctctgcgatggccagcgtaacgcgctctagattttcttcactcaaacaaacacctttcggggtgcctgttgagccagaggtgaacgtgattttttgtgtacccgccaaaacgcgattgggtctattcctcggtttattgccctgatagtgccaagcgtcaaagccaccgactgtcagtgaaggcgaacccaactcaggccaatcaccaagacagagttcaacattcgcctcattcagtaaatgagcgacttgttctgatgtaaaaaaggtcgggacaggaaccataacgatgtgtgaccacatcgcggctaaatcgagcgcaacccagtcgacactgttttgtgcacgtaatgcgatgcagtttgcggataaccgctgcagctgattagcgatcaggtcgactcgctctaacagttgagaataattgagagctatcctctcttgctgagcgttatggccaacaaaagccattttctgcggttggtgcaaggcatgctgctgcagcgcagcgagaattcgattcatctttcactactcacgcttgcttttgattaaggtgtaattgattgagatgggtgcaaccatgcactaaattgcccgccaaaatacgcggacggtgctgatagtaagttccccagatttgagaagcattgggaatacgagctggagaagcttgggcaatcaaggtgagttgcaggccaaaacgacgcatcagggcatgcagaggatcggttgcagtaaaaatgcaccactcaaaccccatggcgaccaactgctgtgccatcaaacgaaagtgaaacgctgaaagcccgcgaccaaaagaagcaagatggccaaattcaatcaacttgccacgaggtatcggacatgcaaaacgttgtgcaagaagacgatcggcaggctcatcgagatattgttcaagaaacagcggctcttgctctgcaatccggtatccacagacagacttcatgacctgtttatcaagtagcgctaaataagcaggcatataagcggtgaggtgggcatcaaacgcttgctgatagcgctcatcaaccagtttgatcgcctcattccaacgtggatgcgtgggtgtaatgacttccagtgtcaaatcggctagacaaggtagaggtttcattggtgtttccctttgcttactctgtaagtcaaaagtaatccacctaacttaagaatcccttaatataccgaaacgacttaaattagcagctcgccagccaatacgttcatcctgatgagcagagacaagttcgatgcttgaggcaaacccacctagccagcaccgccgcaacgtcaaataggtaaagtatatttacactgtaaattcacaagcaaagccaagatttccgttcgcaccgcttgctcgacttgccgcttcccacttaactgaaactgctcggcacaggccgcccaacttttacgctgcagaattttactgatcaacaaaggggataggctctctagtgatggagccgttgccagtagccaagcataaagccacaccgccacgctttcgtaatttgctccacctcgcgcgtaacgctcgatcaattctaaagggatcagaggttgaggcaatgcgacagtgctaggtaaaagctgttggatgatttgtggctccaacgcttgtagagaatcactgagttcaaaaatccaatgcgcactaaactgctgtttggcttgctccaaccaatcgagatgctctccgcgcaccatcaagagagagtaacaaccactcgcctgatctcgatgcgaaccgagttttattggtacgaagtggttagctagccaaaatggcaacaaatcttcactcaccccgaagctggtggcgtaataatccgcgtgatgctgcgcaataaaatgggtcaacaattggctacctataccttggcgttggcagtcgggatggacggcaatgcgtaatattcgccaacaagattggcgcgccgcttggctaattcctaattgattcgccaaagtcacgggggttaaatgccctttcggacgccgcgttcccagttgaatcgcctcaatcgtcggcgcgtctaactccccttcacggaccgccaaaacgcaaccgacgcacacctctccttgataagcgacgaacaacgtcatcgcttcatcttgcagtaaagcaaagagatcgttgggcgaggtttgataatgcgcattgaccaaaagtgcaaacacttgtgctaatcgctcaggttgctccacacactcaggctgactgaataaagaaaaagacagcggttctctcgcctgctctagggcaacttcaggcaactcactttgtagaagaaatacctgattttgccactgttccagcgcatcccccgccgcccagcggatcggctgctcaagatgcagtgagcgcatctgcgggcgctgtacttgcaaccaactctgaaattttagagaaaaaccgcgcccacacccttcgtagccatgaatggtcgaagaaaatactgcgcggtgatagcgctccacccaacgttttaaaaatggcaacggcagcgcagcggcttcgtcgaccagcaataaatcactctcaggttgagtgcgcagtagctcatccggagccataaaacgtaagcttgactgtgccgtttgcacctcaccgcgctggcgatgggcttgcggtaatgtgcgctgggcatgcacaaacagcggctccacggcagccaaagtaggtgcagtcaccacaatatgcatagagcgcgatgacatcagctctgcggccgccaatcccagtgcgctggtttttccacgcccgcgatcggcagtcagcactaaaggacgcttgcgatgcccagtcacgactttaatgatgctgtcgatcgccaatctttgttcggtataagtttgttcggtattcgttcgcgtaaccgaatccgaattgggtaaagccggcaccgtttgtggcgtaatcacaagcaagcgatgacaagcgcgctctagccagactcgcgcacaatggttgagcgtagtcggttcgccaaccaccaacagtaatccgccgcccaccaaggtacccagcaccgcattaaagctattggcatcccaaccttgcgttaaatctacgatcaggagttggcattctcgccctaaccattgctgaccttggcgatagtcgacacaagtcacaccctctagctcagtttgtcctaacatcaatatcggttgttcggcaaagtgcggaacaagtgttttcaataagtgatgctgccactgtgcatcaccacgcagccaacagccaaagcgagtctgtccttgcttggcgagctgctgaagttgcaataaataggtgattggctgagtcataacgagcgatattccaaaatgatgcgccatgttagcacaagcccaaccgatcgctgtaacgccttgaaaggcatcgtaagaaggaggaaacatttgttaacagaaggctaaaatattttttcttaacgacaaattatatttgctttatcacagcaaaaaattcactaattatgcactcgaaccccggcattgggctgggctaaaaaggaatcaaaatgcaatgaaaactttcattaaaggattggtactttctgcagtcgttgcctcttctcaggtttatgcagagcaaaccctaaacgtgtatgcgtggggtggctatctgccagagaagtcgctgaaagcttttgaacaacaagaaggcgttactattaactattcaacctttgagaataatgagtcaatgtataccaaactcaaacttctgaaaggcactggttacgatgtcgtgtttgcgtccgcttattttatcgaaaagatgggccgtgaagggctactggcagaaatcgatcataaccaaatcccgaacatgaaagatgcaatgccaaccgtattaggactggcgcacgatcctcaaaacaaattctcactcccttacatttgggggattacgggtctttactacaactcgtctaccctgcctaacggaatcacaaaatgggcagatctgtgggataagcaatacgaacagcaagtcatgctgattgacgatatccgcgacgtgtttggtatggctctaaagcttaacggctttagcatcaacaccaaaaatgaagaggaaatcaagaaagcgtacgaatctctggtggcactgaagaaaaacgtattgctgtataactcagatgcgccacacgtgccttacgtttctggcgaagccacactgggcatgcagtggaacggcaacgcttaccaaggccaagtggaaatgcctgagctgaaattcgttatgccagaagaaggcgcggtactgtggatggataacttcaccattccttcaggcagcaagaacattccgttggcgcacaagtttattaactttatgtaccaaccagaaaaccaagctgagattgtacaaagcttaggttatgcctctgccaccaaaggcggtcgagcgctgctaccggcagaactgcgtgataacccgactatcttcccatcggatgaagatatgaaaaaaggcgagttcattaacgatgtcggcccagaaacgctggcgatttatgaaaagtactggcagcgcctaagaaaccaataaggctaagccccctaaaacgcacaaagcccgcatcagcgggctttgttatttgagttgactcagtttagcttacgctgcacaaaatcaagaatatcttgcatcagctcatcatcaattttcttcaaattcagcaccaaattattgcctttacgagcatagctggcgcggcctttgatgagctccaccttcggtgtttcggtgcgcttaggaggtaacacatcttgaatccagctttcgatagtttccgtgacttctttggtaatacgcgccacaccttgagcttgagattgctgccacacgaaaccattttcttgatggcatttcgctaataattgctcacgctgagcctcattcagctcgttaaactgtttatgtaatttaacgatagtagggcggcccagctcgacaacactcggatacgcctgcaaaagctctagcggtaaagcggcggcttttaaggcaccactgaccaatgcctcgctgcactggaacattttggcaagcgctttttggtcttccgcttcaccactatcgagcttggcttgcatctctttacctttctcatatagagaaagaggtttatgcgcattcgcgacatcagacaaaaacttagcgtgctcagcattgatattttcagccacatacaccaaaaactctttgcccgccaagatacaagacatgcgacgacggctaccatcaagcacttcgattttgccatctgcggttttacggccaacggctgggtattgctgtccacgctcacgcaatgtggtcagaacatcagccaaggcatgttcggttaaaaacgcctgttcacgggcattttgagcaaacaccacggttttttccgcgacttcatcagccggaattcgcatcagttcaaaggtcactacctcttcacccgctacagccaactcaatcatctgtgcttgtgctttcaccgcagattgcgcttctgcaggcgtcgttgcacggcgcttatccgcctttccaaacagctttgcgttcagttcagaagttttaattgccataagttacttacccctgattcagtgaagaccaatgtgaatgaagtacgcgctctagctctaaagcacttttttgtaccgcatcctgagcggtcgccaaggtttttttaccgccctcgaaatcgttaacggtcaaatcaaagacggtactgtaagtatccgcacaggtttcaaacgcacggctgcgtgggatggtggccatcatgacttgatcgcccaacaaataattcatttcggtcagtaccgacacctgcttcttgttgtcatcctcaaacatggttggcatcaggcgtacaaattcgagccctttccaatcttcagggaacatctcgtacaccgtgggcaaatgttggaagaaattgaccgtagaagcccagtccagtcgcttcgccgcacaagggatcagtaaggcattcgaggcatacatcgcgttccataccagtggatcaacgtgtggaccagtatcaatcatgatgatgtcaaaatcgctggcaattttatcgatcagcttctctttgagtaagcgaacaatatctagtgattgattttgtgagagatattgccacgcctctgcgttaaacatcgcatcttcaggaaacgcagaaatggttttcaaattcggatattgagttggcaacatcacgtttttgcgcaaaaactcagtgtccacttgcaccccatctggcacattatccagcatgatatcaaccgcggaatagatattcgtatgctcagccagactgatttgtggattcaagaataggcgtaatgaaccttgtgggtctaagtcaatcaagcagatgcggtaacgcttatccaaattgagcgctaaacaagcggcaaggtgtaccgcggtcattgatttccccgtaccacccttttggttctgcacgttgatgatccacggtttattctcattattttttttgcgctcatggaatttaggcacgccagcggcatccatcaacatatgcgcttcggaaagagagatagagtagtgattcgcgttatttttggtaaattgatgtcccgcttcttccatcttagcgatagcttcatcaagcttgcgacgtgttaagcctgaacgagtttccataagggctttagacattggaggaaaatgctcatcacggcgctcctctaatacaatctcaattcgatcggcctgcacttgttgggtaagttgtgcaagctggtagagattctctatcgtttgttctcttttcattgccaatttccgttattagggctttaaacagattgtacagcatagtttatttaaaacaacaaaaaggtgaacataaaacaatgaatcaaaatcacacatat
